United States Patent 11,913,074 (METHODS FOR ASSESSING RISK OF DEVELOPING A VIRAL DISEASE USING A GENETIC TEST) - sequence listing, part 13

SEQ ID NO: 393 - DNA, 101823 bp, Homo sapiens
  source 1..101823: mol_type = genomic DNA
cttaagctcttaagatatttcacatttatttttcagaaatacagaggttcatctaagtatcgcttcttaaacagatgtctatttcaatgacagctctctgtccccgctgtccccacatcaagagcagtacatagtccaacgctctgcacaaagcacacactcgggaattgctgcgctaacagggttatcaagggttactgggttctgagctaatgtaattttctgaaccagagaactgtaattgtccaattcgattttagaaagaggaatgtgtaaaaggttgtccagtaatatacttttgacatattcaagtaataacaataaataaaatttttaggtctgaaaagtctagtaataaacttcaacatcagttcacctagacctccctgtgtgactaaactctctttaattatttcaaaacattaaaaaagaaaccataggtcattaagacaggccaatttctattcaattccgtgaatttttatgctggcattcagagacaccccgaatataaccaccacacagagaaagtctgacattatgcttttatgcaaaatagagaatatcagtgggtacatttaaaatatctactaaccagtatgaatttataactcaaaaaatttaagtatatttattctcttataatctccaaataagggtattacaaaaatgcttatcaagtgatacaagctatagcaccaatcatttgaaagaaatcattccaacgatttctaaagcctttttgaaaattgttgctacagattttttttttttcctttttttgggagacactgagtctgctctgttgcccaggctggagtgcagaggcacaatcataggtaactgtagcctttaccttctggcctcagcttcgcaagaagcaggagctacaggtgtgtgtcactatgcccagctaattattattattattttttttttgtagagagagggtctcgctatgttgcctaggttggttttgaactccagagctcaagtgatcctcccgcctcagcctcccaaagtgctgggattacagacataagccaccgcacccagcttgctgtaatttttcatttcatatgtctgtcactagctatatgacacagtggtttgagccaatactaaaccaaagagaattacaacaaacttttccaatgacttctctattaaaatgataataggtgagatatctcaataagcagattttgtcttcatattaataatattcaataaatcctctcccttcttatgccaaacaattcaaaatttgtctagcccttgtaataccttcagagttttgcattttcaatatttctattattaagtaaaaaaagtttattggaacattttgttctgcttcaaatggtataaccgttttctttttacagtaacttcttatcttttcagtttttcagttttcttcatttttacaatagcttctacctttttatagtttttcagtttcatatgttcaatcatctttaatatttgctgtatctctcagttcatgttagtaactgaaacctttttataacgctaagtattgacaatggtgttggaatattgtgtactgaagccaagccactcaaaaatgctcattttctaaatgttcaactatttcaatttcagaatttcaattaaaatacgcaagcttgatataaaacagtttgaaaattatatcaagcctatttattttaattgaaattaaaaattgaagctctatcaccagagaatacccactgaggatcctatttttgttatttcaattccagttcttcagatgtactgtaattctctttgatgatttcatgtgtgtggtaaatataaagtttatttagaaaacaattaagagatttacttatctgtatattgatacctcatccacggaaaattgaatgtggtgacttatacaacaccataataaaatacctagaaatttttctaaaatattggttggaattctagattgtttaccaagcattacaagggtgctgtctatataaaacctgtttaatgtaaatatttctctcactgaaaccatttttttctcaagtactaacagtgaagtttgatatggtattttagatgttattctttctaacaaaaaacgaaaccatcaaagtcttcttgcattttacattttaagcagaatattaaaactcttatataaaatcaagtttcatcagtagtgattaaaattttactgccttgtttcgtaagtttagcaaaatgctgtttcttatttcaccataagtttcaactgcagcgtgtcatactgatatatttttatgccctccgaagtatttcatggttgaaaatgctcaattacttttaactaaaaagcaggtagtgttaacattattttattaacactgataaaattttaatttaaaaattttaagtgcttcactgtgaaattgactcattagattttttctcattgatgacaacacattttccttatttgagtcataaacttttaacaaaacataactgctacatgattaaatatgtaaatgtttagcactttcaaattttaatgatacaacttttgagcaccattcgcacctgacaatatggcactagcaataataaggcagtcatatttttccttgaaataagctgttttccactccataaatacaaattatttgttttattttgtattcactgttgcacagtatcagaagatgttccaagcttcagttcattattaatatcatttcttctttgttctcctgcagattcagaagattcatgtttatgatgtttaaaaggaatgttaagaaatgtattaaaactttgttatctctccattcttggtgttctatttaatattttattataaattattaagtttatcaataccaaaactcttcacagtatgactaactacataaaaattatgcataaaaataaaaccaaattactaatcacaaaagagcacattaacaataaaatcaaagtaaaactaaactatttagatatagtaactgctacataattcatacatgatgataaactagcaattcttctaaagcaaaatagatcctattctattcagttatcaactggtaagaaagcttttcaataataacaaccagtatcaccataactgttaatactggctaaatatcagccttggatattagtcttgtttgctcaatatcagcttgaaacacatttttaccaaatagccagttcagacatattttactgcatttttctcaagtttgcacatttctaaaaagaaataaagtctcactttatgcccaaattctgaaataatgtaaatttcccccaattaaaaattaatccaggttcagagaactgaaaaactaacagggcaagtgattggtaaattgtgtctatgctactgctaaatggtaggatcactttaatgaacagaaatgctcattaccttttttcaggattaatttttaattcaaggtctttaggaaacaaatcctttcagaatgcttgcttataacacatactgagatgacatgcagacactcttccaacaacccatgttacagccataaaaggcagttgggaattaagaatctctgaatttccatctttgtcaccgacatgaatcctcacctgtaccttggcattagactttgtatatactttacaaatactttacaatttgtgctagctgggtctacaaagaacttcttaaaataccaactcccaaattacatgtggagtaactatatctaagaagcaaagaataactttaaaagccatttttttctatggatactataaaatgtctattcttttccactaaattttattcacataatctaaacaaatttcaagtggcaaaattataccgagccaattatcaattgtttcagtaacataaactttcaccaacaggataagcattgtgcttaaaataaagacctcactaaggggagaaaaaaaataaatcataggtcaaaattaacttcataaacctagagaagaaaactagtaacaggaggagagaattgtattccactaaaagggccttcggagagaagggaagtcatgaatgtactggttctaacttgctcaaatataattgacagaaatgtctgcaaaagcaatagctatggagagggaagaagagtaaaggagggaagtttaaattttgtaatatggccttggttgcagaagtcctgatactaaggtaattctagcaaccttaatattttacagtagattcccccttatccaagattttgcgttctgtgattgcagttacctgtggtcaactgcagtcagaaaatatcacatggaaaattccagaaataattcataagttttaaattacacactattctgaatagtctgatgaaatctcatgctgtcctggctccatcatgctccatcccacccaggacatgaaccattcttttgtccagtggctcccagctttgtcactcagtagccatttaagttaacagattaactatctcagtacacagtgcttctgttcaagtaaccgttattttaacttaataatggcaccaaagtgatgccagcatattgttataattgttctattttattattagttattgctgttcatctcttactatgcctaatttaaaaattcaactttatcatgagtatatctgtatagaaaagaacagtatatagggttctgtaatatctgtggtttcagacatttactgggggtcctggaacttatcccccgtggataaggggaaagtactgtacatataaaagatatcccaagtattaagccccactctagggaaacagatggtagactctatctttgtaaggagaataaaatccacagcttgtaggaaaaatcagccccaaacaacatcaatatattctgaagttctgatgagctaccaagaagagtatgagaaaatattctcccttcacctgtgaggttctataataaagaaaccaagaagaagtctctaagtacaaattcttcaaaaggaagaataaaatctctaacatttcctattctactatatttcttatcaccaggaatctatagattgctctgtagttaaaataacaactggatgtgatgtataaaaacagataagacctttacccgaagctttcaaatttccttagcacctctactgaaaatttcaaaactatactggcttcacagattaagattaaaaaaaataaactttcattaaaaaacaaaagaaacaaaaacactccacatacctggcaaatctgatgacatgcttgatattggcgtatggtggaatggtactgagtagtctgttaatgaaggcggaatagcagcaggatcaaccgaagtcacactgggcacccttacagaagatggctgatacatgagaaccctgttttaaatagcacgggaaattacaaacaatctggctgttagttcacaggagagaagagctgcaccactgggcattctcagtcgttcgttcaccagtttcagcacaactatatggcagctactcactacacagcactccactctactctcctctcccataatagtcttcattttaacatgaacatatcttggctctcaacagcagctgcgacataagagcaagttgacattcaaacacaatgtacagtgctggagtgagatataacacttccatccacaaatagaaatagacatcacttttattaatatgtatgtaatatgtatatgggtatcagtaattttatctataaagaaatttaaaactaacatagaagatccctaaggtttgatttaaatcagggaaccttgagaagtgaagctactcactgtagcacaatccaaatttcttcaagtctaactcgaattgtattaattatttgcaatctttcctgggaatcatctgagcaaaattacccaatcttaaagccgaccaacttgatggcaataggccacaatcagaaacgaggatgagtgttcaggatttaaaatataatatccagaaataaaaatgctggctaccatgatagcacctaccaggtaggtgaaatcctaagagagtttatgattttaaaattagctgttcatgctaccaaaaatacaaattaaacatatgtaataaatacttcacaattggtattatataaaactgtatatacactatagaattactttataatttcaagaagcagtataattaaacatacttttgaaaaagttcaagcttaaacagagattttttttgcattcttcctatttaacctgcattttctcttagcccagggtaaacaactacaacttcacaagaaagacatccttgaatgtatgtaggaaactgagcactgttactggtcttatggttgatggtgggaaccatggtcacaaagctagactgggataacctctgggcatcctttccctttcctgttattgctgattattaaatatcagtaatgagaaatgatgacaaattgcatgacattctttgtactctggaaaactatttcataacctcaatttaaatgtcaaaccacttaaatatggatatcaatacaaatgtggaaaacagtcatcttgagagtacatacattgttgagttggcaactatgttagtctcagaaaagtgaataaataacacaggtcagagttcagaaatctttgatcaaaaactgatccatttaggaagcttatgacatataatatgcttgaggcaataacataagcctggtatttgaaaatacattttcccgaggtagataaagacagaaggaagttatcttccaaaaatcaaccacatgtctgtaggttagaatctggagatttcttggcctccagtgctactcgaagacctaaaaccacaagcagtatgtgagcaatgttagaaaaggcagactctggaggaaaaagagaagttgggaggagataaaataagttatattgtatctaaagctcatcttttctggaggtttgaaaacagtggtcctccacagggatcaaacgaacaggacatcatcaaaagtttttcaaataacatgagaccacctctcacacacaagagtttatatgagaaactggaggaaggacacagtgggtaaggaggagagagagactggggtatacgtgagtgctggggaggggactaaagaagtggtctgattattctggctgtctcaaagtattaatatcttattgttttaaaaatgttaacaggcaggcttttgaagaccaaatatatatataaagtttcatttaatttaaaaagtttctacttaagagtacatttagagccaggcaaggtggttcacacctgtaatctcaggtctttgggaggccaaggcaggaggattgcttgagctggaagtttgagaccagactacggaacatagggagaccttgtatctacaaaaaaaaaaaaaaagccacatatgctgaagtatgcctaaggtcctagctacttgggaggctgaggctgagactgcttgagtccaggaggtagaggctgcagtgagccatgaatgctccactgcactctagcctagacaacaaagcaagacctcgtctcaaaaaaaagtacatttaacctatcgtgttttttttttctctgccactgaaagaaactaaaagactttctggtacaagaaaaagctaatgaatgtctttttcccactcccccttctcttcctttgctatttcacactggagattttcttttgttttgatcctgattgccctttcaacttgaaatagacttacacgtaacaacaataacagagctccctttccttccctgaccctttgacttacatctataaaaggagtcaagtgaatgtacctacacacctgtctgtcactacagtaacacctaataactgtacgtgtcctgtcacttagtaacatgaaactttaaatgagtaaatagctactccttacttaggcaacaccaaaaggttgactgtcaaaacatgtgaaatgtgaaaatccaatggcggtacaaattagtaaatcaacatctaaaacctcagcaaacatatgaaaagctaaactacttagtgttggttaattcccattacctgaatgttgcaaccattaatacaaattcaactttacatagaatggcttaaagtagtcattagttaggattatcaaattacatactgggagcaggcttttgttatcaaaatcttcacaaagaccacattcagaaacaaaatgattctaaagcctatgcaaaaaatagatatgagtaacagattccatgaaaaaatgtaaatggctatggatggtgaaatgatggatgtaaaaatgtgatgctatatgttaataaaaagatttaaagcttttaaaacttgttactgcctcttcataggattggtaaacacacacagatacgtgtatacattatgcaagtgaccatttatattttaaacgtttgtaactttatccataatatcacagcacaaaagtgaattgctagaatgctgctatatagcaaatattagtattccggattatatgctggatcagagaattgcatgaaactcacatttgctcagacttggatgtctgaaaataggttgaccatttctatttataaccctgaagttcactgtatgctcccactttatgatcataaaagtataaaaaagatgcaattttgctaccaattcttaatgattatcaatctggagacatatagatttatccttattatgtttcctgtctttagaataccttcttattaaggcaaagcaaccactcatttttcagaaggggcacaatatgtaaaattatcttttaatatggaaaaacatcagaggttttctaaatgtcttaagattaacatacaagtttcttctgacaggtattataagactgcatttaaagactccggttcgtaagcaaagaaagggaataggactgccatcaaaatggcaatgattctctctaggtgagatattttttgctttcttcttggtgctttgtaaaattgtttataagaataatttttactaaaataataatacctcttaaaagatagttgctcacaggccaggcgtggtggcttatgcattttgtaatcctagcactttggcaggccaagacaggtggatggcttgagctcaggagttcgagaccagcctgtgcaacatggtaaaaccccatgtttacaaaaaaaaaaaaaacacaaaaaaattagctgggggtggtagttccagctacttggagggctgaggcaggaggatcgcttcaacccaggaggtcaagactgcagtgagccgcgatcacaccacggcattctagcctgggtcacaaactgagaccctgtctcaaaaaattaaaaaaaaaaaaaaatagttgctcacataatttcggggctgtaaattagagtaagttttcctgatttctcattctctgttctttctcatttgcttactatctttgatggccaagaaatcctatgataaacttacacagcacaggaaaaccataaaaactctagatgctgaactacaagaaaggatatgaaaaggacaaccaagaacaaagtcacaaaagtctaagagtaggaggggatcacagagatgatataactatagcatgagcctccactatgacactgtgacaggtggcagccactctaacacagaaaatatgattttgggacaaaagattaaatttcctagtattcagaaagctccaatagaaagtttatccatgtatctttagtccactggacctaaatctggtaataaagaacaaacttaatccagctagtcattgtctcccttttaagaactacaaggtgggtatcaaataatctcttctcctggtttaacagcttcagtccttaagatccactcatccatcttgctccagattccactattcaccttcccgttcccctgctctggccatactcatttgttaataccattcttgatgatcagcactgactgaaatgctctgagagtcatatagcctaaaatggaacaaaactggcatggtatggatcctggacactatgcttattttattaatgctaagaacaaactgatttcagtggtgaactcttcaaaccattaactgaaacctgacatttgaaagagtttctatcagaaatggcaattaatttactgaaggcctttccaacatccatgaagatgactacaaagttgtccttatgacgagatccatcttatcaatgtatttcctaatattaaagcactcctgggataaactctagttggtcacagatgtcattttaatatataattaaatgatttcctaagactgaattcagaattttcatttatctttctatgtgagtctgtttcttaagagttcttccgtgtattaatgtgtatgtatgtctaggttgggtgttaagggctacatcagcttcatggaacgaactaggtagctgcgctttatacagacttttaaaataaactttcatgtgttgctggtttagtcacaaatttctatcttatacttaccaatgttagtttttgttttcttttcagcctaaatgaggaaccttaacatttatctctatagtagctgatcacagatgtaaactatccttattcctctgcatactgaggtcatttcagattttgtcgcccactgtgtatgtgccatccctcctgtttcatggacttatcaaacacagataaaaatgtagtaaaggacagagggtagacccttgtggcatgccaccagagacatgctccaagatcacaacaactcatgagtcagcatcactaggcatgacctctcaacctggcatgaattcagccaactgcagtacttgcaactcatgtttttccactatattctaaagcgtatcattacagagtaaaatccagaaacatcacatctaagcattcattccccttcaaaatacattttgaacgtaaccatttcaaaattataacttcattttctgtttatcatttaaattacagatgtaccaaccaatttgtctcaaaggagcaataaatgattggcacaccaggaaaaaatccacttgaaatacttcctcattttgttccacacacacaaaaaccccacctcattctaattaaatgggtagaagtaaatatatgcctttaatatatgtgtaaattatatttggaaatgtaagtattttaacagcaaagaaggcagctgaaaaggtttaattcttaaaattataaaaataaacaatgttgcaaaacaagacattttatataaaatgtctaaacaggcattatagacacaaaaaaacgattgcctagatttggggtgtaaataggaataaactacaaaagaacatgaagaaagttttttgggtgttgaaaatattctactactgaatcatggtgatgattgcacagctctatgtatttactaaaatcactgaattgtgccattatatacttaagatgggtacattttatgctatgtaaattataactcagtaaagccattagaaaaccaagtggaccaagaggccaaaaagatgacactagcaaacccaagtttgaaagaatgtgttcgtagacagccaggagaactctcctgttatctccttttatggttcaaaacctctctgaaaaagcaactattgttaaatacccaaacctgatttttaatgcaggtcagtaatgccttctgccagataacttacagagaatccacgctaaaattcaggtagaatgccatcctacccacctatattttgccctggagagggtgaaaagggaaaggaatcaatttttattgggaaattaccacatgcctgacaccgaggctttctttcatctcattaaaacctgaaaatgatcctgtaatataggcgttatttagctccatttaacagaacacaaaaaagaggctcaatcaaattaagtatttcatctaagatcacagaacaagtaagcgatggtgtgccaaaattggaatccatacttgtcagattcccagttccacactccattacaccagactttctcatctggtctgagatgccaaatttccttacaaacaggttcaagaaaataacaaaaagtctcaggtaggaaataaatacctcacacgctcactttccaaagatgtaaatattttctccatcaaaatttgcttcctataaacaatgtgcttactcgaaaatatttcaactcaacaaaggcaaattaaaatagccttctacagttatgccatttcccaaagagacatttataaatctatccaagagcaattagttgcaagggtaatgaacaatagtgaactataaattaacaaaccctttggttgggctgctttgtgtttctgacataaagatgcatttccttttggcaggagggtcttcctcttcgtcagaagagctttctattgtaagatcaataacatctactttcttcttgcttgcctcactggctacagtcactgaacaaggcttactgaggacgcttgaacctgcatgtaaagaaacaaaaggaaaaaaaaattaaaggtataacacaaataaactctagtggtagagtctagtatattcagtatagtatgttcctgacaacatatagccagtgaagccacatactccaacccatggacaaataccaactccctaactccagacctctgtctgtaaaatggttgttcacctagggagacaggtgagcactattccttgacagatggttagaagtctcattcagacagaatgttcttagttatgcctccaataccactgaaggatttgtgcagctcctactgctcatcctgtctctgcaggtcagcagtcgttttacagaaagacacgcagagttagggaactggtctcaggtcatgggacaagaatgggtgagttcaacagctatgtattctcgcacacatgtggcacagttagctcagaaccagatatttccattctagcaattatgcttatatcaaagaaagtacagacttttcaccataagccagaacttgataaaaactttcatcttgataagttgaaaaaaacccaaacctctcaattaagttactaagacatttaaacttttcttatgaattatctgctaatcacgtaggttctttctacccacaaagacagtctcacataccatatttgttaactcacattttcacagaaaagtatgttattatctgtaatgtatttagttaaaaatgaatgacagttgataatggaaaagcaacagaaacttatcaactaaatcactccccatttttctgaaagatgagagaaaccttggtcactgcactcaggtttagtgtcaatcgcagaggaataattaataatggcataaatcctttattttttcccctttcttcttactccattcattacattgtttgttagaacttcaaatgtaatcagaacaaaactgaaatgcagtgagtagactgttagataaaaagaaactctaagttcacgtgtgggtttcaatgagactgttagataaaaagaaactctaagttcacctgtgcgtttcaattactccaaatgccctcagtttccctacttagtgtggatggatgcaggcagttgatggatgagtatacattctaggtaatcaaggcaatgttaaaattcttctccacaaagaaatggaaggtaacaatttgtttactttctgagcaactaacctgtgaccatccccaaaccaccaaggccattaaccaatgatgcagcctctctaacctcacctccacctagggttccacctacagatactctaagaacaattctgaaaaactgtccatataaattcatttgtgactttttgttttgtaacaaacatcatattttaaaatgattttagatgaatgtttcctttattctacacaggaaaaatatactatgaaatagctgataagatggtataaactttagcacattccttcaggaaagaataaaaatcatttgggggaaaactatatatcatcaaaagactgagtcaacaagctgaattccaaacgtatagttctaggggccaagattaatgataatgttgcacgagtctcactgctttactctctgctgctattctacacatactttctatttttgtacacggttggctggatactttcatagcttctttcttcggtctcattggacaccaagaaccatcttcttggaatttgatctcatctacatcagaacagtcattgagaatttccataaaaagcctaaaaaacaattaagaagtacatacatgtgatcaacagctttgcctaaaggtgaaataagaaagtaatacacattaccttgaaaacataagtaatgttagctgacccccttttcttttggtattgcaatactttatactttacaacaattattacactccctttgtcctatgttttaaatctgtaacaggcaacataatagttaagtaacttactgagcatcacctgtgtaactcaatgagtataaatggctagagagaagtagatacctggagcctcctagctgaggctggcagtaagaacaacctctaacacagcacaaaaaacaaacatcagcagataaaggttactatatagtaaaataatttataaactttaacttcgagaaaaaaggataatggggtaggggaaggagggaagaaaagggaaataaaagaagtctcaataaatttaaaataagtgtatttgaattaagttcaaattaagtccgtaccagaaaaacctgaaaacttggaaactaaacaaaagaaacatgagtcaaagataaaaataagattttaaactgaatgaaaataaaaatgtaataaaatttgtggactgtattatttaaacactgaagtagtatttaaaggaaaatttatagcattaatcttccctaattagaaataaagtctcaaatcagtaactttatgaaactagaaaaaaaagcaaattatagtaaaagcaagaaaagagaaataacaaagaacaaaacaaacaaatagaaaaaaagaaaaacagaaaaatcagtttctagtcaaacttatttacactcactccaaaagaaacagataatctaagaagccctatgtctattaaataagttggatctgtagttaaaaactttgccacaaagaaaatcctaggcccaatgtcttctctagggaattctaccaaatatttgaggagaaataataccactacttccaactcattgtacaaggtcagcattactctgataataaaaccaggcaggcattgcaacaaaactaaatacccaacattcccccatgaactctgcaaaacaaatccaacaacaaatatacacaggataacaaatcatgaccaaatggggttcattcccacaatacaagattagtttaatatccaaaagtcaatcaacataattcaccgtattaccagactagtcaatgcaaggcggtgggaaaacaaaaggcatccacgttagaaagaagaagtaaaactgtctctatttaaaaaacattactgactatatagaaaatcctatgtaatctataataaagctactagaactactaagggatgggaataacatatgttgatatgacagcaatatacaaaggtcaactatatttctatatattagccataatcacaaaaattttttaaataccacagagatatgaaatatttaggaataaacttgacaagagatgtacaagacacattgaaaactacaaaacactgttgagacaaataaacagaaagatacatcctgttcataaatcagaagactcaatactcttatgtcaccacagacttatctacagagtcaatgaaaaacaaatcaaaatcccagcaggttttttcccctaattgacaagctgattccaaaatctgtatgaaaatgcaaagaatctacaatagccaagataattttgaaaaagaagaacaaagttggaagagtcacactacctgacttccagcaaatgcagtattgacataactacagacaaataaatcaatagaacagttcagagatcacacatatagtcaattaatttttgtaaaaggtgcaaaagcaattcaatgaggaaaaacaaatcttaacaaatgatggtgcagcaatcacatggccatataccaaacaaaaacaaaacccttgttctttatcttacaccatacataaaaattaacttgatagaaataataaacctaagtgtaaaagtaaattataaaacttctacaggaagctcagaaaaaatatttgtgaccttgagttagggaaaatgtcttaaaataataccaaaagcacaatctttcataaaagaaaaacttggtaaaccagccttcattcaaagtagacacttctgctttttgacatacactgttaaaagactgaaaagataaaatgatagaaaacatttaaaaatcatatacctggtaagacgtttgtatccagaatacataagaaccaccaacattcaatgacatgaaaacaaaacccaactaaaaagtgggcaaaaggccaggcacggtggctcatgcctgtaatcccagcactttgggatgctgaggcgggtggatcacgaggtcgggagttcgagaccagcctgaccaacatggtgaaaccctgtctctactaaaaatacaaaaattagccaggcgtggtggcgcacacctgtagtcccagctacttgggaggctgaggcaggagaattgcttgaacccaggaggtggaaggttgcgctgagctgagatcatgccactgcactccagcctgggcgacagagcgaaactccatctcaaaacaaacaaacaaacaaacaaacaaaaaaaagtgggcaaaagtttggtcacttcaccaaagaaacgtacagatggagaataaatacgcaaaaagatgctcaaaacaattagtaataaggaaaatgcaaataaacccacaatggagtaccactatataccactagtatgatctaaaattaaaaagattaactggccggatgtggtgactcatgcctgtaatcccagcactttgggaggctgaggtgggtggatcacctgaggtcaggagttggagaccagcctggccactatggcgaaaccccatctctactaaagacacaaaaaattagccaagcgtggtggtgggtgcctgtaatcccagctactggggaggctgaggcaggagaatcacttgaacctggggggtgggggctgcagtgagccaagatggtgccattgcactccagcctgggcaacagagcaagcctctgtctccaaaaaaaaaaaaaaaaagagaagccataccaaatgttaatgagaatgaggagcaatcaaaactctccatatactgctggtggaaatataaaatagtacaaccgctttggaaaacagtttgacagtttcttgcagttaagcacacacctggcatgtgaccaggcattctactcctaagtatttacccaagataaatgaaaacagtccacacaaagacttgggcatgaatgttcacagtagctgtatttccaacagccccaaaacagaaaaaacccatcaacgcatgaaatgacaaactgtgggttagaatgcaactcagcaataaaaatgaactattggtatatgcaacataaatgtatctcaaacaagtatgttgagtaaaagaagttagacaaaggaagcacatagtttatgattccattcatataaaagtctagaaaatccaaactaatctatagaaacagaaagcatatcagtgtttgcttgaggactgagagggagagattgaaaacatacatgagaaaactttaggtgtgatgggtgtgttcattatcttgactgggataatgatttcataggtatataataagtcaaaatttatcaaattgtacattttacatgagtagttcttatgccaaaaatgcctacttcataagaggtttatttttctcaattatactgaaaattcagcataatgtaaatcaaaacccaaaaaggttctgtgtaatttgagaatgcttttattcaagtgaacatggcagaatgtattatgacactagtcaaaaaaattctgaaaagaaatggcctaagaaatactaccacataatagaaatctaataattaaaatagtttcgtattggcccagtaatactttgatcaatggaacaaatagcagttcagaagttaacactagtatttacaagaaatgtattagataatgcaagtagtatctcagatctgtgggagagattattcaagtaaatgtggttgagaataatctgggtgctagggtgacatgatccctaccttaatgggatcacctattccctactgtaaagttccttcctcatccccaattttcctcccacagtgtcattccttaccttcacagcactttacacttaatatacttttttttttttaccatctcccatactagaagtgccctgctcaccatttttagacctagtatctgacacatgataggtatttagtaagtactgtgttgaatgaattcatgaagcaatgtatgacggaacaactgcacaactggaaaaaggaatcacaaatgtgcctgatgaaaacaagcaagtgctcatataaaatctctacaactttctaaacactttcaaggaagacattcaaaaaggaaaagacaagacttgataaaaaaaaatgtaaaccttctgaatggagaacaaaggtcacaataaatacaaataaaagggaaactgggaaaatacatttggcacatgtggacagagaaattaatatcctcaatctataatgactatgtataggccagtaagaaaaagatgagcaagcccatagcaaaatcttttttaaaaaaggaatattaagaggcaatttgtaaaagatattataatgaccaatatatggaattaaagaaatatctgataactcctataatacaaaaattaaaaatcaaaatagctatcttttcaattaggaaattagtagacatttttatttgttgttccattttgttttgtttacttttgaaacagagtctttctccatcacccaggttggagtgcaatggcatgaccattgctcactgcggcctcaaactcctggtctcagacaatcatcctgccttggccttccaaagtgctgggatgacaggtgtgagccaccacacccaagagtagacatttttaaagtaagttttaatacgtaaggctgctaagagggctgagaagtggacgatgttatgcctgttggcatgagagtgaaatgatttactagaagggaaaaatagcttactcctcctgggaggcatcttaataataaatagtaaaagtcttacattccctttgagtatttctatttctaagaacttgaagaaaactccacagacatacacaaaatgccaccttcaaaaatgctaacatcacagggcaattttaaattgaaaaagtagaaacaaatatggaatatcaagaatttagtaaacacatcacaaaatattaatgtgcaaaggggcatgacatatgtaactctcaaatggttcaaaagaattctaaaaatggtaataatcatctctctctacattcacaaatgcacacaccaaaaatgtgtatatgcacacatattaagggagaaagtgataaaacaactgtgatagaatgttaacaactgaagcatctgggtcatagttacatgggaggttctttgtgctagtgttccaactcctctgtaggtttaaaattttttcaaaataagctaaaaataaaaattcagcaaaggaaagttcagaaaggaacattaaagtcccattcactcttcattccccattcctctccacagataatactcttgtaaaacttttgttgtttattttagagatgcaactcactatgttgcccaagctcaccttgaattcctgggctcaagtgatcctcccacctcacgttcctgtgtagctaggactacaggcatgtaccacagtgcctggcttaaaacattttcaagttgtacaagtatctttaaaactctaggatacttttcactatatattgagtaaaaatcatatgtatatattaatataaatcattacataaagtatcatttcagtcttttttaatgtcaataacaaagtcatcaccataggatggtactgctaattttattttcatcttttcagtaactgtattttccaaatcttacatggtacatggatgacgtgcaatttttaaaaaagtattatttgaaacaagatactaaaaattagttcatgtcattttccaaattctgacatgcaatataatatgagagatgatgcttaaagtttggactccagagtcagaaatacctgggcatgaattccagttttgaacttaagagctatgtctgtatctaccctatcacttcctctggtttttgcatagaccctaattgctacttcaagaaattctaggtaagcaaaatgacatcacaaagcaaacttttccctctttcctgtgggctttataaaatataatcttggaaagcaaaaacattgccctcaacgcaaatcatattatagagataaaaatgccactaaccacagtttaaaaaataagattgagtataattaggtataagacggaaaacatacaaacatctggatttatgctagagtagaatttatttagaatttagttcagtaagttgtagtgaacaaaggcattgccaacagctgttgtattagtccatatcagctgttaaaagggatatacttacccatctaatattagactttcataggcagcttttttgtcacacacaggacaaatccaggtgggctttttctcattcatttgtagatagagggcagcatcaaaacactgcagatgtgtacaagtcactgcacggcatgggattgtcagcctcatttttcctaactacaggacaggaaacacaaggaaaactatttcagaaaggagaatgagctcagagggaacatggtcagttgtaaaagtcggaagatgtcatacaagaagatgataaaaatgaaatagaaatccaaatcagaatgtattcccaagaagattacaatatatttttattcattgactgccctatgatttttgaaaaaccatttcactttttcaaaacgggttaacatgtaaatccagattcatatacattgaaagtatgactccttcttacctggtccccagtttccctatttagagaaccactgttatccatctcttgcatgtcctttcacagatgttctaagcataaaccaagtgtgtatttaaagaaatattttcccaggaatgatagtatacaatacacactgttttccaactcacttctgtcatataacttggtgactactgcacacaaatcggtatataaaaagctaccattatatgaaggtatcataatttatttaatcagtacactaatgactgacatttaaattgttcccaatcttttatcactacaaacaatgctgtaatgaatatttctaagatttttatatttataatatttataattcctagaagtataacttttggatggaaagaaaagtacatttgtaatttttgtcacattaacacactatcttccacaaaaagtacctattgggttatgcatacatgtgtattaacatgctttgttccactcaaccttttcaatataatgttattaaattcttcggtctctgccaatctggaaggtgacaaatatcccattacagttgtgaactacattcctcttattttaagtggtagttgagcctcttcttttacttctaagagtcacttgtgtttctaagaactttctacctataaccttttctcatttcccatttggttattaatcttttgttatctatttataggcactctttatataagaaatcacgtgtgtaacatgaactgcaaatatatttttcatttatgttatttataggcactctttatataagaaatcgtgtgtaatatgaactgcaaatatatttttcatttatgaaaatttgtttttatataatcaactgtgtcaatttttcaacatacttttgattaactttagtgctgttaaattcttattccaactagtagtggtccactggcaccaagacgtacacaacactcagatttgatcagaccaggttttcctacataatccttcaaacctccccatatatttcctttacagaaaatatcactgtttataaccagtcctgctattttgattgaaaatttgtttctcccactagatcttatgctccaaaaagacggtctagatctctgctcaccactgaatcctactgtcctagcacaatactagctgacagtatgtgctcagtatttgttgaccagataggagaatgaatggacatggactggaaatggggaaaagaacaaacaggaaacgaagaagacggacctatttttatgctataaagtttgaaagaattcatggcaaaattaaaacattcttagctctgcctgggaggcaggctttttaggatgttctttttcttttggttcatctgtaatttctaattcctctaaaatgaacacctggtaatgtggtaatttaaaaagaaaataatttagctgaatcatcaacacagaagtaacgtttatatagttctacctacgtgcaaggtacagtgttgactactacttcacattactctcaaaaacactttcacaattacataacaattatactaaaaggatggtattattaccatccccatgttataaataaggaaactaaggcacaaagaagctaagtaacctaacgttacaaagttagaaaatggcagagcaggtctgacctgggaagctccagccctgcagagtccactctctcactgctatactgcctctatctaagtgtctaaccagagttctaaaagggagcctcgaaattactgtgattcgatcaaggtatgtggcacgatataactcatcacttagaacagaaaaaggtcagaataaaacctggggcagcttctcttcttatgatacatctttctatatttttcctgcctttaaaaacaaattatttcttaaacagaatcttacagtatgcccaaggcttttatataaatctcataaaatcttcataactctatgactccagaaaagctggtatctacatttctatttctgaaatgaagatgctgaggctacaagaggttaaaaccacacactcactgagacacagctgatggagctatatcacaaatccaaatggtcctcacatcccagagacatgccagttttataacattacaaatggtgttagttttttaatttaattacccaccttttcctcctttgctaagtttttgttctattaaaaatgaacgttgactaaatacctattcagcacccaatgagataaccggttttttatatcctttcaattataaaatgaataattttaatagattttcatattatcctttttaaaaatcacatgttattctttttaagtagtaccaacataaatattggctggttatttagaaattttccaccaatgtaagtgagttggcttttttacacaatcactgtgtggaaacaactcaatcactaaacttattattaaattacactatacctattcaacaaaatgcccacaatgattaaaataagaccaatctacacatactaatatacttaagatacactgttaattaaaaaacagcaagccataggacagtatatatactttccaataaacatacatataattatatagagaattaaatctggaaaaatctatcatgctactagtaatgttacttctgaataacagaccttgtgaatttaaaatgatcatttttactttttggttctatttgaataatctataagtacctatttgtcaatttttataattttttctttaaaataacgttctaactcagcctaccacggtttttacagttatcagttctcatttggtttcaaaacccctttaaactcttaaagattaagacctaggccaggcacggtggctcccagcactttgggaggccgaggagggtggatcacctgaggtcaggagttcgacaccagcccagccaacatggtgaaacccaatctctactaaaaatacaaaaattagctgggtgtggtggtgggcacctgtaatcccagctactcgggagactgaggcaggagaatcacttgaacctgggaggcagaggttgcagtaagccgagatcataccactgcactccagcctgggcgacaagagcaaaactctgtcaaaaaaaaaaaaaaaaaggccgggcacagtggctcacacgtgtaatcccagcattttgggaagccgaggcgggggaatcacgaggtcaaaagctcgagaccagcctgaccaacatggtgaaaccccgtctctactaagaatataaaaattagccgagcatgatggcaggtgcctgtaatcccaactacttgggaggctgaggcaggagaattgcttaaaccaaggaggcggaagttgcagtgagctgagatcgtgccactgcacttcagcctggatgacagagcaagactctatctcaaaaagaaagaaaaagaaaaaaaaaattaagacctcaaagacattttatgtatgtgggctatagttatcaatatttgtatattagaaattaaaacatatttttaaaagacaagagtacacaagcacacattccattagccatcagagcaatgacatcatcatcatctattgggtaacccacgttaaacatcactttatgctcctaagagaaaaagaacacaaaatgccaaaattgtgtgtccatattattataaaaagttttaactttgtagttcttttcaaagagtgtcagggaccttcaggtatccatgggccacattttgcaaactgctgtttagggattgtttttgtcgttttcttctatgctgtttccatctctcctgtcacagccttaaaatttccacagcatacagaaacgagaatatccaggactataaaagttgctgaccctaaatttaattctactctagtggtcttataagaactaatgagcatttcctaagaaggaatttgttaccagctagcaaaattttatcaattgcctagtgactatggcatgttattaaaaaggacctgaatgtgccaccaaaataaattctaattctaatttaatcagatgatgatgcttttttgaaatttattatttttatgaatggttatctaagtaatgcaacacttttttcctataaaatgttaagctggcattatccaaattctattcactgtagactaattactaccaatctaaattaagagagtttttaagttgaaaaggcccaaaatggtggtttccaactcttttcagcaggactttttttttttttttaaacatactagaatctcaagagataaaatcaaacctagctttctttctttctttttctctcccccagctacccagtccacctctgcaggacagactgaaaatcactagctgaaatcaccaaagtgaaactcctatgtaaaattcagatatggtgttcagaaatataattatgcacactcaattagatcctcttcagtaactactgtgacattaccttcctttagtcccaaggacagaggttttagaatttgctcccacttttcagactcacgtccactgcaaatcactttacgaaaatactgtgaaatgtaataaacatttattctatcaccctacactatcattttctcttgtttttgccaaataacccagggttcacttcttatttaagtgcctgggatttatttttttccttctccgtttcccattactgcaccagatcccatgttatttccattgttagctggctggactccattctgctttctccaactgataataggacttactctttctcaaacactgctttcatcatctaacttctgtcatccatccaccaaatctaatcaaaacacctgtgtctggtattctaattaatatataccacatattacagtttagctacccaactttatgttaacactactactatagcccaaagagtagcattcattcttttcttagaaagtgctctgaaaagattgatgaacccccaggaaaagctcaaaagacagtctcacgaatagacctgttgtcacttctgagcagagagaaaaaaacatttcagaaacttaaaacaagatttcaaaaacctatttgatctgttacttcatttcttcaagtaactgaaaagttaattttcttaaaaattggtaatgtttggaaggaactgctccctattcttacatagaaggaatcctaacctctctgatacactactttcactattattgaaagtttggctaggtgagatggctcatgcctgtaatcccattattttgggaggccaagatgggcagatcacttgaggtcagaagtttgagatcagcctgggcaacatggcgaaagatctctacaaaagacaccaaaattagccaggtgtggtggcgtgtggcggtagtccctgctactcaggaggctgagatgggaagatcacttgaacccaggaggttgaagctgcagtgagctgtgttcatgctactgcattccagcatgggcaacagagagagaccctgtctcaaaaaaaatttaaaataaattaaaaaaaaaaaaaaggatatgttatgaatgcaaaaaaaaaaaaaaaaatttaaaaagcctgagaatctgttagtatgtttggccattgtattttgttttggttgctctcatgtagaatggcaaactgtatgaagaaaaaaaatttaaaagattctaagaaaatggcactgcacaactgtaaaactccttaggtaagttgtgtagactttcttcctgatacaatagtttgacatctaaaacataatggtgacacgagtttcctccccatatggtgactgtatgtggaatagagctggcaattaatgtttgctgaatatactagggatacataataaaaaatcgtcaatatccaactgttttttaaccaacaaaaaggcaatttcacttgtttcaatctactatcaattttgattttaacatgagagcgaagaaaagtataataacctgaagatactgaaaagaactcatgcctgaaggtttgcatagagcctgcactcagaggaagtcgtgtgtccttccgcatgcctcctagaacctctgccaacaccctcagggctttcaggtcttaccctactggaactgcacacctcttccctgcgtttgctaagagcaggttcccagtatccaagcaatcctcatatcaaaaaattatatttcaataaaggcaaattcatgtttttaagttaatgaagattaaaagagtgacacttcaaaaaaagatctgcaaataccactttccagaataaaagagatgtacttgtaatcaggacatgtatatttcagcccaatctggcagcatggtatattggaaaaagaacaggaatatcagaacactacaatctttatccttgttctaccaataactgtgtaatttgggttagccaacctcattcagtctcagtttcttcatctacaaaatgaagacaactcctccacacaggtttgctaagacagttaaataaaagaacatacagtagagactcaacaaatcattctcttttctgacacaatttctccccatttaaaaaactgcacatttctcaaaatggtgggtagtcatcaaatacccacaaaactacattataaattcctgattccatgactttttctcattaagttcttcttaaccggaaagggttcccctccaattcattcactgctcctgaccctcccatctcctcttggtagtaaaacagcctaactgtaagtgaagtctgcaccatttttatgggagttggttttatttttcaaactcaattattaacattctaagcaagcctcaatattttctcccacaattagctcagtggcaagtacacaggaggatgtgagagttgctgactgatttctccctcatactttctatgtaaggagatataaaagaaaaattattgtgcaatttaaaagaacattacaaagacatcctacacatcctaactcactaaactaagaccatcaattagcatttatcaggccctagtcactttattgctatttttcagtatcatttatattctgataaaaggagtcagctcttaatatatttttattactagctgtatattatctacaacattaattacaacagattattctgagcctaaagctatcttccctcttctttgtattctttgcatgcccaaataatacaaagaattgtgacttaatcatgaagattccttaatgggaaaagacaaaagttcagcattcttcataatatatcattcattcccacacttacttttataggaaagttaatcatttataaaaagtcaaattccccaaaatgttttgttgctttacttacagggcacatcaaggatacccgaaggctagttgtagcaatttcactatcaggatctgcagtaagtttttctttaactttaaaaagaagagaaaaaaaaaaatttaaaaaaattaagggtgacaaagaaatggaattatagaaatatatagcatcttaaaacaaaatgttacatattaatgtattgacaacacgatcacactcccaatataagttaaagaattatgaacatgcaaatttctttgtttaaattcttaaaatttctttttaaaagtaaaactgctggcaagcaagactttcaaaatagaaagctatgtaagacttaagaacaaaacaacaattaggagaggaagctggaatgcagcagtaccctgagcgtcaaagcttttccaacacacattcatcacagtttttattatgcactattgtttgtttccaacaattattaaatttgtaaacagaaaagataaaaatatttatacttcctttgataattaaaaactactatgtggtaatgtgtctacaattttactcaccagtaatgtatataaattagtatatacacaagctaacaaatatatactaatatattgatgtgagcaatatttaaagcattaaagtatctcatatgctcaatctttttttttttttttaaatgcttggtcttattaaacattacttacttagtgctctggaatgatcagggtttctaatacctttcatttttaatctctgtaataacatggctgatgtaagctgccgtacaagatatacagacatagagtaattctacaaacaaacaaaaaaaacctgcattaaagatgagagataatattctctttgtttacatgaaatacttatttaagaaactctggtttctaaaaataacattcaaaataacttccatggaatggtcaatcactgcgaaggggacaaaattcaccaagctacttcactgaaaataaaagctcaatcattttaaaggtatttcttgatcatttatcactttaaaacattcgctggtatgggaatataggttagatcaatggtttccaaactatggttcttatttagcaaaactggtaccttaggggccaccctgaaaatgtaccctcctatgactaaccagaatcttgctaaccaaaatcattctgcttttatcgactttatgtaatgaggttctcatattttcacttaaaagaggaattccactgcagaaacaaattccaaaggccagtggtctgaattaacactgcaaatccagagttccaaagttctaattctggcagaagaaaccacctgctactacatggcctttgagtaaatcacgcaaatgaaccaggtatcagctttcttctgaggaaagctttgataaattaactcctgtaccccaaatgggtattttattgacaagcagcagctactatagtatgtaagacacatgaagaatgataaaaattaaaaagtcaagccagaaaacaacagcgtccaatcccatacctgttagatctggcacaaaggaaccttcattagctatttatagagctatgaacagacaaaatataatttcacataaatgttaaaaaaaaaaaacctatcttcccattttattaaatatattcattcaattgattctacaataaacatcatacttttaatagctgccaaaccaagtattttaaatattttttaatgttcttttagatatctaaatacccaacttatggtgtaaattctaggtcaattaatcattttaattataaggaagagtattatccccattacatggcaaaagttttcaatgtctacaatcatttattccaatgtctgtaaagttactcccagctctgcaattaccttggtggtaaaacaaaaaattcctgctataaataatgcctcaatttctccatccataaaacaggaatattattctgtttaggaacatgtaataagaacactgaaactgatgcttcatgtaatattaacactgaagctgatggtcagaaattaactgaaatctcctttccattcattatttcagttatataaacaagtaattctaaaatgtaaattccttgttgtattaactggtatctcaaaattgacataatttattataagaccaaaaatcaacagaaagtcaagttcatcaacttgaaggtatagagaaaatattataattctaagtaaatatttttatacaaatgcttacaggttatctgaaatatcagttgtttatagaaaggctagaacagattatttctaatcacaacatgtgtacatttaaccatttctcccccaaacggataaaactttctttgttcctcttcataaatatttatcatccaaagcttctagtttattaaaatactaaacacaaacatacatacaattgtggttaaaccattaccttaagaaatataaatatgcatatttcctttccaggaaaataaagagatgatattcaggaaagctcagagttaaagtttttaactttaagaatctccacactgccacctctaaactgaaaattactgctttttagagattacaatccaaaaacagaaagagctgaagccaacagcttaagaaaaaacacagaaagtcaaccctcagtggggtcactgtcctgctacccaaaacggagagcttttaccttcccaatttctgatgcccaagaaatggaaatttggtttggcacagctgaagataacctaactaaagatgtaatattcaaggggcgtccagggcgcttctgttcaatcccatttttaggcggtggtgcatagccctataaccgtaagaaagaaaaattatttcaaatcatctgcaggaagattaaacattttctccaagatagatacaggatcctgcccaatttcagttacactatttttattttagcctaaaaatcatatagcccttatgatcattatcaacccaaaataggaaaataacctttgaaaaaaggttacaaaatatttcacaagtccagaaaggtaggaaaaaaatccatgttccaacattaaaattaaagatgctgacatcttgccacattggctatgaatggttttcctttttcataggacaccaagctttacagataaagtcacaactttttataacgattcatccttagcagtccccattcaaaatacatgcacatattggaggtgggaaagaaaaaaaccaaactgggaagtgaggggaaagaaagaacaaactaatgaatttcatttttaaaatctggtgagtgataaaaatattttccactgccttttctctgggtggaacagaaatggtaatcttttaaaccaggttaagttaacaaataaggataatcaacatttcagttgtcattaaatgagcctgatggctatcaaaatactgctatttatgctttaatctacttttatgtagtcatcaaccgtatttttttttttttttttgagacggagtctggctctgtcgcccaggctggagtacagtggcgcgaacttggctcactgcaagctccgcctctcgggttcacgccagtctcctgtctcagcctcctgagtaactgggactacaggcgcctgccacaacatccggctaatttttttgtatttttagtagagacagggtttcaccatgttagccaggatggtcttgatctcctgacctcgtgatcagcctgcctcggccttccaaagtgctgggattacaggcgtgagccacagtgcccggccaactgttcgttttaaatagcaagtatactcatttctgattcgcagtatatccaattcccaattaccgcaagacttcactctgatttttcagagccaaaataatatattttttagaaaattaaaatgtcttagctgcaaaaaatctacatattgaaaagtagataccatatttcactgatgctaggatgtcagtgatgtaatttaattatgtactattgagaaagagaaaatactatgtatatatggcaaagaaatggaagcaaaatgaattaacatattcccttttgtacagaagaaacttctgaatcacttttcactcagtcattaatgcatacatttttccacatgacactctcctatgtgcaagcaggaattttagagagaaaagtatcttttaaaactgtatttcattccactaatgtctcagatttctctgcaagtcactgacaccattaactggatgtgttaatggggatacaatctggatcttatgagaatccatcaatgaaaagttttcagacaacagccaggattcatgcttctttctcaaaatgtccttaaattatttattaactgaaaagccagggagtacagctaaccagtcacgccatgccaataacatcaaagttgcacaggtgcaggcaatgataatacgtcacagctgacacctggtcaccagcaattttaagacacttctggatttcggcaatgctaaaatatgcaccttaggaccaatgaaaactagtactggtagtatcacaagcaaagaggaacacaccctgtctaccacaacttgggaacacccttcactgtctcataagaggcaagacagtaattattaaatggtagtccacatgataatgtgtaatctataacttgcaacaaaattctgaaaatcattaaaaacgtttgagcaggggaataaaagacaaagagaagaacttcaataacttgcattataatatggaaatgaaagagagagacagtgtgtgtgtgtgtgtgtgtgtgagagagagagagtaggaaggttatgcccatcttaagttgctcaagtgaaaaaaaaaaaaagttgctcagaaaaaaaaaaacaactcctaagaaaagtcctctcataaagactcaaggagctgattcaatgagcatcaagcacaaggagtatcaacaccagtatctaggtaattttgaacaaaacttttgttttgcctgttttgggcctggaagataattctgtctgctggtatgtccactggtaggttaaccaaataaaaataatgttacagggtctgtcagaaggatagaaataactcatgaactaaaatgtgcactctggaaattagaatttaagacataacactgtctgacacagtagaaaagggcaacagaagcagggagagtaacactcatgtaagaatgaagtgtcagcaaactcagaatcattttagtctcactcagcataaagtgttttcaatctattctgtatcccatttgagtagtgtgactttactggtaattctgagttatctgataacttgtattctacctgtaaccatcagcaccacccctacccaaccatcaatttcctggttattgataatatattaatagttggaattttataaaatataaagtttagccttcacacatatttctaacaattttccatatttaaagcaaaaataaagtcaagttcatgtgacagggaaccagtggggcaaatatgcgagctttctaagcaaaggccactggacagcaccagcggaacactttgtggtagtactgtgacacactcaaagaattttttatgtttcatgctctgatgacaccctaccctacttgcaactgtgacaaaagttgtccacaattattgtactttaacattttcctccaaattttctaattaccactactacttgaatacttctaacaaagatttactttttaactttaaattacggaaatttcaaacatacacaagaaaggaacaaatagcagggacccaccaaccaggttcaataattatcaacatgttgccattcttgtttcaaatgcttttggccccaaagccagtctgccctaaaacacacacaccacaaaaatacacatttctttttgtccttatttaaactcaaattctagacatgccatttaacccagatatttaacatgcatctctaataagactttaaaaacccacagcattacaaccccacaaaaataatcacaattttaaaaaatcacctaacaccttgtctttcgattcagatctcccaggtgcctcaaaatttcttttcctgttatccttttattgttgaaaattttaaacatatacaaaaatagagaaaaaagtataatatgtatatatctaccagttcagtaatgtacttacccatgaacaatctttacctactctacccaactcccactctagattattttaaagcaaatctcagatacattttctattttctccagatgtagtttagtatagatgtccttttacagcttgaatcagaattcaaaactagagccccacaccgcacttagttaggtctctgaagtctcctttattctataaacataacccctgccatctccaaacacacacactttttccccaatgctgttgttctactggagaaaccaggacttttgacctgaagaatgacttcgcattctagattaggtatattgcttcctcgaagtataaggtttgttgctctacctcccatatatttttaaagccagtcattagttgtataagcttgattaaacttggggtaaaaattttagaaacaaaaaacttcacagaaaatgttgcatacttcatatggtgctacatcataaggcacagaaggtggtttgccctgttttcagtggtgtcaagattgatcaggagttcaggggatgtcagcctgattcctctaccatgaagttccccgtcaagcttcggcatccattgatgatagctacctagacccattatatgattatgaattgtggaataatgattttctaattctattacccttttgattgtattagccgaaatgtttccataaagagcttgaccacatcaacagctggtcaccttgaaataaatgattctcttccttcatcaatcttcggagcagcagtgagttagtgcaacctccagtggctttagtataattattataagcacacttacatatttgatagttttgagtctactataatcattattctttcagatgtcaaaattatcccttctcaggtaaggaggtgcctcttcaaattggggtgagtgtgcacacaattatgtgttttaaaagaagaaatgttgagtttatgtcagtcctgatttactatgagacaggccatcagggtaactaacacacaacatcagggaacataaatccatgaactcagaaatacaatttataaggagaagggggccagtactgctaagtcttctggctgcaccaaaggaactacttggagattgctgccagctgaattacagcacatatcctctctactctttgggatctttaaaagaaatattcttgtcaacccttcttcctttcttcaaccttagagctacacaagatttatagatatttctcacaaattgtttagaagaaaaataatccagcttcttaaaataactccctaaacaaagagggcctttttctttcttctgcccattaaaaacatggaatgttctcatctggctgtcagtctgtacactggcagcccttggagtcaaagatgggagatggtctctgcagcaggttcttgtctgtccacactgcatgtcaccatcccacaagccctactatgagctgctgtcttccttgcaccaagggaacctggaaaatgaatgcatgaaggtgttttgtaaaactcagcatcttgatgtaggttaaaaagcacatatgctgcttgcatcactatttgatccttaacagtctagggacacgttgccattttcaaagtaataccatttcccattcctatgtttactttgtacatgaagtatagtggtcaactgccatgggtccataaagactgggtattacagtaagatcatacacataaggacttcttccaggacacagacaaatgccaccatattcagagctctaatgggcaattcatgactgtgtcaagcttttccctccaggattcatggttcaatacaccaggatcacgggcaaggaccacctatcaaatttcttttgtggcttgttgatgcttcttaaaactggaacaaagtccctgaggctctccatggtggcaagagctcactataactcctatagggccacagcagctttcttcttctgaggctgcagcatactcacgtaattcttaaaaactgcagaatcttgttttatatttaaaaagactccacatttcattatcccaatcaatagcaactgtggatcaagtggtggtttaagatgttttccatcagatgcgcatgtgaatttctgtcagctgttctataggactttacggagctagggtaaaaagactctttgggaaaggcaggcatttgattttctttgggatggccctataagggtcaggcaaatcctccccattgccttctatttttgaaaatatgtctttgcctttctctcaatgctctatttcttctcctccttcacaactgcccatggagctgctgcaggcccctggctccagggatgccagactcatcagacaaaggctgctttatgtagtagtcaatatgttcacaaatagtctaatacaagtaatcaggggttagtgggtgctttgggacagaaatcagcagtaactaagtaacaatgccccagaggaagtactcaactgcctaaattcttctccctcaaaagaactggaagagtaacaaactccaagccatcctcagtggtactgtagacctcctacaggaaggtatcatcccaaaatgtgacactgactggtccatttggaaattctggtaacgtctatgtttacacatctgtagccaccatattttccatagcaatgccacagagtttaggcacaacctcacacatttcagatgcagctcccatcactggcacagtcacacgatgatacaggataagccttcaaggtgagtccacagacaccaagaagccctccatagtcttatctttcatcacagataatgggaggggcaaatagcaatgagagtcaaaggtcaaagaaatcttagcagccagacgcagtggctcacacctgtaatcccaacaccttgggaggccaacataggtggatcacttgagcccaggagttcaagaccagcctgggcaacacggcgaagccctgtctctacaaaaaatacaaaaatgagccagccatagcggtgcatgcctgtagtcccagctactaaggagagtgagatgggagaatcgcttgagcctctaggaggctaagactgcagagtgagccgagactacactaatgcactccagcctgggcaacagacctgagagcctttttttttttttaaataaaaaaaaaaaggaaaaaatgaaatcttagcacatctagggcaaagaaaaatggttatgaaaaggccatgggacaggtgcacagggttgtgtattaatctgttttgccaggctttctttgtcacacatgcagttacccattggtatctttcagctccaagtagggctgcttcttcccttggttcagatctttgtgcaaactagccaaataaaagataggccaggcgtggtggctcacgcctgtaatcccagcactttgggaggccaaggcaggtggatcacgaggtcaggagttcgagaccagcctgcccacatggtgaaaccctgtccctactaaaattacaaaaaccagccaggtgtggtggcaggcacctgtaatcccagctactcagaaggctgaggctggagaactgcctgaacccaggaggcagaggttgcagtgagccgagatcacaccactgcactccagcctgggtgacacagcaagactctatcttgggtggggatgggaggggagtgggaaaaaaaggatagctcctgagaatcttgttgctagtagccggaaacctgacaaactaaatgtcccacccggggaaacatgtatgggccatgtaagcaatcccccctgaccatacctactcagcctctgcaattccccttcactcccaggactgtctcaatggatttcagtctcagatgcatctttcaaaaagagtcacgtcagtgatgcagtgttgctcaagccctttaaaggttcacaaaacaagtatttctcaggtctctaagtccacaggctgtgtatgcgacaaatgagactcctgacaaccaagagaagtcagatccctctgtccacaagaccagggtcagtctcagtcatggaatttcttcactttggggcccaattcttagcacttggctctggagagcccagagtcctagatcatattgtctgacttgcttggctactcgtgagtactgctcatatattagtccagagcccagtctcgtgttcagcagggatattacacagcttccccatttcctcaatagttgcgaagagtgtcagctctggtgaaatgacaactgggcctagtcagggagtcactgctctcttagtgattcagttacagtaaatacacctccaactttgtagtgcttgacaaacgtgccatgttgtactatttttttgattatggctttgctggccttcttacagaatggtaccaatttagtaatgtatccaaaatggaaaccaatacatagtccagttctacatttattattttattttattaagacttgactatcaggatttgaagagtcaaaagccatctattaggccagagacaggctgcatgcatttacattgtatacatcctaggtgctgaagcccatatactctctcactgcttaaatgtgttgtcaaccaactattattgcacccacccaccacaagtgaatgcatcatcaaggcccaagctgggaatttttgatctctgtagttagccactctcagcagcctctgcttttccccatgccatccacaggccaggcccagctaatgcagacatcccacacatgctgtcctatacatgaaagtgcccaagtcctccccttcaactatgctgtttgatatgatcccaagagtgtttcacagcatccttgatttcttaagtaagatgctccaggctctagccaggtacagtggtgcacaactgtattccccactactcaggaggctgaggtaggaggattgcttgagcctataaattcaaatcaagcctggggaacacagtaggaccttgtctctttaaaaaaaaaaaaaaaaaaaaaaaaaaaattccaggcttatgttttccatctccttcagacctgaaataagccatttattatttatccaagaagccatgggttaccctagtggaaaatagtatttaatctggatgctaaaactgttcactggtattcagctgtcactgttgcactgtttctaggccttgtcagtgtttatattaaacttatatgcaaatctggtgaataaaaagcaacttacaggcaaaggaaatagcttcccatttacttttatacatagactatttggatagttatcttcttgagggcaacttgtctctgccaggcaaagtctgcattaataaaagaaaaaagtattcttaaatagtgtgctcaaacattcttatatgttttaaaattcagaactacatgcacatagtaagcaagtataaaactaaggtaacagaaaatttcaaactcacctcaactgaacttggactgtataatctctcctaccacctggcaaaaaatccctgttggaaagagaaagaaaatgggttaaaaaagtacaatgagaattctcagaacagtctccccaggaggaaaaaaaggaaaagcattatttgtatttttcttattccctgaaaggtgatcaatatactaccaataatataagccttaatgaaatcactgtaatgatgataaacctgacttgcttaacttctagccacgtctttatggcaattttaaggtaccttcaatgcacaggaactttgatgatgcaaaatttatttcaatagacatcaaacttggtaacatgcaaggaagcagcctaagttcggaaagagttttaatcagcaaatctatttgcttagagcattctaatcacttgaagacttttttctttttcttttgttttttttttttttttttttttttttgagacagagtcttgccctgtcgcccaggctggagtgcagtggcgcgatcttggctcactgcaagctccgcctcccgggttcacgccattctcctgcctcagcctcccgagtagctgggactacaggcgcccgccaccacgcccggctaattttatttttatcagagatagggtttcaccgtgttagccaggatggtcttgatctcctgacctcgtgatccgtccgccttggcctcccaaagtgtctcattacaggcatgagacactgcacctggccaaagacttttcttttactataaagacctattcactggatattcttattgatctcaagtacagcctaagcattagtttttatagctactagggggattctaatatagacccaggataaagaattagtgcctagagtctcagcatctccataccatgcaacttcataattatgtatccaattaaagatacagaacctcttataatttctagatgagaatctaatggtcccatgtaaaatatatttcatactgaaccctccaaactcttgccacgcaacatggagtctacggggaagcagcacttattccttaggagcttgttggaaatgcagactctcaggccccatcctagacctatagaattagaatctgcatgttaacaagatcctcaggtgacatgtatacacattacagttttaaaaagtattgcccttagccattgtcataaatcttggactctgtcagagagaagatcactagagtgtagtcctttcttgagaagactggagtacactgagcccccatggtgctctaactgggccagtctactcaccgttcccaatcctcgagctccactggaaggcagtaaagcacagcagtgacaaccaccttaagttctacagtcccaagctgcacaacattgtgcaaatcacttaaccattctgtgcctcagtttctacatctgttaaagatggaaaattactgcaccaacctcatcaagttgctgtgacaattaaacatgttaacaacacatgtcaagtgcctaaatataagatgtgctcaacacatgggagcagctggctgctgtgactgtttccactgctcccactgttctccttaccaagagcagccttctcaaatggctattcaaaacatccccatatccttgacaatactgacctcttctgagcaacccatatcactccactcattcatatcaagacacatttcatattctgggtgctggagcttcaaagacaaatacaacacagtatttgcttcaaaggatttatatgctaagtaggtaacagaaatacaacacctaaaataaaatatggtaagtggtacagtacattataaaaagtaagtgctacagaaaaagggaaaatttttgtcttgaaagttcaaggtcattatcacaattagtccaatctaactagaaaacagggtttttacagcagtggttctgcctacttctgcttagtggctccactaggaacatgagtaactgtgggtatctagtgcagtaattcccagaaaaaaagaaaggacagagatacagatcagaaacttgttagatgggaaacacgatgtgaagaaagagaaaagacaagacatgagcctagaaagatggatgggggcataaagggttttgaacagctcactaaggagttacactttattctggcaagggaaattaacaaaaactgggaaatacaatgtgctaaatatcttcacaaacattatgagtaatgaccaaggcatcttctgacattcatttctgccaatcactgttctaggaagttttacatactggtccatcagatacaaaagaagcatttaccatatgctaggtactgtaatgggttgtgaggtgataaaaatgagtagaagaatgctgctttcattaagaaggttgcaaatgcaagcagtgaaataaatgcaatgatgccttaacagaaaataagtacatggcacagtgagagacaaatgacacattaaagcaaatctggaaaggcatcacaggggacgtatgaattgaactggcccttgaaacatgactcaagaagtttgccaggcagagtacagagaaaaaaggcggcaaaggtgcaaagatgtgaacaccatagttaacctaggaaacacaaatgggaaagcctagtcagagtacaggttgttagaaaagagtaacaggagataagattaaaaaaaaaaaaaagcagagcaagatgttgaaaacaactgccaggcaatggagtgtggactttatgaggtaccattagagtgtgtttaaagcatcaaagagaaaaaactgaatgggctttagaaagatcatatgtaggagctttctaatggaaagatctcataattaggagaccattacaattgaagaggcaaaaaacaagggcttgaagctgggcgcagtggctcacgcctgtaatcccaacatttaggaaggctgaggtaggtggagttcaggaccaggctgggcaacacagcaagaccccatctatgcaaaaaatagaaaaatcagccaggcatggtggcacatgcctatagtcccagctagtcagaaggctaaggtgggaggatcaattgagcccggacattaaaggctgcagtgagccttgattgcggcactgtactttcagcctgggtgacagagcaagaccctggctcaaaaaataatagtaatttcaaatgagggcctgaaagctattaaacataaataccactgagtgatattcacacataaaaaatggtaagacttgatgaatgactagatgtgagaaggcaggataagggaaggggagtttctaggagggtatccaggttttggaatgctgcaactgaagagatggccatgctactcaccaggacaagaagaggcagagcaagttatagcatcaatctcccaaaccacccagtgaggtggtgatcattattccaattttgcatgctgagaaagtgaggtttagtcacctgtctaggggcatacggacctaagtggttggttcagaattcactttatacttagtattactctaaagaccatactagctccctcaaaggtagagttgccttgctgagttttaaatattcagaatgacataaaagaatcaatgaagggccagacgcggtagctcacgcccataatcccagcactttgggaggccgaagcgggtggatcatgaggtcaggagatcgagaccatcctggctaacatggtgaaaccctgtatctactaaaaatacaaaaaattagccaggcgtggtggtgggtgcctgtagtcccagctactcaggaggctgcggcaggagaatggcgtgaactcgggagtcagagcttgcagtgagccaagatcacgccactgcactccagcctgggtgacagagcgagactccgtctcaaaaaaaaaaaaaaaaaaaaaaaaagaatcaatgaagtgcagcaaacagacaggatgtggtaaatgaagagtggcctatcacaaagaggcctctgtcaaggcagattccaatgccattaaggaaacgagtaatgcagaaggaaatatactaagcaaaaatctccttgaggccagtctgtttttcaacttcgcatctttggtgcctggaatattgtctggtccatagtagacagttaataaatgtgtgctaaatgaatgaataaaagaacaaaagataagcaggtttgatggaaggcaagctcaattttagatgtgttgtgcttgatgcccttgtaggtcaaaggagaggcactgaaaaaggtgtctagagggaggtgttggtaattttgcagccacccatataaaaataacaaagcacattaatgaatattatcatagagtagcaagaagagaatcccagattgatcccttaaaatgggtacaagaagtcagtgtgaggaactgagagcatggttaaaaatatactagtaccaaatggaaggagcagcgctaaagccaaaaagagaactgaatccaatgttcaatcttcacaagatgtaacagaaagaacaaaaaaacctggacaagaatgtattcaagcgtctagtctagatcttactaccactacaggcaaaggggagggagctagaaacacagctgtggttctcaagttggctgcataccagaaacctgggaaactttaaaaaccactcatgtttgggttcaatcctgagattctaatttaactgatgtgggataaaacctgagtatgagaatttcctaaatctccccagctgatgctaatatgcagcaaagtttgagaaacatggggagagaagtagttaaatgacacaagaagcaatcatccgaatccagaatgtacaatatgctagatcaaatagatcactttttttggaaagtagtgttacaaaataaagcctaatgagagaaaccagggctccctggagaactgatcaattccacagttgcagcagagaaaatacaagataagccttcagcatttttgttgcaagaaattaaagagcgctcaaagtgggtttcagggagagaggtatatcaaaagggcataggagccaacctgaaagaacttctaatagccaaagatagaacaatttgagcatatcaattactgtaacactggaatataactcatagagcacccatgagtccacactgttataaacgaataaacgggctgggaatgctggctcacatctgtaaagccatacctgtaaacccaatagtttgggggacaaaggagggaagatcacttgagcacaggtgtctgagactagccgaggcaatactgtgagaccccatctctataaaaaacataaaaattagccaggtgtggtgttgtacacctgtagtcctagcttcttgtggggctgagatgggaggatcatttgaccccaggtggtcaaggctgcaacaagccatgatcaccaccactgcactccagcctgggcaacagagcaagaccttctctcaaaaataaaataaaataaaaggccgggtgtggtggctcacacctgtaatcccaacactttgggaggccgaggcaggcggatcacctgaggtcaagagttcaagaccagcctgaccaacatggtgaaaccctttctctactaaaaatacaaaaattagccaggcatggtgaagaatcgcttgaacctgggaggcagaggttacagtgagccgagattgtgccactgcactccaacctgggcgacggagtgagactttgtctcaaaaaataaacaaacaaaatgaatgaatgaaagaaagaaaagaaaaggagacagctcctccttgtaaaaataaaataatctcaatgtaaaaaagattaaggacaacagaacacaagaatgtttttgctaaagtaaccactaaagccaagattcacgagtgaacactgaattaatctgcaaaagtttgaggaaaaacagaatactaggtgcctagttgcaaagttatctttgcaaaatatttatcaacaaaggaacaaacagtaactttacagtgcagatacctggcagctagtatcagccaagtgatcaaggttaacatcaccaaaaataagatatcaatattatgttgcctgatatggtaccctgagaagggcacataacttgaggtattcttgccaaaaatgcacaacctccatctaatcatggtaaaacatcagccgtacccccaaatcagaaagagtctacaaaacacctgatcagtactcttcaaagtgtcacgctgtgaaagacaaaaaacaaacaaacaaaaactaagaaactgtaacagattgaagcagagtaggatgactcaacaattaaatgtgatttgggattgtatctaggaacagaagacgtttattgaccaaaaaactggtgaaatctgaataaagtctgtagttaatagtactgtaccaatgttgatttcatggttttgatcattgtactatggtgatataagatttaatattaaaggaaacagggataaagaatatatgtattatttctataatttttatctaaataaaaattactacaaaatataaagtttttatgccgggcatggtggctcacgcctgtaatcccagcactttgggaggccgaacaggtggatcacttgaggccaggagttcaagacaaccctggccaacgtggtgaaaccccgtctctactaaaaacacaaaaattagccaggtatggcggcacctgcctgtagtcacagctactcaagaggctgaggcaggagaatcgcctgaaaccgggaggtggaggttgcagtgagccaagatcatgctactgcactcactccagcctggatgacagagcgagactctgtctcaaaaaaaaaattatgtaattaagtacagaatttcccaaacttacttaactgcaacaatcttatttttgaaaaactcttactatcatctcaaagagtgttctaattaatatctgaaaaggaagtaaacacctctaatttactcaattccttgctctgcttttaacattacagccccccaaaaatcattaacctcccagaagccttagttttatcatgctgaatcttttaagaatgcaactttaaagagtcatataaataatgttttgttaacactaaaggtgtgtgtatacatatatacatacatatatatacacatatatacacatatatatacacacatatatatacacacacacatatatatacacatatatgtatatattcttttgagatagagtttcactcttgttgcccaggctggagtgcagtggtgcgatctcggctcactgcaacctctgcctcctgggttaatgtgattctcctgcctcagctttccgagtagcagggattacaggcgcccgccaccatgctcggctaatttgttgtatttttagtagagatgggtttcgccatgttggccaggctggtctcgaactcctgaactcaagtaatccacccaccagagcctcccaaagtgctgggattacaagcatgagccaccacgcccagcctttttaaaaatatttttaattggaaaattaaatgctacagatttccttttctttcttcttacatctcttagttcatctgctctttacaaatgggtctaccaatacttttcataattgttttcatatatctggtaattttttggtcaggatgactatacagctcactttacccataactacctcagtttatgttcttatctcagaataattattagtaatgtttactttcactctcaaaaatgccccagtttggaatgataaagcttatggtcaccctgtctttgggctactataaattctttttatattgctttacccaatatatatattttttcagatggggtctcgctttgttgcccagtctcgagtgctgcagcatgatcacaacagctcactgcagcctcgacctcccaggctcaagtgattctcccacctcagcctcctgagtaggtgacactaatttctgtatttcttgtagagacagggtttcaccatgttgcccaggctggtctgaactcctgggctcaagtgatactgccacctcccaaagtgctaggattacaggcatgagccaccatgcccaacctgggaataaatttttcatttaaaaaattattgccaaatataacaaaaagtaatctaaaagacattgaggttttattcaaaggttaaaaattttattctaacacacagtatttactaaatatttggctgactttagtcaaagtatactaccctttcatgagagaaacaggtcaactgttatggactgaattgtgtatccccaaaatttatacgttgaagtcctaacccccaatgtgactgtatttggagacaaggcctttaaggaggaaattaaggttaaataaagccacagggtaggtccccaatccaatatgacagtgtctttaccagaaaagaaagacaccacggatgcactagcacagagaaaaggccatctgagacgtgcaagccaaggagaaaggcttcaggagaaatcaaacctgccaaaaccttgatcttggacagaagcctccagcattttgaaaaacaaaagtctgttgtttacactgtccagtctgtgaaattttgttatggcagccctacaggtgaataaaccaatattcatgagaaatatattccaaatattcctcttacctggatatgcatatctctctaacttgttgaggtgtcaaagcaaaaataaaaaacttctcttgaaatcgctgaatactgctttgaactgggaagaaaaaaaaaaagaaagataatatttcaataacaaatccaacactacaaccacctgcaataaccaggcattttttataaagtacctgccaaattctgaaacgttatggttaaaatactccaaaatcaggaagtactaaactgcattcatcttggaatcatgagtaaagtcactacaaaggggtttctttaacgttaagtacgtaaccattctttattctaaaatactaatgcaggctgggtgcagtggctcacacctgtaatcccaacactttgggaagccaaggtgggtggatcacctgaggtcgcaagttcgagaccagcctgaccaacatggagaaaccccatctctactaaaaatataaaattagctgggcatggtggtgcatgcctgtaatgccagctacatgggaggcggaggcaggagaatcacttgaacccagaaggtggaggttgcagtgagccaagattgcaccattgcactccagcctgggcaacaagagtgaactccatctcaaaaaaaaaaaaaaatactaatgcacagtaaaaatataacaaaacgcttcaatattacatttcattcttaactataatattatctaatgaaaggaagtcaaaatgctccccaggagaactgtattcaagaattaaatgttttttgtttatttttctttgttgtattttgcttttggtgctctgtatttaattacacaaaacactcatataagaaaattttgaatgtcaaaacttttaagttttgaagatacctaatttgcatatgaaagtcttcccagttaaaaaatattgcttaatgaagtcacccttatgtatattattacctgaaatgtatttatgacttcacaaaaacctgcaataggttaataatgaattattcaataatgttctagtgtccattaaaacaaacaaaaaagttaatatatatagaggcctcaagtcttttgcttcctaacaattgcaacatcacccaagtaaaggcaaaatgaggccgggcacagtggctcacacgtgtaatcccagcactctgggaggccgaggcaggtggattacttgaggtcaagtgttcaagaccagcctggccaacatggtgaaaccccatctctactaaaaacacaaaaattagccagtcatggtggcacgtgcctgtaatcccagctactccagaggctgaggcagaagaatcgcttgaacctgggaggtggaggttgcagtgcgctgagatcacaccagtgcactacagcgatagtcttcaaaaaaaaaaaaaaaaaaggcaaatggtccttgtatataacactgtccagttttcctgctacatgaagataaaaaagatgccagttggatatccaatgtcagagcggttcaaccacaagtcacatcaagtcagaaaaatattaattccctagctaaaatattcttttctataagcacagtttattatagcaattattctcctagaaatgtcacaaaatggttcatattttttcagaacgctttaaaaaggagggaagagggagatgccgtttaagatgaaggccaaaaagtaaaataaaactttggattataaacataattatggagcatcaaacacagaaacataagtaagcctctccatttctccagttcctattcactcctcaaccctttttttcttgttcggactccacttttcactatctgtggctaaggtcaccaatgacctcttaactgccaaatgtaataacgtgtattttgagattacaagtaaacatgctgcattttaatcttaattaattaatgacatgagcatccagtctcttcagccagaaacctcaaaaggtctaaagtaagtacaaatggagaactaaaagaagagagtgcaaaatgagacattaaaaaagaaaactacttgcagaaataatgaatcaataattctacctttgatggaggggaaaaaaggatttacaaatcaaactccatgtaaaataatacaaagaaaactacctagtcacatcatagtcatactattgattatgtttgattaatcttgaaagcaacgagagaaaaaagaaacaagggaacaatgcaaatcaaggccaacttctcatccgaagcaatataggccagaaggtatctttaaagtggtgaaagaacaaactcaactgaaaattcaatacccttcaaaagcagagtggaagaataacttttcagataaacagaagatataagaatttgctgacagcagacatgcattacaagaaatgtaaaacaaaatcaccaggattattttaaaacataaattcaaaactggatctctgggaatgaaaatcatacagtaaataagcataaatgtaaaacagtatgctgtattttcttcttgtaatttccttcaaaagactgttgacagctaaagtgatggcattgaaaggcaggatttctaacacagggaggaaatatgagaacagcaaaaagaatggagggggtagataaaggaaattatctccccaacagttgtgtttcctgcttttttctgataaacctgaaatctccctaaagaccctgataaacctaaatctccctaaagaccaatccactcttagcgtgccacaagcagcaggtatctacacctgtaaagttgggcacaagaccctctgtgaattcacgaatataaatgccagtatttgaggctctgtctgaatgactggagacaacctaccctgaaaagtttccaaaacccatgaaccttaacatttgaaaagagaatggttccatagtcatgttgtacatgtatgttcaacatgtacttttatatcaaattgtacttacatgttgcacatacgcaatatatatgtacaatttatagaactggcagcttaatgttagtagtctgtgtcataacagacatattctcggtgtgccttttatttttctgacatatctttgactttacctatatttgctgtcaaattttcaatccagattataatctcaaataaccacccagtatctatagaaaaatggatctgtgtcattgctatatactataaccagactccaggaacttacagcaacaaaaaattgtgcatatgctaataaaaatctaatttgtattaacattgacagttcttagataagtcaattttatgacagaacagcagccaaaagcataccaaactttccataaagtgaatttgttagctaaatggttattttaacataaccatgagaaagaatgcaggatgcaaagtatgcaggttttgcagtttattttctccccattgtctacaatttgggaatcagaaaaccaattctgcagagattccatgaatgcctttaagttaagagcaaatgaaatgaaaaaagatcatggctcaagggcatgaattaaatatggctttattcaaacctttcctttttcaacaacccttcataatgtagattctattttccaaatataaccacattatctcccatcatgtcctcctttttatgtaaacttgacattcttccaactgagtagtggggtctttatcaacctccctttgaatctgaatggccttttgtaatagcatcaaccaacagtgtacagtttaagtgatgctatacagctccaaggctgaaccataaaaataccacacacatcttccttgctctgtggggacactcattcttggaacctagctctcatgctataaagaagcccaaattagaccacatgaagaagccacatatgggtattccagccaacagccaagctaagtccaagtcatcaggtggcatagctgccaaacatatcagggaagatgcctccaagtgatctgagcttctggccaagtgcacctcaagcatatgtcttctcagctaagaccccagagatcttgggataagaaacaagccacccacacactgcccttccaaattcctgacctaaggaatccatgagcatgtcagacacagtaagttcctcttcaaaggtttaatttctgacttccctgttctttgctcttaagctcaacttccttgtcccttctcctaagctatctgctctgtaaacaactacttctgccagtcccaatctgtaactcacatctcttccttatttggaaagagtcctctttactcctggctacccattctgtaagctccccctcttgctgagacagctctccctgccgaaactacccttcccgcctttgccgcaccctgacatgcccaaacatgccttgtactgtaacagacagcctctccctttccgcctaattagccatattcaattttaaatggtagccaatcaggtcagtgtagattgtgccgtctgactccagccaatggggaaaggacacagaaccagagattaaccgtgttagggataaaaaccccttcccctcctttgtttggtgtgctctcgcagcggccagaagtgtgaccagcacccttctgcagaagtaaatttgctttgctgagaaatccttcatttggcatttgggtgcttgttttccttgtgactccaagctcttgtttctaacaacttgggggctcatccgcgattgcctttctcatccaggaagaggtccctgatcatctctcatgaggagatgcgtccccctgcctcactgtggtggcctcagggatgagggatcaagacctcccccagcatgatgaataaacctggactctcagcaacgcaggtgaaaaggatcctcacacaccatggcaaccaggtaactctgtacacaaaccaaggtaagaaaagtcgtgggggtgacaaagtatttccttggtggttgggacaacttggagcttgaatgtgtgtgaatgagatgtacaattaagcacaaagcaagcgtggagtctggatctgcagttctgtggtcacctcatatggcttatggcagattcctgttgtggggcttataccgacacaccgatgctaagagggacttaaattcccgtgagggaagcagccagagaaggacaaagcaaaaggagagtaaaaaagacctccagtagaggggggttaagcctctagagaagggaaggcaagaaatatctaatacgaggagggactgagcctcagcaaacctctagagaagggaaggcaagaaatctctaatatgaggagggactgagcctcagcaaacctctagagaagagaaagcaagaaatctctaatacaagggattgagcctcagcaagcctctagagaagggaaggcaagaaatctctaatataaggagggactgagcctcagcaaacctctagagaagagaaggcaagaaatctctaacatgtggcattgagcctcacatcaaacctccaggatgggaaacaccccacgtaagacaggaaatgaaagatataaagctagtgatgataacaacattccctctggtagtcccttaggtctcatgttaacatactggagggacagtgaaaggactaaacataataaaaaacaacaaatgacaaaatattgttgtttcatttggaccacagagctcatcctcacaccctcagttttctggccaaagtttcagtcaaatgaggattgaatttgtcaacttctaatagagtatgtcaatgacaagagtcccatctcccaggaggaaatagattatgccctgtattggcagcagggacccatccttctttaccccctaaaagctataggaagtaagccagaaatcagttcctctgaggaaagtaagacctctaccccaaaacaatccaccaatgtatgagacccaccagaccacccacctccgccaaatcccccaccccaagcaggtgcacaggacccccttcactcaattcctcctccatataaccctgagtcaatgcctgccccaatgccccgtgccctccctaaccacacgtctgagtctatgcctcctccaggaaggctctagtgtgagacagaacagtgtaaaaaggatattcagaactccttttcccctccacctctaaggaatcagccccaactcttttccccttgagggaagtgccccttggaggagaaggaatcggctttgtaaatgctcccccttcactagctcagaagttcgaaatttaaaaaaggaactcaagaccgggtgcagtggctcaagcctgtaatcccagcactctgggaggccgaggcaggtggatcacaacgtcaggagattgagaccatcctggctaacatggtgaaaccccgtctctactaaaaatacaaaaaaattagccagacgtggtgacgggcgcctgtagtcccagctacttgggaggctgaggcagaagaatggcgtgaacccaggaggtggagcttgccgtgagccatgatcgtgccactgcactccagcctgggcaacagagcaagactccgtctcaaaaaaaaaaaaaaaaaaaaaaaaaaaaaggaactcgagtcattattagatgacccatgtggggtagcagatcaaattgatcaattcttagggccacagctgtatacttgggcagagttaatgaccatcctgggcatcctcttttcaggggaagaaagaagcatgatccaaagggttgctatggtagtctgggaacgtgaacatcctcctggccaaaacattcctgcagccgaccaaaaatttccagcccaagaccctcgatgggtcaataacaatgcagctcaccaagagaatatgaaagatctcagggaaatggtaataaaaggaattcaggaatcagtacctcagacccaagatatttcctgagcattccatatacaacaaagaaaggatgaaggacctatggaattcctagagaggctgaaagagcaaatgagacaatatgcaggcctagacttagaagaccctcttgggcagggaatactcaagttacattttgttatgaacagttggccagatattgctaagaaattacaaaagatagagaattggaaagactggactattgaagagcttttaagagaagctcaaaaagtatatgtgagaagagatgaagaaaagcagaaacaaaagggaaaaattacgttacccaccttccaacaggggttccaaaagacaaggcccactgatactactctccattacctacagaccccacacccctaaacaagggctacagggggccaaagcttacaaaggatttaagtcctcacatgctaaaccatataaaggacatagagagacaagaccaggtaacctcagaacagggagggagggaggacaaaatacatgcttcaaatgtggaggagcagtcattttaagagagaatgtcctgaatgggagaaggagaaagaagtcattccatttaagggagtcaggggctctattctttttatcttgaattctaccaagagcccttgataaacttagaggtgggacccaaacatgaagttataacccttttaacagattcaagagcagctcgttcctgtttgtttccctttacctaatgtcccttgctcctcagaagaactttttgtcttgggggtgaaaggagaaaggtttaaagcaagaatcttagaagacacagaggtcaaatataaaaattgatcagcccactttcaatttctgttaatccctgaggcaggaactaacctattaggaagacatttaatgctaaaactaggtataggcctacatgtcagtccaaacggatttctcacctcattaaatctacttaccactgcaaatgaaaaatatattcatcctgatgtatgggcgagagaaggaaatcgaggaagacttcaagttgctccaatacatatgaagttaaaacccccaggggaaatagtaagaagaaagcaatatcccattcccctagagggcaggataggcctaaaacctgtagtcgaaggtctcattcaagataagcgccttgaacactgtatgtccccttataatactccaatatagcctgtaaagaaattagacgggtcatgctgactagtgcaaggccccagagctattaactaaacagtccagactacccaccctgttgttcccaacccttacactatcctcagcaaaataccatatgaccatcaatggtttacagtgatagacttaaaagacaccttctaggcatgccccttggctgaggacagcagggacatatttgtttttgaatgggaagatcctcattctgagcgaaagcaacaataccaatagatagtcttgccccaagagtttagagattcacctaacctctttggtcaaatcctagaacagattctagaacaaatttgtacccccaaaacacatatgcttgctccaatacgtggatgacctgcttatatctggtgaagctatagaacaggtggctgtcttctccacacaccttcttaaccatttacaagagaaggggttacgagtttcaaaaggaaagctccgatctgtggaacccaaggttaagtatttaggacacttaataagtaaaggcaagccaaggataaggcccgaacgggtcaaaggaatcgtgtccttacctttgcctaaaaccaagaaagaactcagaaaacttttgggattagttgggtattgctgactatggattgattaatatgccctagagatgaaacccttatacctgaagctcacccaggaaaagcctgactttctcctatggacttctgatgaaatccaccaggttgaggagctaaaacacctactcatcactgcccctgtcttagcccttccttccctagaaaaaccatttcaccttttcattaacgcaaacaagggggtagctttaggggtgcttactcaagaacatgggggccactgacaacctgtggcctttgtatcaaaagtttttgacccagtaacctgtgggtggcccaaatgtgttcaatttatcacggctaccgccttgttaactaacaaaagcaggaagctaacctttgggggaaacttggtggtgaccacaccccatcaggttagaacaatcttaaaaggcaggaagatggctcaccgactcaaggattttaaagtatgatgctatcttactagaaagaggtaacttaacattaaccactgataattcacttaacccagcaggtttcctgacagggaacccaaatctaaaaggccctgggcgtaaatgtttagatttaattgattatcacacaaaggtcaaggctgatttaagagagacccttttcaaaacaggacatctattcatagatggcccctctagggtaattgggggaaaaaggagtaatgggtattcggtggttgatggagaagctcttgcagaagtagagtcaggaagattgcccaataattggttggcccaaacatgttaatgcatgtttaacatgcattaaatcaggctttaaaacatttacaaaaccaagaagggaatatttatactgattctaaatatgtctttggggtagcccatacctttggaaaaatttggactgaacaaggtctcattaatagcaaaggccaagaccttgtccacaaagaattaatcacccaggtattagataaccttcagttgctagaagaaatagctattgttcatgtcccaggacaccagaaaaatccttcttttgaaagccgagggaataaccttcagaccaaatagccaaacaagctgccgtttcctctgaaacgcccgtttttcacctccctccttgcctttctccccctaccgccattcccatcttctcccccgctgaaaaggagaagttaataaaaataggagccaaggaaaactcagaagggaaatgggtgttaccagatcaaagagaaatgctatccaaatgtctcatgagggaggttttatctcagttgcatcaagaaacccactggggacctcaagctctgtgtgatgcagttcttggagtctccagatgtagaggaatttatactctagcaaaacaagttacagataattgtttaatatgcaaaaaaactaataagcgaatcctaagaaaaccacccatcggaggaagaaccctggaatagggccattccaaagcatccaaatagattacactgaaatgcccccaataggtcgcctaaagtatctacaagtaatactggatcaccttcctcactgggtagaagttattcccttttcaagtgcagccaccagtaatgtagttaaggcattaatcaaaaatatcatacctaggtttggatcactagaaaatattgattcagataatagaacccacttcgctgcacgtcattaaaaagctagcccagctattagaaataagatgggaataccataccccctggcactcaccttcatcaggaagagtagaaagaatgaactaaaccctaaaaagccaccacaccaaattaactttagagactcgactaccatggaccaaatgccttcccattgccttactgagggtctgaactacccctcggaaagatattggcttatctccttatgaaatgctatacgggttgccttatttacactccactgctgacattcctacgtttgaaactaaagatcaatttctcaggagttacatacttagtctgtcttccactttctcttccctcagaactaaaggccttttagcagagacaccacccttggagttcccagcatgtcagcatcagcctagggatcacgttctcatcaaaagctggaaagaaggaaaacgcgaaccagcttgggaaggaccctatctagtgcttctaactacagaaaccactatctgcacggccaaaaggggatggacagaccacacgcgagtgaaaggagtggcttccacagccagagaaaaatgagccgtcaccccagggcccacccccaccaaattacctctaaaaagggcttaatattattttcccttttctttccaacagaaggtcaccttgtcatctatgtgactcaaactaaccatcccttaacccttcagtttgacgcttgttcagtcatctcatatggagatgaacgaactcaaaggcagctatcaaatgtagataagtatctatgtccgtactgtagtgagtcaacaaagtataagcatggagccttaaaaagtccctgtggtgactggacagatgtttggtggaccacccaatatggaggatggacagccaggcccccttcttcaaacaagttgcaaggactgaaacagaaactccaacttacgtggtcccaccccatcaaattgtaagtcactgcaatgtaaccccttatccccttgttgctaattatagataatccccaaacaatggcccaagaaccctccatattcgaatggtatgggttaggagcagatgttataggacgggaccccataagaatcttctctctgagtcggttgaaaacaataaagaaatccagacccagagtccggggaatatatgggatccaacactttccccaaacatatcatgcccagcattctcctcccatctccagaaccacccaactaaggtaacggctgtggaggtgaaagaattaaggcagactatagctctagagacaggatacaaagatgcaaatgcctggctgaaacggattaaatattccatccgcactctaaacaaaagagattgttatgcttgtgcgcaccgcaggccagaggcccagactgtcccctttccactcagatggtcctccagccgaccaggcatgaactgtatggtagctctcttccaacgccccacagcctagggtaatgaattatgccaagctctctcttggctattccctgaagttcggcaccctatgggtcaggccctgagggccacgtcaattttacctcatgtctctcacaacaaggggacaacttagcatttcttggagacctaaagggatgcagtgagtttaagccattccgagagctgacctatcagtctgccctgatccatccgcaagtggatgtatggtggtattgtggcggaccatcactggacactctgccaagtaactagagcagcacttgtgctctgatccaattggccatccctttcaccctagaatttcatcaaccaaaaaggataaagacaaaggattgtataacaagagatagccctcatgggtcctttgaccctcacgtttatatagatgccactggagtcccgagaggagtgccagatgaatttaaggtgcaaaatcagatagtgcagggtttgagtccatactattctggtggttaactgtaaataaaaatgtagattggataaattacatctattacaaccagcaacgatttgttaactatattagagatgctagtaaaggaacagctaaacaattaggacctaccagccaaatggcttcagaaaatagaatagcattagacatgatactagcagagaaaggtggagtttgtgtcatcattggaactcaatgttgtacttttatacctaataatactgctcccgatggaaccataacaacaaaagcattacaaggtcttactgctttatccaatgaactagctaaaaattcaggaataaatgatccctttactaatttttttttttttttttgagatggagtcttgctctgtcacccaggctggagtgcagtggcgctatctcaactcactgcaagctctgcctcccgggttcacaccattctcccgcctcagcctcccgagtagctgggactacaggtgactgccaccaagcccagctaaatttttttttgtatttttagtagagatggggtttcaccgtgttagccaggatggtctcgatctcctgacctcatgatccacctgcctcagcctcccaaagtactgggattacaggcgtgagccacagtgcccggcctccttcactaatttaatggaaaaatggtttggcaaatggaaaggacttatgtcctcaatccttacttctcttgcctttgtaacaggtgtgcttattcttgtaggatgttatatcataccctgtgccagaagcctagcacaaaggcttattgaaacagctcttattaaaacctttttcaatctccccaccaccttattcagataagctcctacttttagaaaaccaggcagaataacagagtcaagaaatgttaaaaacgtttgaagaggaagaattataaaaatcaaaagaagggaactgtcagatatggctaagttcctcttcaaaggtttaatttgtaacttccttgttctttgttctcgagatcaacttccttgtctcttcttctaagctacctgctctgtaaacaacttctcctgcgagtcccaatctgtaagtcacatctcttccttatttggaaagcgtcctcttcactcctgaccacccattctgtaaactgcccctcccgccgaaacagctcttcccatcaaaactacccttcctgcctttgccgcgccctgacatgcccaaacacgtcttgtaccgtaacaaacagcctcccccttcctacctaattattcatattcaattttaaacagtagccagttgggtcagtgtagattgtgcagtctgactccagccaatggggacacgacacagaaccagggaataaccgcgttagggataaaaaccccttccctactttgtttggtgtgctctcgcagtggccaaaagtgcaagcagcacccttttgcagaagtaaatttgccttgctgagaaatccttcgtttgagtactcattttccttatgactccgagctcttgtttctaacaagcataataaaatacctgctttacaccactatgttttggaagactatattatacagcaacagtaaatgaaataatgccacaatttcatgaattttggcataatcttatcaattccaagtattcagattcatttataattactaaatgagtaggctactggtataatagttatgacagctctaaatctatggatccctttttcctctttataaatttttaaacttaactagaccagaatataacagtcctatatcctagccttagccctactggttactatccaagttatttaggaaatttacaagtctctctacacctcatttcaaatggaagtaacacttttctcacctgcctttttaagatggttttgtggactaaatgcaggaacatgtgaaagcattctgaaaacagtaagatactatacatgtaatatattttcacttgtggaagtcctcatcaaaagtctatgctttttaagataccaaaatttcaggaaaaaacaagcagttcaacagatatattttgtcacctactttgtaacattgactttatcttgataagacatttaggtcaaaaattaatattttaatgtgcctaaatgttaaatatacttaatataaaacctgccaagtcatcccccaccatcaccccctgcaagcactatattgacaccttttaataaactggtttatatttcagtaaaaatgcttcctaggctaggtgcagtgggtcactcctgtaatcccagcactttgggaggccaaggtgggcggatcacctgaggtcaggagttcgagaccagcctggccaacatggcgaaaccccgtctctaataaaaatacaaaattagccagatatggtggcccatgcctgtaagcccagctactcaggagactgcggtagcagaatcactagaacccgggaggcagagtttgcagtgagcggagatcacaccactgcactccagcctgggcaaccagagcaagactccgtctataaaaaacaaaaacaaaaacaagaatgcttcctagcggttactgccaaggttaacaggggctcatactatggctaacatagggaaaagataaaccaagaggttttttagggagttttgtggattaaaatggctcagtctagccaatctaacagtaaaataattcataaagtaacaatgaatgaatcagtttaattactctgcattttctaagatcctgagctatccggttctcatcacctaccagctactgtatcatcaccaactaaagaatgtcttctcccactgcaatgctgcactaaaataaaagggagtagggtaggagcaggacttctaaaactcaacagctaaaaacaactcaattcaaaaatggacaaaggacttggatagacatttctccaagtacatacaaatggcaaatatgcacatgaaaacatgctcaacatcactaatcattaaagaaatgcaaatcaaaactataatgcaatgccacctcacacccatcaggatggtcactataaaaaaaaatagtaataatagtaagtgcagatgaggacagggagaaactggaacccctgtgcactgctggtggggaatgtaaaatggtgcagctgctgtggaaaacagtttagtggttcctcaaataattaaaaatagaattaccatacgatcccgcaatttcacttctgggtgtatactcataagaattaaaaaacagaatcttgaagagatgtttgtatactcacagtcatagcagcatcattcacaatagctaaaatgtggaagcaatccaagtgtccattggagaataaatgaataaaacaccatgtatacatacaatagaatattactatgccttaaaaaggaaaaaaaatctgacatgttataacatggacaaaccttgaggacattacgtttagtgaaataagccaatcacaagaagacagataatatgacacgtaagtcaaataataagacatataagtatgattctacttatatgagaaatctagagtagtcagaatcttagaaagcaagatggtggttgccaggagctgggggaagagggaatagtgaattactgttaaatgcatatagagtttcagttttgcaagatgaaaagggttctctggagatagatggcagcgatggttccaacaatattaatatacttcatgccactggattttaaaatggtcagacagtatgtattttaccacagtaaaaaaaaaaaaaaaaaaaattggggatggggacagtggttcatgcctataatcccagcactttggaaggccgagacgggaggatcccttgagcccaggagttcctgaccagcctagggaagatggcaagacctggtctctacaaaaaaaatgtaaaaattagctgggcatggtggtgcacacctgtggtcccagctacttaggaggatcacttaagcacagaaggttaggctgcagtgagctgtgatctcacaactataccctgcctgggtgagagacagagagaccctgtctcaaaaaaaacaaaacaaaacaaaacaactgggcagggcaaggtacagtgacacacacttacagtgacacatacctatagtcccagctactcaggaggctgaggcaggaggttcacttgaggccaagagttcaaggatgcagtgcacaatgatcatgcctgtgaataaccactgcactccagcctgggcaacacagtgagacccccgtctactaaaaaagtaaaaaataatttttaaaaattgggacaaaaaatttaaatttcttcaaaaataaataggggctgaccctcaaacatgtagaaataaaaatacacacacaaaaagaacattctcatacagttgtaacagaagaaatacataaagtcaatacaggctctcttctatattagcaaactagctcatttttgataacctgtgtcttgacatgttggaactaacaggcacacacaatgctttcaagaaacactttacaactgcatctatatagcaatatccaattgtttacaaatacagttttcactgaacactgctttaaattataatcccattatatacagcaaagtttttctaatttaatcagatttaaatagaacatagcaaaactgagttatttgtaggtgatttatctatacagaaattatcattttattaataatcaccagtgatgcttcctctccattttcactaccaccaccctactgaaagcctattataaccttcttcaaatgaaacagcagccccaactcctgccagtctcccaccagtgtggagttagtccaccttattactttcaacccccttcctctgctcaaaatgctcaccaacgtcctatctctgaacgaccccaggctctttcctagcaaacctacatttcttcaagccccctccagggcttactcagttcaaagggcttactctacctgtgggtgtgtaccattttattttctattttattctgattaaataaatctgattaaattagaaaaactttggtgtatgtaatgggattataatttaaagcagtgataagtgaaaactgtatttgtaaaaaactgaatattgctatatagatgcaattgtattttattctatttatttctaaaataaaccattttattttctatttctgtgaccactcacagttctcccctttcttggcatttcttctcctacaaactctgccaatccaaagtaggcgcattcatccttcaaagctccctcaagtctcactacaagaagccttgactgaattctccattcattaggccaatgcagtaactgacctttagatgtacaactgacagtgcttcatcatgcaaacacctatctacttgctacttatttcgaatgtgaacattacctccctaactgtgtaacaaacaccttaaagcccatctcatacttctggcttctccacaattaagaatacacagacaccgggcacggtggctcacgcctgtaatcccagcactttgggaggccaaggcaggcagatcacgaggtcaagagttccagaccagcctggccgacatggtgaaaccctgtctctactaagaatacaaaaattagctgggcatggtgacacatgcctgtaatcccagctactcgggaggctgaggcaggagaatcacttgaacccaggaggcagaggttgcagtgagccaagatcccgccactgcattccagcctgggtgacagaacaagactttgtctcggtggcggtgggggaagactacatagccatatccaaattaagtccttattatatacttattaactgagttaataaaaataatatatacagtaaattagaatattatattttaatggctttaacattaatgtgcatatcatttgaatactgtttaatcatatccaaaagcttaatgagtgtgtcctaatgttcaagaatttaaggataaaaagagattgattcttattaatttttcacctttcagattagcaaaaattaaaagaccaacaatacaatgctgatgagtgtatagggaaaacagtacctccacacacacaaatggactacaaattggtgcaatgctgtggaagctactgtcgaatttccctctaaaggtgaatatcaaaatataaaatattcatattttgacccaacaacttcacatccgggcatttatccttcatatatatgtgtacaagtattcagaaatatatgcaaaagttgttcatagctgcaatgtctgtaaaactgcaagaatagtgcctgatacatgctatacacaaaaatacttctgaatgaataaacagtgaaagcccattgaagatgtacatcaaaaaagtactgggtaagttacggtacatctataagataatagaactactgcaataaatctgctgtaataaatttccaggaaatactgttaagaaagattgtcacggtgcaaaactctagggaacactattcacagatattacaaacagaatagtgcccccactccctcaaccagacactctgcagttggaaaaggttttaagagaccagcctggacaacatggtgaaaccctgtctctactaaaaatacaaaaattagccaggcctggtggcgggtgcctagaatcccagctattggggaggctgcggcaggaaaaaaaaaatcgcttgaacccgggaagcagaggttgcagtgagccaagatcacaccactgcactgcagcctgggcgacagagggagactccgtctcaaaagaaaaaaaaaaaaacaaaaagagagaagagaaaaagcattaacataacacaagcggagaaaaaataaacttgatatgactctagctgagcaatgaatgagattacgaaggactgtccctttcttatgatttttgattccaaatattaactacttttgtaatctgaaaagaacaatgaagaaattaaggaatcaaaggttcataaaactttgaaggtatttcacataacaccagccagccagacatatcaacatttatgatgcatataaacagcgaacaaagagtcacagaagaatacatataagaatataattatatagtgccaagcgcagtggctcatgcctgtaatcccagcactttggggggccggggcagaaggatagcttgacctcaggagttcaagaccagcctggacaacatagagagacctcctctccacaaataaaaaaaatcaaagcctggcagaatggctcatgcattttaatcccagcactttgggaagctgaggcaggcagctctcttgaccccaggagttcaagaccagcctgggcaacatagcaaaatctcatatctacaaaaaaatacaaaaaaattagccaagcatggtggtgcatgcctgtagtcacagctactcaggaagcctaggtaggaggattgcttcagcccaggaggttgaggctgaagtgagccaagattgtacactctaacctgggcaattaagtgaccctctctcaataaataataaataaattaaaatcagtcaggtgtggtggtatacacctgtgggtcccagcaacttggaaggcctgaggtgggaggatcacttgaacctgagaggtagagggtgcagtgatgccactgtactccagcctgaatgaaagagcaagaccttataaaaagaacaaaaacaaaaggaataccttatataaatttcagaagcaagctaactaaacttttttttacaaatacacatatatgatgaaataagcaaacaagagaaacacaaatccaggatagtgatttaactcagaaaagagagggctttaaagatatggtaatgttcctttttcagaaagtagcagcttcacaggtgttcattcccttgaatctttataacttaacatgttttatatacatattcctttatacagatagaatacagacaaatttttaaaacagaaaattcccaaaggatctcatgttttatttatttattttttatttttttttgagacagagtctcactctgtcacccaggccagagtgcagtggctcgatctaggctcactgcaagctccgcctcccagattcacgccattctcctgcctcagcctcccgagtagctgggactacaggtgcccgccaccacgccggctaattttttgtgtttttagtagagtcggggtttcaccatgttagccaggatagtctccatctcctgacctcgtgatccgcccacctcggcctcccaaaagtgttgggattacagatgtgagccaccgcacctggcctcatgttttttaaaaattatcttgccaggtgccgtggctcacgcctgtaatcccagcactttgtgaggccaaggcaggcagatcacttgaggtcaggagtttgagaccagcctgaccaacatgaagaaaccctgtctctactaaaaatataataaattagccgggcgtggtggcacatgcctgtaatcccagctactcgggaggctgaggcaggagaatcgcttgaacccaggaggcagaggttgcggtgagctgagaccgtgccattgcactctagcctgggctacaagagcaaatctgtctcaaaaaaaaaaaaacttaaaaaattgaagaggaaatcaagactgcctgtgagagcacatcaggatggttatttaaggaaagaaaatggagatttttgctagtttgtttttagattaggggattatccattttgttaacagtagaaccttagctacagagcactttatttagtattattgtatacactcatgttttcaagataccacaatttttcacttcaagtgataaaaaaaattttatatcaacccttttgaatagaaataaccccaagctgcaaaacaatatactaatgtatcttcttaaatagaatatactcattatgggccacaggcagtgggtcatgccagtaatcccagcagtctgggaggctgaagtgggcagaccacgaggtcaggagttcgagacgaacctggccaacatagtgaaaccccgtctctattaaaaatacaaaaaaaattagctgggcgtggtggcgggtgcctgtaatcccagttacttgggaggctgaggcaaggagaattgcttgaacttgggaggcggaggttgcagctagccaagatcatgtgactgcactccagccctggtgacagtgcaagactccatctcaaaaaaaaaaaaagaaaaaaaagagcatatactcattatggttttttgacatacagctactggtttcaaaatcccaagaggttctggaatgacatttttgacctcatgtctgtttttcgcgccactgcactccagcctgggtgacagagcgagactccgtctcaaaaaaaaaaaacagtgataggtaggattcctgaaaaacattgtttttagttcaagggtagaaagtgtataagccatgaggatacgtgtatttctggcattctaactgaagctacgaccaaaatgcagggagtttagttactcttctaaacaaaatatctctggcattattttatctaagccaaatgagatagttttgaacaccaaatatgaaaagttttattttagtaaatttataaagagcatactatttaactttactgaggttaataaaagagaaactctgtgatgaacagagcaaagtaagaaaatttctagttctatttgtgaaaaaagcaggaaggtaaggaaagagaaaaggacaaggcctctcccatgtctccctcttggagtaccactgagcaaaagcctactacagcatcttcacttagtcccccccagtcttctgtccatgtctctaaaacacattccactgtaaccactaccctacagaccctcttatcctctctgtcctgtgcttagccacattcctgaggggcctcatgaagcagggctacccaagccatatcactagtctgaatctttctcagaataatagaaagtaataaatttgctagtccttcaacatagataaggaaaaaaaatttttttaagtaataaatttataataactgctgggacagaatatataaatgaaccacgacattgtgcatgatactgtccaaatgccatgataaaggaggaattagaaaacaaattagggaaatacgttaaccagataaatcaactctttaaaaacaaggctaaagatgaaagtaaaatcataaaagacagacaaccgggtaataagcatttaaaatacttgctcttgttggccaggtgcagtggatcacacctgtaatcccagcactttgggaggccaaggcgggtggatcacctcaggtcagaagttcaagaccagcctggccaacgtaacgaaaccccatctctactaaaaatacaaaattagcccggtgtggtggcacatgcctgtagcctcagctactcgggaggctgagagaggagaactgcttgaacccggggaagtggaggccgcagtgagccgagacagcgccaccgccctccatcctgggcgacagaacaagactctgtcccccccctccaaaaaaaaacaaataaaatcgaataaaataaaatacttgctcctgttactaattttaaaaataaaaatttaagcaagatacaagttttcatctaaaaatcacagagatctgttttcaatagcacccagtaaaggcaaaaagtaatgagatatgacaagcattctctcactttgcttgtggaatttaaactggcactaaaataatttggcaatatgttatcaagagtctaaaacgttctttttacttgatccaataattctactcataggactttgtacaaacaaataataaaacatgaacaaacactcaatccttatttcaaagtgaacgtaataaagagataaaatgcaatactccacttgcttggatcaccagttttgctaaaacataaataaagcaaaaagcaaaaaattgaaaaaaaaaaaaaaatagccacattgcctgccactagtcaggccatactaaccccactaactagctctacccctcaaaaccttccgatttaaccaagacaggctgcagtacaatcctgtaagacaggtaaaaaagcacactgatatgtttaagtgttttcacatgactgaaaataaaaagggttttcccaagaaagaaaagaaagcaatcttccacatcaactatgaaatgttacttcccaatttatttcataaagaaattcaaatatatttgtaaataacttcattaggcagtaagaattataacacagcaatgcaaaaatttgttagtcacattgtaagcaattgatgggcattaaataaaagctaaaaaactgcatgtcaaactccctgtgccactttagaaataaaattaaatataaaaggtttatttcttagaaaatcagtttaaaagctacattaaatggaaagtaagtccctttataaaaatatgaaaagtatcaaaatacaaaatcaggatcaataaataagatttgtatctattcccattcacacggaagcaatctgatttctacaccataagaatgcttgagtaagttctagccagagcaactaagcaagaaaaagaaataaaaggcatacaaacagaaaagaaagaagtaaaattattcctgttcacagatggtaggctcttatatacagtaaaccttaaagatttcacacaaaaaacctgttagaataaatgaattcagtaaagtagcagaatacaaagtcaacacgcaaaaatcaattgcatttttataaactaataataaatatgatgaaaaggaaattatgtagtttttacaatagtatcaaaaagaaaaaatatttcaaaattaaccacgaaaatgaaaacctgtacaataacaactataaaacattgctgaaagatattaaagaacacataaataaatagaaacacagctcatgttcatgtactggaagacttaattttttttttccccatcagcctatgtgggaaaagaaagacttaatattgctaagatatcaatactacccaaacaaatttacagattcactacaattcctctcaaaatcccaattttttttttttatcagaaatagaaaaactcattctaaaattcacgtggaatctcaagggccccaaatagccaaaacaatcttacaaaataattaaagctggagaattcactcttcctgattccaagacatattacatagctacggtaatcaaaactgtgatactggcataaagacagacatctagaccaatggaataaatcaacagtcacaacctttttggccaggaccagtttcatggcagacaattttcccacaggccaggggaatggtttctggatgaaactgttccacctcagatcatcaggcattagattctcgtaaggagcatgcaatctagatcccttacatgcacagttcacagtagggttcctgcacctatgagaatctaatgccactgctgatctgacaggaggtggagctcaggctgtaatgctcgaattcctgctgctcacctcctgctgctcacctcccgctgtgcgacctggtttctaacaggctgtggactggtgctagtccacggcctgagggttggagaccttggaacagagaacctggaaataaaacctcacatacatggtcaaatactttttgacaagggtgctaagatcattcagtgagggaaaggacaggcttttcaacaaatggtggggaaaaactggatatccacaaacaaaagaacaaagctggacactcacctaataccatatacgaaaattaactcaaaagagatcaggcttaaatgtaagacctaaaactataaaattcttaaaggaaaacacagggcaaaaccttcacagcatgaagtttagcaatgatttcttggatatgacaccaaaggcataggcaacaacaacaaaaaataaacaaattggaatttcatgaaaaaatgttaagttgtacatcaaaagacactatcaacagagtaaaaaaggcaaaccacagagtgggagaaaatatttgcacattcatatatctgataagggattatatccagaatatacagagaactcctaaaactcaacaacaataaaacaaaccaattcaaaaatgggcaagagacttggctatacatttcttgaaagatacataaatggccaaaaagcacatgaaaatgcacaatatcaccatcattacagacatgcaaatcaaagctacaataagataccacctgacacccattataatggccactataaaaaaaaaaggaaaataaaagtgttgttaaggatgtggagaaactggaacccttgtgcactgttgaagggaatgtaaaatgcagctgccacggaaaacagtatggtgatgcctcaaaatactaaaaacagaatgactatgtgatccagcaattccacttgtgggtatacagccagaagaattgaaaagcagggtctcaaagagatacgtgtatacccgtgtccacagaattattcgcaatagctaaaatgtgggagcaacccaagtgtccaatggataagcaaaatgtggtatcctataacacagaaatatagaagtaaaaccagaagaaacagctaaaataattaaggttgttgcctcttgaaagtgagattgagggatgagtagtggagtgagcaaaagattactatttttctttaaaaatgtatactattgtattatttagcctttaaaaggaaagaaattctaacataaactacagcatgctagaaccttgaggacattacatttagtgaaataagccagtcacaagacaaatactgtatgattccaacgacatgaggtacttggaatagtcaaaatcatagacagtggaagtagaatggtaactgccaggggctagtgggagaggaggagaggaaggctattgtttaatgggtacagagtttcagcttcagaagatgaaaagagttctggagatggatggcagtgatggctgcacaacattaccaacatacttaacaccactcaactgtacactttaaaatgatcaagatgatacattttatattatgtgtattttacaataaaagaattggagaagaagaaagatcaaatgatatgaaataaagcttctattagatttcagtcatggttgccgaatttttatccgtatattcaaacattcggcattgatgcctcaatttcactatattaacagcacatcattaatcaatagttgaaggtctctcatttcatttactatcttgttcagaagaaactgaattctcaaacacttacctaaactcgtgggcttgatgagaacatcaaggacatcataaaagggcagattttttaactgcacatcaggatggacaggaggaattgggggagatggctgctgcatctcaaatgtgggcttagtatcttgaagcagcacagaaccaacaggagaggatggtgagtgaggtgtaactgaagtggaaggcaacgagtggattccagccacggccaagtcaggttctacaggtgatgagccaccatccaaactgaaaaccgatgatttgattgtggataaatcagaaagtccttcaagagttcgtggatatcggcgtctatacaattctcggattttaatctgaaccgcagggctgcagccgctcttcaataaatgcagcgccctcatcaggaggtcatgcttgcgtccacttttattccgtccagcaaagcctagtaatacttgtagttcagaaaccctaaaactagaaaccatattctaaaaggaaagaaaaaaaaacataagccaagtcaccctcaagcatacaaaaatcctatctaaaatataatgtaaaatgtgatttttccagcattctatcaattggcatgtgctagtaacagcatttcacataccacttagaatcattaccattcataagacaatcccgtaaaaattacattcaagttacggtgttaattatattttgttgtacaagatcttaattttggtaatctatagtctattggtttctactaaccacttcattatctgattatgctctaatgcaaacagttatttgctttatgactataaaatctatcaccaatgaatatactccttttcaaaaccaacccctcccaatatacaatgtaatgtttgttacagaattatcgccaattaaccaaacaaaaaatcagattttcacaatgttagatgtgtaacttttgatgctgagtagtaaatccataaaaatcaagtcagaactgtgatccaaaatgcaatgaattttttaccccaattcaaacattaacaaacaaacaacataataaagatattttaaaatattaaagctaaaaaatcacatacatcttatttagcagtcaaacttctaaaacaactgaaattcccagctgggtatccaaatgagaaaaagacctttgaagagcaaggaaatgagcagtcatcaatcttaaagggcaacatttcctccacactactctactggcttgtgcttgggcgtaaaacaaaggttataagcagttgcagcttcacatcacaccttctattttttcagcaaaacttaatgaatatttttaaccccttgcagcctcaggaatccacctacttagtgatttccagtcaattctgaactcagaggcaaatcacacttgggtcagataccacacatgcatcatctagcaagaaagaggaagaacacctggagctgaccaaagccctgtcagaaacctacccaggagaactacctgtggtttggtgtcccatcccatcctcatcactcccccaacccagcccgtgctacacactccacagtcacttgggattccttttcaacctgcttgtctcatcagtatagtggaaatgtggggcagttgctctgtactttttaagtctcagggacggcccagaagcaactgtttaaaaccctatatggtttttaaatacttgttggtataaatacttgctagtttactaaaatgcaaacagatttaaatatgccaaagtaatccatatacactgtcataactgtactttgtgtactatatatgtctctatatttcataatgtacaagtgagagaatattaaattgtaatcctggcaagccattttatactctaattcagtgctgtccaacacaaattaatagaagacacacattaaacctcctagtagtcacattaaaaaaactaatttaggccaggaacagtggctcacacctataatcccagtgcttttggaggccaacacaagaggatcacttgagcccaggagttcgagaccacactggacaacatactaacaccccgtctccacaaaaatttaaaaattagccagccatggtggtgtgtgtgcctgtggtccaagccactcaggagactgaggcgagaggatcacttgagcccaggaatttgaggctacagtgaactgtgatcacaccaccatattccagcctaggcaatattaagactgtctcaaaaataataataataataatgataatttacattaacatagttatttaacccaatatatcaaaactatcttttcatctcaacatgcaatcaatttttgtaatttaaaaataatcattttttaaagtgtcagtgggattttttttatactaagtcttcaatatctggtgtatattttacacttacaatacatctaaatttggactaaccacatttcaagtgcttaagagccacatgtggccactagctaccacactgtggtagctctaaatcatactctaatagaacacataccacaatgtgtgttacctctacagtgcagacaacaaagaaggaaaacaagaaaacttttggcctatctcataacaaaccagtcacagcttactcaacatctcatgcattaaacagaagacaacagcttcttgggaagggtttacccaagcaagtaatacgatgcatctttccctcaatcttagtaaatacttcaattgattgtggaacactaatactaaaaaaggcaatcacacagataaaacataactgattttttctaactcagaattcactactttgcttcactccttatacttattgtcagatattcttcattttaagggaagctattttacagaaatgacaaaacaaagcacaaagtcatcctacctaagcttgactctcagaggaatttctaggaggtctcatatctcatatttccagtgataacattatttggcaaaggatgttaatgcaactggctctatgggctgttgtaaatagacaaacaaaaagtaagaaagagataagagcttagactatgaatgcggaatcacagaattctgaacagcagatgggacagtctttgcattacaaaatgctgcaaagataaagtattgctggacacatagccaaaggtaattaagtcaacagggccctgtgaaaaacttcaagccagcaatcagcagttgtggttcaagcccaagcaccaagactttggaccctgggaaagtcatttcatccctctggtcatcaatttctattttaaaataacaaacaccccccaaaaaaatccctctccttggccaggcacagtggctcacgcttataatctcagcactctgggaggcaaggcgggtggatcatttgaggtcaggagttcaagaccagcctgaccaacatggtgaaaccccgtctctactaaaattacaaaaattagccaggcttggtggtacacacctgtagtccctgctactcgggaggctgaggcaggagaatttcttcaacccaggaggtggaagttgcagtgagccaagactgagccactgcactccaacctgggcgacagagtgagaccccatctcaaaaagcaaaaatcaaaaatccctttcctttatttagcacttactgataaaataatctcaaagcagcttactaagtaaaattctacaaatatgttgtttggcaaatcttaccagatcccacttcctctaggagtaatacctattttttcttaacttagtctttcaccaagtttcaggcccttcccccacagtgagtgggtgtggtgagtagagagggtcaccagagcccacatgggggttaaggttagcctgctatgaacactaccaagaatggatttcagttgtttttctccaccaacctctgatgttggtatctttagtctaattttttccaagcggtttttccactccactgcgctaactctcaaaggctcccaagtcagcccacttcagttaaaactgttattcctacagacgaatttccctacagagaaatgtgttggcataattaattgtgtaaaaagatacgtaatctaaattctaaacaaaaactaacataaattaagaccagagttttaagtcaaccttgttcctttatcaaatgaaaataaacacaaaattattaaaaattttaaagctgggatattatataattgaaacactacatacaaagatgaaggcaagctgaaggtgctacctcattaggtagaaaatacctcattaggctgggcgcggtggctcatacctgtaatcccagcactttgggaggctgaggtgggtggatcacttgaggtcaggagtttgagaccagcctgaccaacacggtgaaaccccgtctctactaaaaatacaaaaaaattagccaggcatggtggcaggtgcctgtaatcccagctactcaggaggatgaggcaggagaatcgcttgaaaccgggaggcggaggatgcagtgagtcgagaccataccattgcactccagcctaggcaacgagagggaaactccatctcggaaaaaaaaaaaaaaaatacctcatcaaacaggtatacatgacagttacatgtaatcaccagtgaataaaaatatttccctgagattgctcttcaattctaaaacatgagacagaagctgcaataacggcctagaatttggggaagtgctaataaggttagaaatcatggtaaaggtcaataagaactctgtagattccccatctgctatgatgtatataatacaggagaagacgagaagctgctgagggcaactgacaaactgcattattaatattgcctactccagctacaatattaaaataatctacctcaggacggacacggtggctcacacctgtaaccccagcacttcgggaggccaaagcgggcggatcatctgaggtcaggagttgaagaacagccaggccaaaaaggcaaaaccctgtctctactaaaaatacaaaaattagccgggtgtggtgtctcgcacctgtaattccagctactagggaggctgaggcaggagaaatgcttgaacccgggaagtggtggttgcggtgagcggagatcacactactgcactccagcctgggtgacagagtgagactccatctcaaaaaagaataataatcatctacatcttcatttataagtaggaataaagaaaaactgccagattaacataatccctcaaaaaagagtgaccaagctaatgccatacataagaggaactatgtggcaagccagaaagatactgcttactcttttcaaaggtcattggaggccccagttcctggtcctgtattcctggtgaaatcatgtaatccctataattaaatccacttttatttgagagactaatgggtttctcccttacaagataatgattacaataactcctaggttaaagaaatcaaattgaaaatcaactattaagagaaacaataaaaaaaatgctacattccaaattcagggaaaacatctccctaaatgcttctattattatacaacagagatttaaaataaagtagtcaattaaggaagcaaaaaagtaataataaaataaaccaaaagggctggggaagcattacaggataaaaagaaaaaagcaaaaaaaaaaaaaaaaaaaattaattagaaagcaaaatgcagtgaagtcagatccacaaaagggaaagtaaacaaacgtatggtcttataaatgaaaaaaaaaaaactaaacaaatttctttaaacaaagaaaatagtgcatgcaactatatattctaataacttaaatacagataaaagtggtttcctagaaaaatacaaattactccatctgattcaagaagaggtatattgtcttgccctccctccacatccaaaaacatctacccaaacaagacagcttcatgaataaattccaccaagctttcaaggaaaggatggaattctgttccttaaactgttcaagagaataaaagccagggagtaaaatacatacgtgttagaagacaaatatagaaaaatgctgaacacaaaacatgaaattcaaaaaacatgcaaattattggttttcaaacttcagcagggagaagtccaccctatccaaccaaacttttaggcaaaagcctatgaaatggcgggcctagtataccatacattctttctcatttatcaacatggaccataagaagtctttgtgtaacacaatttacaaaccaatattaacacatcaatgtttcctgtgagtgtagacataaaagtcctcaatgcacccaatacagtgtaatctaccaatataagaatggtttaacataaattaagtaaattgcttggttaagattatttctatccttacagtcataagattgagtatttatgtataaaattatacaatatatggagtttcctttcaaataatttgggggaagtaggtggggacatatatgacaaaagactggagttgattaacttctgaagctgtgtactggggacacgaagaattttctatcattgtaaatttaagagtgtttcaataactcaaaagtttgcttgaacaggggaaactgggtgtgggcatgtggggactctaccaccttcccaagttttctgtaaatctaaaggtattctagatttcattaaacaaaaactgttagtctgtttgaaggtgaggtaaaaaagcggttatggcataaatactatttcccataaaaggaacccagactccttggggaaataaatggctgactgcaggtctggggcaggaaatgcacaagataagcctataacattttatcgcaccagaaaacagagaagctatcaaagatcacggggccttgtcagaagggcaaagaaaacatccagaatgggctcctagtagcctaagatgagaaaatttgagcatcaaaaagaataataactgcattggattcaaaccgattaaatatagtaatgtttcattttattcataataatactttaaaaatcactgatctcctttaaaggatgttaagggaaaaattcatcattattctgacaactgatagagaaaatgcaaacagatttttggtttgagtagaaaagccatatgattaatggctaaatgctagaagggcatttgataaaattctattcattcctgatgaaatctctcaataaacaagaaaagaaagaaattctgttaacatgataactggtatctgtcagaaagcaatagctaatatactaaaaatgaaacactaaatcacaaagctaagacttctaaaatgtatactatgttctgtcatttgacagtattctaaaaattctagataatacaaggcaatataatttttgggttttttttttttgagacaggatctcgttttattgcccaagctggagtgtggcaacacgatcttggctctctgcagcctcaacctcccaggctcaagtgatcctcccacctcggcctccagagtagctgggaggccagcccagttaatttttacttttcatacagacagagtctccctgtgttgtccgggttggtcttaaacttctgggtccaagtgatccttccaccttgacctcccaaagtgctggaattacaggtgtgagctactacaccaaggcaatataattttttttttttgagagagagaatctcactctgtcacccaggctggagtgcagtggcaccatcttggctcactgcaacctctgcctctgggattctttgcctcagcctcccaaatacttgggattactggcacacaccaccacacctggctaaattttgtattttagtagagacagggttgccatgttggccaggttggtcttgaactccggcctcaagtgatccacccacctcggtttcccaaagtgctgggattacaggcatgagccaccatgcccagcaaggcaatataaattttttaaaagtaacatttactatttacaaatgacaagactctctctattagaaatataagacaatccactgaaaaatttaaaccaataatattaaggcaaaacattgaattttccgtatatcaaatacattttcaaatggctgaaaaagagtattaaaaaaaccgaagtaacacaaaaacataaaatgcaaaagaataaattttaaaattttgcaagaggtacattaaaaaactatagaataaaagaagctttgaggccgggtgcagtggctcacgcctctaatctcaacactttggggggctgaggcaggtggatcacctgaggtcagaagttagagaccagcatggacgacacggtgaaatcccgtctctactaaaaatacaaatattagccgggcgtgatgggagggtgcctgtaatcccagctacttgggaggctgaggcaggaaaattgcttgaatctgggaggcggaggttgcagttagccgagattgcaccactgctctccagcctgggtgacagagtgagactccatctcaaaaaaaaaaaaaagctttgaataaattaaacagactgtatcatgcatgttactagataaaaatactcaacactgaaaaggtatcaattgtttccaagttataaatataaaaaaattccaacgactggttaatgagttggagagcttaacagaccaaaaccttaataaagaattaaataaaacatataatatggcaggtcatgatgaataaaatgaacaaaaacaaaggaggaagggacacaaaaagtgaagaagtagaggatttgccattttaaaggggaaaggcctcactgaaatagtaactgaataagtaactgaagcaggaggaaagcactctatggatacctgaggaaaagcattccaaggcattccatagcaaatgcaaaagtcctgaagacaaaggcaggcctaacacactcaatgaaagtgaaaggcaaaaagctcaccactgccgaaccagagtaatctagaggaatgagttatttgttgctatttgagacagggtcttggctcagctgcccagagtgcagtggtgcaaacactgctcactgcagcctcaacctcctgagctcaagtgatcttcctgcctcagcctccagcataactgggactacaagcacacaccaccatgcctgctaatctttttaattttagtaaagatgagatttcattatgttttgcaggctggtctcaaactcctgggctcaagtgatgctcctgccttggcctctaaaagtgcataagccaccatgctgggcccagaatgagtattaaaatcacagaatgatgttcgtttttcacagaaaacaaatgtggggagggaggtagtcaactaaacaaacctttactatatgaagtaactatcaaatttgtgaggttaagaaaacacagatctcatcctgacagcatcaggaaaaatataaaaataagacagaatgaaaatgctgagcaatgaaggcatataaattggtagtagggtgcaagggtgcattttgggaggccaagtgggcagatcacttgaagccagaagtttgagatcagtctggtcaacatggtccaacatcgtctctactaaaaatacaaaaattggctgggcatggtggctcacgcctgaaatcccagcactttgggaggccgaggcgggcaaatcacttgaggttaggagttcatgaccagcctggccaacatggtaaaacacagtctctacagaaaataaaaaattagctgggtgtggtgtgggagcctgttatcccagctactcgggaggctgagacaggagaatcgcttaaacccaggaggcagaggttgcagtaagcagagatcacgccactgcactccagcctaggtgacagagtgagactccatctttaaaaaaaaaaaaagataatataggcaaggaacagtggctccaaccttttaatcccagctatttgggaggctgaggcaggaagatcacttgggccaggagttcaagaccagcctgggaaacaaagtgagacccaggttctaccaaaaaaaaaaaattgtttttaattaccacggcttggtggtgctcaactgtagtcttgattacttaggaggctgaggcaggaggataccctgggcccaggagtttgaggctgcagtgagctataatcatgccaatattcccagcctgggtgacagagtaagacctcatctgaaaaaaatacaaaatagaggctgggcacagtggctcacacctgtaatctcagcattttgggagaccgaggcgggtgaatcacgaggtcaggcgttcaagaccagcctggccaagatggtgaaaccccatctctcctaaaaatacaaaaattagctgggcccggtggcaggcgcctataatcccagctgctcaggaggctgaggcagaagaatcacctgaaccctagaggcggaggttgcggtgagccgacgtcgtgccattgtactccagcctgggtgataagaacgaaactctgtctcaaataatattaaaaaataaaaataaggaagaactaacaacaattcaatataatttcttccagaaaacagaagatgagagaatatttccaaattcattttatgaaactaatattaccatgataccaaaacaaaacaaagacaacacaaaaaattaaactacaggctgggtgcggtggctcacacctgtaatctcagcactttgggaggccaaggcgggcggatcacctgcggtcaggagttcgaggccagcctgaccaacatggagaaccccatctctaagaaaaatacaaaattagccatggcacatgcctgtactcccagctactcaggaggctgaggcaggagaatcgcttgaacctgggaggcggacgttgtggtgagccaggatcatgccattgcactccagcctgggcaacaagagcaaaactgtctccaaaaaaaaattaaactacaaaccaatattcgtcatgaatatagacgttaaaacccttaacaaaatattagtcaataaaattcagcaatatataaaaagaattaaacaccatggtcattatgcaccatgaccaagtggagtttattccagtatgcaagactggttcattatatgccactgctgctcagcattttcactgtgtcttatctctgtatttgttttgagatctatagaatacatcatattaacagttacaaaaaaccaaatcatatgatcaaatcaatcaatgcgaaaaacgcatttcacaaattcaacacctgttcatgatttaaaaaccctcaaaaacaagaatagaggagagcttcctcaatttgataaacaggtctaccaaaaaaataaaattaagccaatattatactcagggcggaaagattgctttccctctaatattgggactgaggcaaagatgcctactatcacccctcattcaacacagtactaaaagttctagctagcagaataagacaagaaatggaaataaaagcagtaagagttgaaaggaaaaaataaaactatatttgtagatggaatgattgttcacatagaaaatctcaacaaatctacaaaacaactcctagaacttgtgagttcagcaaggtcccaggatataaaatcaacacacaaaaaccaaccacatctttatacactaaaaatgaacatgtgaaaacaagttaaaaacatcaccatttataacactccaaagaaaattaaaatacatatgtaaaaatgtaacaaacacgtacaggacttatatgctgaaagctacaaaacactgaaaaaaaaaaaaaaaatctaagaaaatctaaaggccgggcacgatggctcacgcctgtaatctcagcactttgggaggctgaggtgggcagatcacctgaggccgggagttcgaaaccagtctcaccaaaatggagaaaccccgtctctactaaagatgcaaaaaaaattagccatgcatggtggcacatgcctgtaatcccagctactcgggaggttgaggtaggagaattgcttgaacccgggaggcacaggttgcagcgagccgagatcgtgccattgcactccagcctgggcaacaaaagtaaaactctgtctcaaaaaaaaaagagaaaagaaaacctaaacaaataaattcttcacggattggaaaactcaacatagtaaagatgtcaactttccccaaaccgatatataggtttaacataattcctatccaaattccaacaagatttttgtagatatagatgagattattctaaaatgtatatgaaaaggcaaaagaaatattaatagaacagccaaaacaatttttaaaaagaacagagggagaggaatcaatctatcccattttacaacttagctaggactgacagactgcatggtattagtggaagggtagacacatagatcaagcaaagagaatacagaacccagaaacagacatatacatacatacccaaataatttttgataaaggtgtaaaattaactcagtggaagaaagacagcctttcaatatatggtgctggatcaactggacacccatagacagaaaaatgaacttccacttaagtctcataccttatacaaaaataactccaaatggatcacagagtcaaatgtaaaaataaaactgtaaaacttttttttaataagcaggaaaatatttgggatctaagactaggcagagttcttagatttgacactaaaagcaagatccataaaaggaaatatgacacactggacttcacacaaactaaaacctgtgctacgcaaaagacccctttaaaaggaaaaaaagacaatcaacagactcaaagaaaatattaacatttgcaaacacatatctgacaaaggactactatctaggatatacttagaactctcaaaactcaacaggaaaagaaaaagaattcaattagaaaaaggacaaaagacacaaagagacatgtcatggattgggatatacagatggcaaataagcacataaaaatatgttcagcatcattagccattggggaaatgcaaataaaaacctcactgagatatcactagatacctaccagaatggctaaaatgaaaaacactgataacaccaaatgctggcgaggatgctgagaaactggatcactccatacattgctggtagggatgtaaaatggtacagccactctggaaaacagtttagcaagttctttaaaaactatacatacaatgaccacacaacccagcaactacactcctgggcatttatctccgagaaagatgtgtgcgtaagtttaccaaaaaaacctatgcacaaatctttatagcatttttattcataattatcaaaaaactgtaaacaacccagatgtccctcaacaggtgaatggttaaacaaactatagtgaattcatatcgtggaaaactattcagcaataaaaagggatgagctgtttatatacaacaacttggatgaatttccagaattatgctgaatgaaaaagccagacccaaaaggttatccactgtgtgattctatttatgtaatatttttgaaaagacaaaaatcatagaaatgaaaaagatgagcgggccccagagagtgagggaactggatgagacaggaacaagtgtgactataaaataacaatactttggagagagggatccttgtggtgataaaatggtctatatcttgattgtgttcatgtcaatatcctggttgtgatactgtactatggtctttaagatgttaactctgaaaaaaaactagagagagtatacagaatgtctctgtattatttcctagaaatgcaagtgaactgacaattatcttcattaaaagtttaattaaaactacaaggagtaagactatcagactagatttttaattttcttaaaattcaatggtattatatttgaaagagataaaactgaaataaaaggacacaaaaatgtaacggtgaggagaaattttttaaattaggcaaaactgacaaaaaaagaaaaataacctagaaggccgggtgcggtggctcaggcctgtaatcccagcactttgagaggcccaggtgggcagatcacctgagatcaggagttcaagaccagcctggccaacatggtgaaacaccatctctactaaaaatacaaaaattagccaggcatggtggcaggcacctgtagtcccagctactcaggaggctgaaacaggagaatcacttgaacccacgaggtggaggttgcagtgagccgagatcgcgccactgccctccagcctgggtgacacagcaagactccatccgtctcaaaaaaaaaaaaaaaacagagatgggggtctcactatggtacccaggctggtctcaaactcttgggctcaagtgatcctcccacctcagcctcccaaggtgctaagattacaggattacagttctttcatgtgctagtaataatgttaaaatatggtttaaaaatcgatagaactacaaagaaaaatgaaaaacgaaacaaaattctagtaaaagattaactctgctctcttaataaaaaataaagatatgagatttgaacaacataattaacaaggctacataatgaacatatataaaactgcaccaaaaaccaggcaatacatagtctcttcatgtacaaataaaaattattaaaatggaccacatttttaatagtctaaacatatttcaaagagttggcattatacacaccaattggcatcacactcaaacaggctgcctaaccaaaatgcaattacaaatcaacagccaaatcaactagaggaactctgtttggaaattaaatttttaaatagctcataagttaaagaattcacaacggaaaatagaaaaatacaagtaaaaataacggaaatatcacacacatcaaaacaaggaggcaatacgcagacattttatgatcttaaataactatgttaaaatgctgaaaattaatgacaggcacccagcttaagaaattagaaaaaaagaacagaactacaaaggaaatgtaagaaaagaaaagaagagcaaaaattaatgaaacaggaaggatacactaaagagcataaacaatatcaaaaacttgattctctgaaaaatctttaaaaattggcaaacttttagccaaaaattatcaagaaaaaaagaaggcattttaaaaaaagacaaggggatattaactacaagtaactgcaaagaagagattaacaactaaatgctacaaattcaagaatgtggatgaaatgaacaactttctataaaagtatgaactactaaaacaggtttgaaacttgaaaatatgaacagtcctacaaccaaagcaattgaagcattcctcaaagaaaacaatagtaataattttataagcaagttctactaaatatttaagaaacagacctttctaatgttacataaactcttccagaagagaaaaggtatattttttaactataggctagttttactcattatgagagacaaaaatcctaaattaaatatctccaaactgagtccagtgaaaaaaaggaacagatagatcagggttgaatttatacttgcaacacaaagtttgtttaaatattgggaaaaaaattaatataactcagcatgttaacagattacaaaagagaaataattttctcaaaagatgcagaaaaagcttctgataaaattcattcatgattttttaaattagcaaactaagaaagggaacatccttaacctgaaaagattatctataataaacctacagcaagcatcatacttaactgtgaaactttgaaagcattccctttaaaatcaggaacaagatcaggatgcccccatcacagcttctattcaacattgtactggagatcctagccagcacattaagacaagaaaaagaaagaaaaaaaaaaagcataagaattggaaaggaggaaacaaagaggtcattattcacagataggactgtctgcatagaaaaatccaaaagaaatctaaagataattaatcacaattaggagtatagcaaggttattatacaaagtcaaactgtacttctgtgcaccagcaaagtataattataaaaagttaatatttatgatttgctataaaaataatttgttagaaataaatctaacaaaatatttgcaatactttaactgaaaataacaaaactttattgaaagatgttgtaaaaaacctaaaagaaatggagattacaatgattgtggttaagaaaacttagcagcaaaatgtaattctctccaagctaatttacagattcagtgcatttcccatcaaaataccaacaagatgtatgtgtgtgtgtggggggggggggaggtgtataacatgaaaatatgattctaaaattacatggagaagcaaacaatcaagaagttccttgaacaattacaagccaggaggacttgtgctacttctgtctccctcaatgactgactagactgtttcataccaaccctccctgtgagaacttaacaactgaatataatattaaaaaacaaaaatctgtgtgaatgcaggaggcactacaaaggcagtaaggacctgagacaccaagactctgaaaagaaggagagcctgcaaagctgagtctcttgatgccttccccggagatatctgccaatggaaaagggcaatggagaggttaaaagtccagcagaactctgaatagactcaggggaaacaagagaaggtatgtgcaaaacataaccagcaagagatggtttccaagatgtataatgaactcctacgaatcagtatggaaaagacagatgtcccaatataaaaatgagtaaaagacttggcaagccactttacaaaagaaacccaaatggccaataagcacattcaaaggagcttgacatcattacttattagggagatgcaaattaaaaccactacacattcaccagagtgtctaaaattaaaagggtagacaaggatatggagcaactggaactctactatatcactagcaaaagggaatgaaccaactacaactacagacaacaataaggatgaatctggcaaacgaaacagaaaaaaaggcagaaacaacagaatacatatacagaaacagaatacagttgacctttgaataacaataacatatagttgaatattgaataacaataacatatccaataacaaaaacctgtgttagtcaaaggtcaactgtatcttgtcaactggtttgaactgtgcaggtccacttatacgcatatttttttttcaaccaaatgcagatcaaaaatatggtatttgcaggacgtgaaacccacatatacagagggccaacttttcctatacatgggttctgcagggccaacttcaggacttgagtacacatgattttcctgttgggagggtggatcctagaaccaatcccccaggtacaccaaggggcaactgtatatatactacacaggttccatttatataaagttcaaaaacaggcaatactaatctgttaaagttaggatagtaggtcgcttttggaagaatgaggtgaggttagccactggggaggggaatatttagagtgctggtaatgttctctttcttgacctgcacgattattattttgagaaaattcatccagctataatttcattatctgtgtacttcctatgtgtatgctatatatcaaaagaagtttggttttttattataaaaaatattatcttacacagagatggggtctcaccatgttgcccaggctggtcttgaactcctggctcaagtgatgctcccaccatggcctcccaaagtgatgggattacagccttgagccacctcaccaggcaagaagtttgtttatgctagcagcagcatcatcttgttttagttactgtaactttttaacaatttctgtaaaaacagactaacggcccagagtccagaaccaaagcacagatgagtgatggcatccaaaccagtgaagaaaaaaatttgcatgaaaggtgatggaacaatttattattctttgaggaaaaaccatgcatcttggtcaccacttcacactgtatacaaaatcaactccaggtggattaaaaccttaaatgagaaaaggtaaaaaaaaaacaaaaacaaaaaacaaaaaaactacgtcttatacttttacaataatggaaaatatcttcgagaactctgttgaaaaatttcttcaacaagattcaaaagcactatccataaagaaaagcctgataaatgcaatcacataaaaattaagaacttctactcatcaaaaaacgcataaggctggatgcagttgctcatgcctataatcccagcactttgggagaccaaggtgggcagatcacctgaggtcaggagttcgagaccagcttgaccaacatggtgaaaccccgtctctattaaaaatacaaatattagccaggcatggtggcgggtacctgtaatcccagctactcagaagtctgagacaggagaatctcttgaaccttgggggtggagggtgcagtaaactgagatcacgccactgcactccagccagggctacagagtgagactccatctcaaaaaataaaaataaaaatgatttaaaagtgagcccaattgaaaggagaaatttgcaccacatgcatccaactgtgaaactattaaaaatcagtatgaaataatttttttaaaaaactagtacaaacatgggcaaaagacatgaataggaatgtgagaaaagggaagaatggctaatcagtatagtaaaagatgctcaaactcattagcaaagcaaatgaaaactaaaaggtggtattttatactcgtgggtaaaaacttttttttttgaaacagggtctcactctgttgcccaagctggcgtgcaatggcatgatcacagctcacttcctagcttcaggtgatcctcccatctcagcctgccaagtagctgggactacaggtgtgggccactatgcccagctaattttgttttgttttggtagagatggggtttcaccattttacccaggctggtctcaaactcctggtctcaagccatccacccaccatggcctcccaaagtgctaggattacaggcgtgagctaccatgcccaaccgataaaaccttttgaagtgtgacaaaagtagatgttagcaagaaagctgagtaatgaaaacttctgcattgctggagagaacgaagactgacaccaccttttttggaagataatctgacattatccaatattggtgaatatgcacacattcttcttaaataccagcaattctattcctagaatctctacagtgaaacatacaaatattcacactaagtgagatcaacaaagattacaatatcagtgcaggtcagggtttttctgcaagacaagtttggtgaaactttacagtttttttctcttcattttcaaacatttggatttaagaaatatggatggccagacacagtagctcacacctgtgatcccagcactttgggaggccaaggcgggtggatcacctgaagtcaggagttcaagaccagcctggccaacatggtgaaaactaataatacaaaaaaattagccgggcatggtgcacacctgtaatcccggctactcgggaggctgaggcagtaaaattgcttgaacctgggaggaggaggttgcggtgagtcaagatcgcgccactgcactccagcctgggcaagaagagcaaaactccgtctcaaaaaataaataaataaataaataaattttacatatgtatatatgttaaaagtataaagacagaccaggaatgatgaatccaaaattcagtacaatggctactgtcattggtgaaggtggacatggttgcagtggatgtgatcaggaaagtgcatcctgctaaagttacactaatgaattagtaaactggttggtaattatatgtatgtttgtttacatacgccttacctgttataatcttttgtacttatcaaataacttaaatatttaaaatacaaaaattagtatggaatacctaaatacaaacccactgttagagtcaccaattcagggaagtgtctcaagaactctagagaaattagcatcagagaaattcaaggtatttccccataaatcaaggacaggttgctatttaaaaagaaagaaaaatgaaagatgatagaagaactcttataaattaaagataactactgaaataaattttatagaaaagttcaaagacaaaatcaaagaaacctttcagaatgtaaacaaatcccgtagatcgtagactacaattgtagattacaatcttctacaggagaataaccatcagatctgcaatggacctctgattagcacaccaagtattttagattcccacagcaaagttttcaaaattctgaggaatttataattccacatgtaaactttcaatcaggaacaaagacaagccattttcaacattcgagaactcagaaagtttatcaccagcatatccttccagaaacaactattgaaggctgtattcctgtaaaataaaaaaggtatctaaaagagaaaaacatgggatccaaataacaatagatctaacccaggagaacaatgtgaagtaatcccaggatgacagctgggtaacaggtctactaagcttcccaaattagaaaaggcaggccaagactccggaaagtctaccaagacaagctgaatggctacaacatgagaacccattataatattaaattttaaaaataacttcaatgagctttcctcattcaaccaggactttgttatatttcttttttttttttttttcctgagacgaagccttgctttgtcacccagcctggagtgcaatgacatgatcttggctcactgcaacctccacctcccgggttcaagcaattctcctgcctcagcctcccgagtagctgggattacaggtgcccaccaccacgtcgggctaatttttgcatttttagtagagacggggtttcaccatgttagccaggctggtctctaactcctgacctgaggcgatccgcctgcctgggcctctcaaagtgctgggcttacagacgtgagccactgtgcccggctgactttgttatatttcctttttaaggatcacaggtttaacagaagtgaagtttctctatggctccacagtacttggttctatagtaactaatactcatgtcaacatacatatttaaaagagtggctattagtactcaatttctagattttcctgcagaagcacagaaaactttagaagagttataaaacattatataaatgcaataaatcttgccaatgtaacagtactaaccaaaaacaaaggctggggccgggctcagcggctcatgcctgtaatcccaccactttgggaggccaagggagggggagtggatcaccggaggtcaggagttcaagaccagcctgaccaacatggtgaaaccctgtctctattacaaatacaaaaattagccaggcatggttgcaggtgcctgtaatcccagctaatcgcgaggctgaggcaggagaatcgcttgaacccaggaggcggaggttgcagtgagccaagatggcgccattgctctccagcctgggcaacaagagcaaaatcctgtctcaaaaaaaaaaggaaaaaagaaaacaaaggctaggaagggaggagggaaaaacaaaggcaaggtttggcttttaaatcccaaaaggaaagggatcggtgttatatctttttctgaaagaccaggaagtgaggaaatatagttgtctctcagtatccgtagggggctggtaccagggtcccctgcagataccaaaatccaagaatgctcaagtctcttacatgaaatggcatagtatttgcatataagctatacacatcctcctacgtactttacatcatttctagtttacaatacctaatatatggcaaatgctatgaaatggttgttatactatactgtttaggaaatactgacaaggaaaaaagtctgtacatgttcagtacagatgtaaccaaccttttttcctgaatatttttgatccaaggttggttgaaaccaaagataagtcattcacagacatgaagggccaaatatactgtctaaaagtgataggtcaataaacagaaatttataataaaaagttaaaaataacagcaaaattaggaaccaaaatgtaactgatagaaatcaaagtctaggacaggtggaaaatgacctaaatttcttatctagcaaaaagttaagaaatattttttttgagttgaaaaaatatagagagaaaggcatggtatatttttagacttttggaacaacaataaaaccctaaaaacaaacaaacaaaaatggttaaaagcataatgggagtgggatttaatggaaaagggaagactttcactattttgaattttttcagtactgtctgcacaaatattgctttcatttaaaaaatatgagaaatggaaatgagagaataaaaaatgtgacatcaggtgatccacccgccccaggctcccaaaatgctgagattacagccttgagccactgcgcccagcctatttcactttaagttaaatatattttgtttcgaacgtgctttcatagacatgagctcaggtgaagccttggaaattttagttgcatcccataatagctttgaatcatatggaagattctgttatatctatcatagctattagtctgtatccctgcccaataaatggggagaggagcgtgatgaggacctctaacctcaaatcccccattaacttcccattctcctgctgcatcctaacagcacttgaagttatcaggatggtgactcctggtaggtgtaaggaaaccaaacacttaagccttctagacagaagaccttctgttacagaattacttaggcttcttagcatgaaagacccaaatctgatcttcgaattatgacacaacaaatttacccagtttggtaaatgttctggtttacccagtatctattgataaagttatcatcgctggctctctcaggccaaatgcacaaccagattctcacaggcacattctctctcattctgagacacacacagaataaattctcaatgcatgaaaagaaggggatgaagaatacagaagggagatccttaaaaaaaaaaaaaaagtcactacaatagatccccctcctccccattgagtgatgagaagtagggaaagtagattaaccaggttaaagtgtagcagggacctttttgtgaatgactgccaccagcagaccacaatattggaaatatgcaactggaagggtaaagaaaaagctgctctggttaaagaagaggtaagtgattccagaaactcaactcctgctctcctccatccctgtgcttagctcttctacagactagtttgagacagggtctccctctgtcgctcaggctggagtgcagtgtcaagatcagagctagctgtaacccagaaatcctggcttcaagcgatcctcttgcctctcaaagcgctggaattacaggtgtgagctaccaagccctgccctccagaccatttttggaggaggaagcaaggcagcagtgacagaagttcaggccatcaaatcttatgatcttgtcccacattaattcacaactagttaattcaaaatctgttcattcacaaactaatcactccttcagctcctaacaacacagatgccataaataagcaactggtaaattgagtaatttcttctctggcaccttgaaagcttctaatatataacacattattgtaaccatctttgagcacacaggccacattttcccttttcagagaacttccccacttcctttccttcaatccatcaggataatctgctgatcaggtttgtgtgctttgactctaagcccccggctatggatgattagaacagaagtagagacctaaactcagccaatcagattctctctcccagaagaactggaagagaggtgggctggtattctggtcacccggactgaaaggcaacaaggtatagagctgccatattctgctatgaccagccaagatctctggtactggctcacgcagcagtctccaaaactgaaatagtcaggcgacccccttaacagttgcctaatcgaataaccaaccctcccccccccaactccacccccgacacacaagtctgaaaagcaaaggcaccagggtcaccaaaccacactgaggattacctttcccaaaattccctatctccagtatagatgcagcactagccaggatatgaactgctctggttatacttgtccaaaatgagtagccttgaagggtaatggaaatcctctctgtggcatatcagcagccaaatatgtggcatccagatcggctgaccaatttctctactgccaagaagttagccaacaaactaatgcccaaaatttttcctggtcctataatttacttgagcatcactctgaccaccacaatatattctgatccaaggaccatcattttgagaatccaagattatttcttccccttttctttctttctattccgttttttagtctgtttttcttcctttattataatgtcacacaagaaggatgttaccaatcatttaatttaggagcaatcgcaggatgatggctagaagctccacctagaccccaaggtaccagaacaaagtagtgtagcccgggctctgaaaagcccagactctaaaagctacatgtctaagattaaaaatcttagcttttcaaatctcaagctgtgtgatttaggtcaggttaacctctctgtgcttcaatttcttgaaaaaattgtgagaattaaataagtatagaaaaaatgcttagaccagaaccaggcatggaataaccactatattaaaatgggtatataccatcatcatcattactgtctgtaatgggatgtaagggcggggtacagttcatcttcaagtgtagggtaacatgggtctgcacagagcagttaaggcaaagaaaagcagatgatgcttactgcatgtgcccagcctgcacccctcactcctctgaaaattctccccagttagtctctgttgggcacgtcatatgaattgtgggagaggggccatcttctaaaaatgcaagaagtaaagacagctgatttacaggaaaagaggatgaagctgatccacaaaccaaaacagagaggaaggcagaaaggaagagaaaaaaaagcttctttggtttctatcactttccagttgctggttgcactccaatctgagcactgactgcttttactctgctctataagagcgagtaaattcttcgctttacattaagctttggccaacaacattcacaagagtctaataaaaatcctggaaagttttcattaacaaaaaaaaaaaaaagaacttagaaaacttgtatacatctgttactacacaaaaattaaaaatggcaggtaaaaataaatataacttcagagttcagtcttctcaacccatcctaaatctaacgcatgaatttacagaggtgaggttcagggttcgttgtttgaaaagctccacaggtgttaaaagctctacagctggggctctgagccactaaaacccttaaacttatcaagtatgaacaccctttacctacacttatggttctctgcataaactagtatggggcataacatgtattaatatgtgtttactgggaacttaataattatttttgaaacagcaggagggaatatggcaggcactgtgcaaactccaacaatctccgtttagagcagaggatacgttcttttgctcacgtccactaagcaggtaaccagccaacatccttcccccatcccatctcttgcggaaaacaataaatatacaaaactgaaccttttaccggattcctcttccttatttgaaaaagaaatcctaatatcataagtgttacacaaacgagttgcagtaaatgtaatttcaagtttacactcatctctaccttgatacatttaaaaaaaaaaaaaatcagggtttctgtccgtaaacatctcatttatgtcgccagtaattcagcgatacacacaaatccatctcattcgtcacacttagttaggactttaaaggttatcagtctggggggaaaaagtctcttctgttctacccccatcacagccctattccagacctctgctatacaagggtatcaacaataaagttatgatcttgttttaagactgagaagaaaaaaatatttttcctcaagagtaaaaggggtgcacaaacctcacaacatagactttgcagatttcttactaaaacactaagaaaatatcgaggtttaaggccgattattgaaggcagggatccccaaacattaggttcctcgaagatgttaggaggcaagggtgggagaaggggccttttctcgtgacagacctgactaaacggtagcatcagccataagaagaggagagattcctaaacgcaacttcagctttcagaaaacagtcctccaccaagtgagtagcatgcagacttgtgaatagccacagacacgtacaccccggtgaaggtgcaagatcaaacgttgcttcccacatcggccctcactgcgaaccgggatgtcgggtccccatgtgcccctcctggagggcgccccgaccccccgcgccaggtgtgcggaccactggcagcactcaggagccggctcgccgcggcccaggcccgccgcccccgcgccgcccgcgtgccctccgccggcccgctcccctcccccgcgccctcggcgcccgttcgtccgcgggccggggctcagggctccgccaaccggccccagaggcacgagcaggcggcggccggcgacgttgcggtttccccacctcctctcccatcccctcccccgcggcctccgctctccactcccgcttaccctcaactcttcgaaatccgccattttataccacccgcgggcgccgccgccgctgccgccgcacccactcccgctgccgccaacgacgctgccgccaccacggccgccgccgcctccagcaccatcctgcactgggcgccgcttaagacgccgcggccgccgccgctacagccgggcccgtcacgtgaacggcgcgggagctccgcctccg

SEQ ID NO: 394 - DNA, 7010 bp, Homo sapiens
  source 1..7010: mol_type = genomic DNA
tgattttatgtcattattttattgatgatgtgttttatagaatcacaaaatttagaaacataagaaggatttaggtatcacctaaattcaaagaaatgtgtgtttctaggttgctaaatttgaagagaaagtatgatttggtttggttcatttaaaacaggtcagaaacagaattatatttcaaatttagaagacacggtattaaatgattcatcttatcttggacatttttcctcaagggaaatttttctggaaggaaaagtacatttatatgtgggcttattaagagaaagagagaaaggcatgctattttaatcattaaattcttgatgatgactatcatcatcaagatgagatagaaaagaaatatgagccaagagaatctgttgttgccagcaatcagtttaccagaacacctctaggtgaacattttctaaatggagtgacagactaattgcatctatggggatgagaatctgccatagaagaggatgctgttggtcttattttgccttatgaagaataggaaagggtgattacaacagaactcttcattagttgaaggagatgataattcgactactactacagcggtggcagctgcagcttccactccctcctcagtgacctccacaaaggccttgtgtaggactttagatactgagagaccgtggctccaggtcatgcctgagaggtctgcatccccattgaagatattcaccattcccatggttctcaacgtgtccttgaggtcatagctctcttccattttgaaccgaggtaagtgtaaatcgacacatgtctctctcatattctgcaaacttgtccattccatcaatttctcagcagtgagtttctcttcaagctatacaaatggaaaaaagaaactgatatgactaactgtcgatctctaatacaccttaacaatgaattgactatgtggagattcgttattttggcaataaatgtgaaatacagaaggttcactttaatagacattattattctaataggtaaaatatgagtcctgaatatataaatacattgggttatatgtgtatatgtatatacatgtatgtaaaaacagaatcatgtttttacgtatatgtatatgtgtacatatgtatgtatacaactgtatgatacacatgtaaaatatgattacattattttgtacacaatgaactgtatgtatcactatttcttgtgccaacagcctactacatgtgtcaatttttaataggctcatcatatttttctgtatacattatttagtacacattgcaattattaaattgtaattccctaaattcctaaatttgtattcccttttctactcggcctatttgtaaactttcctcacattggtatatatttctcccagtcaagtttaaattgctgcataataatatcatcaaattgatatccaatgcatgtaactctaataaattaatcattaactaagccatagatggaattaaatcatagatgggaattgaacaatgagaacacttggacacaggaaggtaacatcacactctgaggactgttgtggggtggggggaggggggagggatagcattaggagatatacctaacgctaaatgacgagttaatgggtgcagcacaccagcatggcacatgtatacatatgtaactaacctgcacattgtgcacatgtaccctaaagcttaaagtattataataataataataaaaacaaacaaacaaacaaaaactaagctttcagtttgtgtcaggccctatgctcaaatatttgtaatatgaaggtgagtcatcattcctcatttagaatttttcatcattttgaggcaactcggtcataagcttttaccttgtttaaacttggtatctttggaaaaatgtccggcagtagaaggaagagttgtagatgcaagttcttaccttctgcagaccatcgatttcatttggcagcagcacaatcatgcttagatctttgcctttgtatggtatttccaggaccttggcctgtacatcctccagcaaggcaaaattaaaggaattgtattgcctcatcatctgtacagatttgtatgtattctgcaataaatcaatgtgtccaacaaataacacgtgaaacacaagacaaaaaagataatattattgagatagcaacacatccttcttcttctaagaaataacccaggaattccatgagttagaaacaatagtttttcaggtattcctaactaaataaagttataagagtaaaacaacaaaataacagacatgaacaatttttattttttacttatcatgttacattccatcagaaatgtttaacattccatgtattaacatattacactatataaataaaatatagacaataccttgtttggccaaaatttttcctctttagtgttttcttttttaaatttattctcccactgccctttgaaatagattgcgttcacaagaaccagtgtcgtatcattgccaatagtcccatcaggaaataggtttttaattttttctgcaagggaaagaataaaagagtcttttacacaagctacaaatggcttgtctggaagatgctttgcaaatgttcgtgactgatcgttaattattgacccaaatccctgcttgagactcactgactttgatctttgaattgttagactcactgaccagtggttcaccagatgcagctttcttcaaggctccagtcgtataaagttacccttgatggagacatcacttcttgtgatagagaaggagttcacgttctctgtgtatgaatgtctccaatcatctgatttggaatactgataaactgattttgtctactcttccaacatgtgtctttcctttctccctccctcctcttcctacttttatttttttttaactacggggtccccattcagaggaaggaggccctgattgcattttaggatgagtgacttgagctctgtaatatgaaacgcatgtcctgtgctgtcagacactacttccgggggtatcttcctattcactctcatgttgagttgctgtaagtttggcctgtaatgagaggtgggaggtaagaaagatgtctgtagaatggagactttgtcaagctctttgcccttgatggggaagagagctgtgataatccctgcagaacacattggctacagatgtgatccaggcagctccagctcagagacaaaagggtgatttaccagagagctgcttgtttcccaattagtaaaggagacgagagacgctttctaatgttttctattaaatattcatcataaaaatttgagtctgatttaaagtaaaggatatgatctcaaaataggcctgagcggagacaggggatccacaaagctattgtcatgcagggccataagcaaataattctccagatgtgtttccatctaattggcttcctgtgatttcctccttggctcccctaggctctcttcatattcatttggacaaatccttcatctggagtgccctcttcagccctccctgcaaacccatctcaatccccacacctgttcccccatgcagtgtcaagcacaaggctcactggcataggtttctcaaaggtgtttctataatgggtggctctcctaccattcgtttgactttccacccaggagttaatcttctttcgactttcttctggagcatttgcaaaatcagtagattccacactggtctggtaaaatttcttgatggcatctaaatattcctttgagatatgaaggaagaagtaggaattaggagtaatttatgtaactatatattaccaaacttacttatttgtaacaacagtaagctgaatccagaccctgaatagatgcagtatctcctgtccatggatatttttatacaggtgtcatgtaggcaatgcaaaaggggaatgtgggctggcacaagaaagaggtcactgaaggtcaatatcatcttggcaaaaggcagaagcagaagaggctgtggtttgcaaactgcagagcaggcttccctgaaggagattcattgcttctcagacttctctccagtaattttaaccatgatgtttctgatctttgtttttgtctttcatcctgtgcattcaatatttcctggtacttcctcaactattctcaggaactcacccaagcctgcccattccaataatatcccattagtcatacatttcccaccaagatgtatcgtatgtgactgagtcagtgccagtttatcgatggtatcttattacttattactcttactcactctattacacaacctcctcttttatcacaagattatccctaaatccacacttcagtgatgtatcgttggggtctgggacactccagtgggggagagttgtggaaatggagctaatgcactctgagtaaatgctctccacctgagtcggccaggctcatctgccttgctttcttccatttggccactcagagacacagacatcaggatgcaaatgaaatgtgggtaggccaggtgaaattacctgtaaaaattgatacgtcttttctccgaagagcttgttggcgatcttcagctcatatgcatcagtggatttgttgaattcagtcagaagcttttgaaactggtgatgaacatttcctgacctatcaaccttcaaacatcaaaaagggagatcattcaattgctgtatcaatgtaaatactaaacccatgctaagtctgttagatcagtccctaaatgctggtagtctcattgaggacctttgatgttattccctgataattggtgtatttcacctcaaatacccttcaaaatccaccttatatttgacttcttccagaaaattcttcttgctctaacgtactgcaatcttttctcttctgaactaaagatgcagcgctgtctaccagtagattttctccttgttggtttaaagggttaggtttagcttcccagttaaactctcagctccttatgggcaaggaccatatttcacttctaacagtcatcaaggatacgagtatgttgaaggttggatattttaaatagattatgccaggaagccctgttatacctgttggtgctattatcttgtaggacacattgactgatctgtggctctttcctcatgatggtcattctctgcacgtaagaagagtgtatgccaggtccatggctaaggactttacatgggtaactctaagtctttagttcaattcagatgaacacaagaaagctcagagaatggggaaaaaaaccctgtttatagagacataaattagaagtgccaagttttgaacctaagcctgtttaaatctagaactttctaccttccagcaaagcattttgcactattaaggctctaaaccaatatattccatagcaatcattttccaaaatatacttggacttgtgcttattcctctgaatctcattaatgactcaatgaaaattaaattattttcacattattatgattagtataattatagctactttataataataataacatttattatgacttttatgggcaaggcactgttgtaaacatttgcatgtatttgcatgtattgagtcagattttttcttacccttagttttctgggatgaggtcactgggactccgagcagttgtgtcctgctcttattcatcatttgtgaagagcaaagctggagtctgaacccagcctatcctgatccagacctatgctctgaggtacagtgctgactgtcttttagtaacgcagaaatgaggaataataattatgtgccatgaaatgccaacccactctgtatgtctcaatctttgtgtccaagattttccctaaaactggccttttcttagtttttgtgaagttccaggtttaaactatgacctgttcagggatctaaagctgaaccatagtgctctgtgactcacatgatatgttgcagctttttctgtggtgttctctgtgacttgatcaaagtgaagaacctggaagagacatgaagcgggacaagaaaactttactcaaaagatctgtttaagtcagtggtctcacagttatgggaattcctgcacagccccctgtgctacccatcagaccaccacatctattaccatctgcgtgctagccgacggaaccagagaaaaactgcaacaggacaacgtaatgatgctgatagctaccttgctaatttgttgtgcagtgttgtctttggctcctaagaggaccatccctaatgctgatgtgatgctgataggggaatagaagatgttgttctcttttgattttctgaactgttggaacagatcgaacatgaacttggtgttggcttcactgagtgaattcatggtgaactcgatgtgatctggaactcctggaaaagcatcagattcctgtcagaatgactttaataaatggaatggtattttgtagtacaattttcttaaagaaatgatatatctgggttgtgagattttgacatttaaagtttttctcttatttttaacgcttcaatctttctacaatgtgcatatattaaatatattaatgtcctaattagaaggcttacaaaactacgtttttaaagactattgtaaataagtaatcgaccctctttatctttctttcattgctggttacactagagctaggtaggatggctttacaatgaatgctaacaggagacctctgtggatcacatccaaccagctgttaagatgcgtccctgacatctccttcaagactctctggctgcaaggcactctccctctgtgttcctaaaagtgccttggtttacttggaactaagcaatttagataaaggacaaatcagatgaaataggtattttaattttgctctggcagaataagtaaaatataatcagacagaatgcaggagatgcatgatatagaacacagtatcattattattctcaaaaataattcatgttattaagctggagaggcttgaagctcttacctgtgttcctagaggaagcagaggtgggcagagaggctgtgtgtgtctgtggaatgaagg

SEQ ID NO: 395 - DNA, 16116 bp, Homo sapiens
  source 1..16116: mol_type = genomic DNA
aaaatggggagggcaagtgatgaatgtcactagacagtggggccctcaaggacctggcaaatgggggcttggacctcggatcggcctcccacgcgaagcttgctccccaccagcatccccacgttggtggcgacgctgccccggccccacggatacttccgcgcctgtcagactccctgatgaactacccttcccagagtaccgcgggagctcgggctcctgagggcgacggtcctctgatggcagatgcgggagaaactctggcgtcaggcggccctcgcgtggagcacacgaagtcgtggcttattctggcttcagtatgtggggtggagaaggcgatccacgcagctgcgtctatttcctgtggatcaatcgcaaaatacgttctgtaagccccgcccccactgcgtgcgggcggcttttgtctccacggcaaccgtcaactctggaaacgcctgtctttctccatggcaactgtctacgccgcaggctggagctgcccattaccggagcccgtaagcagtatgggtgctggacaaacagcgtgatcgggtcgtaaaacttggtggaaaacgaatattagagcacaaggaaggaaaaaccgggctgggtgggactgaaatagttgatgtgagggaagatttctcaaagggagactatttttttattgtttgtttgttttttacttttattttttcaagacggggtctcgctctgttgcccaggctggagcacagtggcacgatctcggctcactgcaacctccgccttccgggttcaagcgattctcctgcctcagcctcccgagtggctgggattacaggcgcccgccaccatgcctggataatcttttgtatttttagtagtgtgaaaaatgggaaagttattcttcaaagattataaaaagtcacaatttcttagtataagattgctatccactattatatattccaaatcagctgtcctagcttgctccggcatgcctggacagaactagacaagccccaggacatagtgcatagttaaggaagcatccttaactatcccctgggcaacttccttttctttgttctgttccccttacccagttaaaaaagttttaaactaatagccaatcgggtaaagtgtaaaatgtgaggtcctattccagccaatggaaactggacacagcagtagggtagacacatcaggttataataactctgtctccttagtttggcggggtctcgtggctggacagctattgagtagcaccctttctgcaggaagtaaagctcaccttgctgagagatcatttgttcccgcattaattcttttttttttttttttttttttgcgacaccaaaaacctcgttcccaacagtaggggtttcaccatgctgcccaaggctggtcgccaactcctgacctcaggtgatccacctgcctccccctcaagtgctgggattataggcatgagccactgctcctgtcccatgaggcggcctttgaaaaaggctttgagggatgagcaggaggtcgccaggaagagaagggaaaatatactatatctatagatctggccaaaattaaaagtctcaacgagggtgtgaggaaactgccgttctcctaccctgctggtagggagaggaatgtcttcagcctttgaggaagtaaatcagtcagtcagttggtgatgtttgctgagaaccttactgtatactgggcagacgctagggatacagcggggaaagacagagggcaggcagtaaccatgagacatgattggaaattataagtgctgtgaagtaggctgggtgtggtggctcacacctgcaatcccagcactttgggaggccaaggcgagtggatcacttaaggccaggagttcgagaccagcctgggaaacatggtgaaaccccgtctctactaaaaagacaaaattagccaggcgtggtggcgggcgcctgtaatcccagttactcaggaggctgaggcaggggaatcacttgaacctggaaggcagaggttgtagtgagccgagatcacaccaccgcactccagcctgggccacagaatgagactctgtctcaaaaaaaaaaaaaaaaaaaaagtgctgtgaagtaaacaggcaggggctgagatgggaatgaaggagggactgtgggatcaagaaacataattctttgagaacataatgtgaaataatataaataatatcaacctcaagagaaatgtagaggaatactatgaattgcagctggaatctgccctaaatgtacatttcttcttcctggtgtttgtgacaatttgagttggggttttcttttagtcacagctgaaggcatcctgatgtgctagcataaacaagatgagtgtcttgcttttgatgcttttagctactcaagccagtaaattatcattcttgtttgaactgtgtgagaggtggtcaagttcaacatttgaagggagagttgagagatactgagtgggagagagggataggaaaaacatgccttctttctgtttaggtttctaaggtgataggagataagcctggagctgctcgtggtcaccttgccaccatggggggagaacctgccagaaaatgaaactaaccaaaaaggaagctgagctaagaggagtgaccagattactgacatgtctcttaaacacctggatccatctgttcctgaaggcaaaactgttcaattacataggctaataaattccctttcttccttaaacaaacagaatactcttggctggaaatgaatctctatcttataccagaaattatttaaaaatccagatggatcaacagccgggcacggtggctcacgcctgtaatcccagcactttgggaggtcgaggcaggcagatcacgaggtcaggagattgagaccatcctggctaacacggtgaaaccccatctctactaaaaatacaaaaaattagccgggcgtggtggcaggcacctgtagtcccagctacttggggggctgaggcaggagaatggcgtgaacccaggaggtggagcttgcagtgagccgagattgcgccactgcactccagcctgggtgacagagcgagactccgtctcaaaaaaaaaaaaaaatcctgatggatcaaagttttaattgtgaaaaaaatcgtaaaagtactagaataaaatatagcagaacttttttttcataatcttcggggtgaagaaggcctttgttagcatgatagtagatccaaaaactataaaggaaaatacagatagattaaaatacctaaaaatttaaaaactctgtataacaaacataaacaaaattgaagagaaactgggagaaaatattagtcacttatataccaaagtgttaatatgcgtaatatataaggacttgccgttataaatcaatacaaaaaggcttctcaattaaaaatgggcaaaatacataaataggcaattcacagaatagaaaacatcaataaatacataaaaagataatctcacaaccaagaggacatttttacctatcagattaaaattgctttaaaaaatgactaacaccaagtatttgggaaggaagtaaagaacagagaaataggcactcatatacacttccaggagttgtgcaaattgtttcaccccttttggaggactatttagaaataactatgaaaaatttaaatgtaggtgttctgtgatcccacaagtatacttgtaggaattcattttgtacatatgtcaaataataaatatccaatgatggaaaagaaaatgaaagcaacttaaatatccattaacagggattggttaaacaaattaaagaaaccctagcatgaaatattacacagctgtgaaaaatgaagatacctatgcatgtatatatttttgtgtaatatgtacaatatgtatatattttgcattatcatgggaaagtatccacattatatcaagtgagaaaagtaacttcttaaaattatgtttgcatgtggttatgccatatataccatacatatgtgaatatatatacatataaagtcagtttcataaaaacagaaagggagatttcttatttatagaaaaagtatgaaatctttggaatgaagttttttttttgagatggattttgctctcgttgcccaggctggagtgcaatggcacaatctcagctcactgcaacctctgtctcccagcttcaagcgattctcctacctcagcctcccaagtagctgagattacaggtatgtgccaccacacccagctaattttttatttttatttttagtagagacagagttttaccatgttaatcaggctggtctcgaactcctgacctcaggtgatccacatgcctcggcctcccaaagtgctgggattacaggcatgagccaccacactcggcctggaacaaagatttacagggcactaaagatttcttcatttttgtatcatctgagttattcacaatgaatattacttcaatcatgaaagaagccacaaaagattaggagaaatacctgggcgataactttaaaatataatagcacagaagaaggctagtgagacatagccccatatattgacagacgttccagctgatacagaacttctggcaacccattggcaacatactcgaggtcacagaaatcctctccctatgaccccatgacctcactgccaggatttcacctgggaaatagttagacactcatccctttcataaaagggatgttccatactatatatatataaaagtcaaaagcggccaggtgtggtggctcacgcctgtaatcccagcactttgggaggctgaggtgggtggatcacgaggtcaggagatcgagactatcctggttaacacagtgaaaccccgtctctactaaaaatacaaaaattagccgggcgtggtggtgggtgcctgttgtcccagctactcaggaggctgaggcaggagaatggcgtgaacctgggaggcggaggttacagtgagccgagattgcaccactgcactccagcctgggtgacagtgaaactccttctcaaaaaaaaaaaaaaaaaaaaaaaaagtcaaaagctagaaacaaccaaaatgtccaacaagggactggataatatgctggctgaatatatataagctacgtgaaactgcaaaatatcaggttgttaaaggtgacttaatgatatgttaaatagctgacactcattgctataaaaatgtagtgcatccatggtccgcatgcccagccatggcaggtaggttaagttcagccctttggaaagcaatatggcaacttgtgtgagtaatcaggaaaatggctggaaccttggttcccatcattgccactgtgggaattttactttgaggaataatcaccccaaagggagagaggaagtgagcacggacatgttcattataacattatttgtaattgggataactggtgaaaaacccatgtcagtcaaaagcttaaagaagaatctaaatggagaatggatttgtaaattacaccttctcagtggcatatcattatccttaataatgataaaagtgtatggggacaatgacaatgctcatggcataatgacggcaaaaacggtctctgcattgtgattacaatgaaataaacttatatttgtttaaaagatttgaaaggaaatataaaaaataaaaacaatatgacttctaaggatggccaaattgtcagcgatggcttttatgttttcaacccaaaatttctgacaactaaacctatggatatgggatatagatttaaaaaaccataaagaggccaggtgcggtggctcacgcctgtaatcccaacattttgggaggccaaggcgggtggatcacacaggagttcaagaccagcctggccaggatggtgaaaccccatctctactaaacctacaaaaattagccaggtgtgatggcaggtgcctataatcccagctacttgggaggctgaggcaggagaatcacttgaacctgggtggcagaggttgcagtgagccgagatcacaccactgcacttcagcctgggcgacagagtgagactttgtctcaaaaaacataaagaaacacacccaagaatgactggtgagtctctctgagctgcagaattacagggaatttgtcttttatttcatacttctttacactttccaaattatcctttatgataagcatatggtatttcactaaatttttttctgttataaaaatatatggccgggcacggtggctcatgcctgtaaatcccagcactttgggagactgaggtgggtggatcacgaggtcaggagttcgagaccagcttggccaatatggtgaaaccccatctctactaaaaatagaaaaattagctgggcatggtggtgcacacctgtagtcccatctacttggggggctgaggcagaagaattgcttgaatctgggaggcggaggttgcagtgagccgagatcttgccattgcactccagcctgggtgacagagcaagactctgtctcaaaaaaaaaaaaatatatatatataattattaaatgaaaaataatactatgttttaaaaatatgactaaaagtctccccttgggaggtggggcttacagtgagccaaggtcacgccactgcactccagcctgggcaacagattgagactctgtctcaaaaaaataataacaaaataaaaaatctccccttgggcgtgaataaacagtgatgcttaacaacatgacgcttaatagaacaatcactttgtaggccgggcacgggagctcacgcctgtaatctcaacactttgggaggctgacggaggaggatcacatgaggccaggtgtttgagaccagcctggccaacatggtgtaaccccacgtctactaaaaataacaaaaattagctgggagtggtggcaggtgcctgtaatcccagcttcttgggaggctaatgtaggagaatcgcttgaacccaggaggtggaggctgcagtgagctgagatcatgccactgtactccagcctggtaacacagcaatattctgtctcaaaaaaaaaaaaaaaaaaaaaaaaaaaaataaataaataaataaaagaacagaacaatagctttgtaaagcatagatcctggaaacataataaacagaaacaataggacattaaaaatgtctataaatatgtgaaacatttatatttatatccatatttatatgaaacatatttattgtttaagccaactgcagattctgatatttgtagcttaaagtttcaaaggaaactaaaaatgttactttaaagggttaatctttatagctgtcttcccccattgaatattcaggctccagtttaagtttcttttttttttgagacggagtctcgctctgttgcccaggctggagtgcagtggcgcaatctcggttcactgcaagctccacctcccgggttcatgccattctcctgcctcagcctcctgagtagctgggactacaggcgcccaccaccacgcctggctaatttttgtatttttagtagagaaggggtttcaccttgttagccaggatggtctcgatctcctgaccttgtgatccacccacctcggcctcccaaagtgctgggattacaggtgtgagccaccgcgcccagctcaggctccagtataaggaaggatgaatcagtttaagaagcttggagagagctgttcttggtgaaggtcccagatgaaatggcatcccttttggaccactctctaactataccacgatctagggacatggcagggtggaggaaatatgcaagggaagcccccagaatgatcagaacctgtcgcagttagtgaaaaactgtgccaccttccctctagggaacaaaggaacaaaccatctcaacatatggcgccagcatccttctctggggagttcctagtgttgatgaagagcagattgctgaaaggccatttatgcacctggatccatctgttcctgaaggcaaaatttttcctagggttcctagtgttgatgaaggtgggatggaacctaacagcaggacagccagctcatcacacactcaggttgtctaatcagcatgggttctctgatgatcagcaagctgtgtgccccaagcaaaggctttctcaaaatcatcacagatgtaggcattctggccagtatgaagcctctggtgttcagtcaggtgtgaactccagctgaaaccctctccacactcctcacatgtgtagcgtttgctgccagtgtggaccttctgatgttggagaaggtgtgagatctgggtataggttctcccacagtcactacacttgtaaggcttctctccagtgtgaatcctttggtgttggattaagtggatgctctggttgaaggccttcccacattccttgcaggcgtagggcttctcgccggtgtgaatcttctgatgttgagtgagggatgagttgtgactgaaggttttcccacattccttacacttatagggcttctcgccagtgtggatcttctggtgctcaatgaggtgcgtgctctggctgaaggctttcccacactctctgccctcgtagggcctctctccagtgtgaatcctctggtgttgaatgaggtgggagatctgggtataggctttcccacacactttacattcatagggtttctcccctgtgtgaatcctctggtggtgtgtgagggaggagttctggctgaaggttttcccacactctgtacatttgtagggcttctcaccggtgtggatggtctggtgctgagtaaaggatgaggtgtggctgaaagccttcccacattcgttgcatacatagggcttttcccccacgtgagtgctctggtgcctcatgaggtgggaaatctgcgtgtaagccttcccgcactcgtgacacgcgtagggcttctcgccagtgtgaattcgctgatgctgggtcagggacgagctgtggctgaaggctttgccacaatcagtgcactcatagggtttttctccagtgtggactcgctggtgctcagtcagggatgagctgtggctgaacgttttcccacacttgttacatttgtagggtttctcccccgtgtgggtggtctggtgttgggtcagggaggaggtgtgacagaaggccttgccgcactctccacattggtagggcttctcccccgtgtggattttctggtggcgggtgaggtgggagacctgcgagtagaacttcccacactggccgcatttatagggcttctccccggtgtggcaccgctggtgtttgatgagggatgagctctgtgtgaaggccttcccgcagtccttgcctttgtagggcttctctccagtgtgaatcctctgatgctaggtaagcgaagagctctgagtgaaggtcttgccacatgcatggcaggcatagggcttctcgcctgtttggatgatgtggtgctgaatgaaatatgagctgttgctgaacgccttcccgcagtcacagcacctgtggggcttctccctggtgtgaattcgctgatggagaatatagtccgaatggtaaatgaaggctttcccacattccgtgcagttaaatggtttcttctccacgaacgtcctttggcgtttcaagctcttccagggcctgccccacttccggggcctgtctccaaagggcactcgttgcttcctgatgagggcagaggcctgccggaggcttctcccaagctcgttacacccaaggcctctctcccccgaggtgtctcccttgggagtagcaaataaacacctcaaatgcctctcctgctttcttgcatcctccgaccgatagtgacatgccaagggtttccccacctgggcatctccaagcatggcccttaaaggtccctctactggggaagctgaatcttcagaaatgctcttttttcgaggtgtctctcgaatagtcacagagcttgtctccgagtctgaaagaaatggaaaataccaataccacctgtcccaggacaaagcaagctgattacttggaagtggcagtgtaaacctaaaaaaaaaaaaaaaatttcaaactcgatgttgctactttgtttgtttctttcttcttttttctttttttttgagacaaagtcttgttctgttgcctaggctggagtgcagtggcaccatctccacctcccggattcaagcaattctcctgcctcagccccctgagttgctgggaccacaggcgcccaccaccacacctggctaatttttttgtatttttagaagagatggggtttcaccatattggtcaagctggtctcaaactcctgacctcgtgatccacccacctcggcctcccaaagtgctgggattacaggcatgagccaccgtgcttggccgatgttgctattttgaaaggcatggtgtacgtagatagattcatgttctgacatggaaggatagtctcaatacactctaaaaatgaagacaaccaagttctaaacagtttatgtacacagagttgagtagctatgctatagagtacattttttttacaaatcaataagaaaaatgatagaaaaaaatctaagaaaatagagaggcgagaatatgagtagacaattcacggaagaaaaataagaggctgataaatacatgtatagatgctgaacatcagcaatagttaaaaaaatcaaatcattaggatgctattttacccattttagattggaaaatattaaagatatccagtgttgccaagggagcatggcacagaccttctcacactatgtttgtgggaatgtgcaaggaaagagtgaacagaaggtccatctcagttttttttgtttgtttgttttttgtttttgagatagagtctcgctgtgttgcccaggctggagtgcaatggcacgatctcagctcactgcaacctccatctcctgggttcaagccattctcctgcctcagcctcccaggtagctgggagtacaggcatgcgccaccacacctggctaatttttttttttttttgtatttttagtagagctggggtttcaccatgctggccaggctggtctcgaactcctgacctcaagtcatccgcctgccttggcctcccaaagtgctgggattatagacttgagccactgcgcccagcccatctcactcagtctttgtttatctctgcagatatggcaatgacccttggccagtctctgggaactaaactcctgggatgtttacacaggtgctgggtaagatgttcttccatatgctcaagaccacgggtcaagatgtactaggctgtcagcattgttgactgtaaatatgaagatgcatgatgggcacctggtacctggattggagttctcactctgttcatgtagcaggtatgtgcatacgtgaccagctctcttcaagaactctggactataagactccaagtgggcttcctggggtggagacacctcatacatgtgtctgtggttttgcattagtggaaaaatgcacgtccatgtgacccacacagggaaagggagggctggaaacctgtgtatgacctctcttgcctttgttagttcctactgttcctgagttacaaactttgctgtaaaccgtcaatacaactcgccaagtcatgtgactccttccggaaaatcgccaaaccagtgggtggttgtgggacccccaaaacagagacatgacaactaaatgctatgtgagattcctgaaattatccttttgtcattggattaggcaatggtatcttagacatgatgtcaaaaatcacaaagcaacacaagcaaaatagatacattggacactgtcaaaattaaaacctaggccaggcacattggctcacacctgtaatcccagcactttgggaggccaaggtgggtggatcacttgagctcaggagttcatgaacagcctgggtaacatggctgaaccctgtctctaccaaacatacaagaattaggtagcgatggtacacgcctgtggtcccagctacttggaaggctgaggtgggaggatcaacaaagccccggaagttgaggctgcagtgagccatgattgcgccactgcactccagcctgggtgagaccctgtctcaaaaataataataattaaaaatttaaacctttgtgcttcaaagacactagtaagaagcaaaaagacaactaatagaatgggagaaaattttttccaatcatatgtctgataaagaacttgtttctagaatacataaagcatacttacaactcagtattttggtttttgagacggagtctcgctctgtcacccaggctggagtgcagtggcacgatcccgggtcactgcaacctccgcctcccaggttcaagtgattctcctgcctcaacctcccaagtagctgggactgcaggcacgcaccaccaggcccagctaatttttctatatttagtagagacagggtttcaccgtgttggccaggatggtctcgatctcttgacctcatgatccacccacctcagtctcccaaagtgctgggattacaggtgtgagctaccacacctggccacaactcaatatttttaaaaactcaattaaaaaagggcaaagttctcaatagtcatttctttaaagatatacaaatggccaataagtacatgaaaagatactcaacatcattagacatcaaggaaaatgaaatgaaaatcatgagattccacttcacactcactagttatataataaaaaagacagatagtaacaagcgttggtgaggatgcggagaaatcagagccctcacacactgctggtgggaatgtaacatggtacagccactttggaaaatagtctggcagtttctcaaaaggttaaacatagaattaccctatgattcaacaattccattcctaggtatctacccgaaataaatgaaaacatacattcacacaaaaacttgtgcatgaatgttcatagcagtatgattcataatagccaaaaagaagacataactcaatgttcaccaactgatgaataaaccaactgtggtacattcatacaacaaaatagtattcagccataaacaggaatgaagctctcatacatactgcaatgtgaatgactcttaaaaatattatgctaggctgggcgtggtggctcacgcctgtaatcccagcactttgggaggctgggcgggggtgggggggtggatcacgaggtctggagttcgagaccagcctggccaccatggtgaaattctgcctctactaaaaatacaaaaattagccaggtgtggtggcaggtgcccatacccagctacttgggaggctgaggcaggagaatcacttgaacccgagaggcggagcctgcagtgagccaagatcgtgccactgcactccagcttgggtgacagagcgagactccgtctcaaaaaataaataaaaaaataaaaaataaataaaaataaatgaataaaaagaaatgatgagcagaaagcaaaaccatctggaatttgtggagggaatggatttttttttggagctagtgggtttgttcatggaatgtccattaattacatatgtgccaaccacggtgctgtgagtaggtgaccttttgctaaacaagatatctggttcttgtcctcagagaggggggagaggcaggcttatattcagacattttggacatatcctacttatctctttagcatccctgtctttgaacaaccactgctccccttttcctatagtcttggtggggctgtcacatatctccccaacccccacctcagcaatgggcatcagacttccgactggccaatcataataccccgttcctcgggccataataattggttcatcatccaaagggacccagtcagagtcttccccgagatgagtatatggggttattaggcagaatataagtttgagactgtgggtagccacgttgattgctacttggaaaggtctgtagacaaaacgaagctagaaacagacagaatcaacacatgtggaaagcgaaggagggggaaggtgggggttgtggggagagagagagagagagagaacaagtaagccctgacaataccatttaaggccttagattcatgtatgccgaaagtcttgcactgcaatacttcctagttatatgggtcaaaaaaaatctaatttttcttaagctattttgattctttacatgtgggagtcctgatatatcagataataacaattattattattgcaatagagaacattcattaaatgctgactacctgccagatactgttctgagcttgttccgtgtattaagtaatttcatcatccaaacatttcattgaggtgggtactattattctccctatttaataggtaaggacggccgggcgcagtggctcacgcctgtaatcccagcactttgggaggctggggcgggtggatcatgaggtcaggagttcgagaccagcctggccaacatgatgaaaccctgtctctactaaaaatacaaaaaattagccaggcacggtggggggcacctataatcccagctactctggaggctgagacaggagaatcacttgaactcgagaggcggaggttgcagtgagtccaggttcaccactgtactctagcctgggcgacagagcaagactccatctcaaaaaaaaaaaaaaggtaaggaaatggaggcaccaatagattaagtcacttgcccacaatcacgcagtgggagaaaggggatttgaactcagagtctacactcttaagtacaacatgcacaagtgcagtaatagcaccttgagctaggagctgtgaaaacgctgagaagcggtggcctagttatcacggaaggccacttggaggaggtgacctgtaagcttcatcgtgaaacacatgaaggtgcttgccaggcagaaaaagcagggaagggtattccagacagagggaacagcatgtgtgaaggcccaaaggtggcaacacacattcaggttgaggtacggacaggtgcttcagtgaggtcagggcatggtgtacaatcaggggtggatggtgaagatgaggccagagaaagcacaggctgagtgacacagggcaccgagtgccaggctgaggggctgggacttcatcttgggggtactggggaagcaggggagggtgtgagcaggggagggagggggttagctctcagtatggaaggatcccctggggcggtgtcaactggaggggtaagtctgggggccaggaggctggggtgagggtccaggggagagaagctgaggcctggccaggggcaggagggacaaggctggggactgatgggctgtgacgggacaaggggagggtcgggtgagaattataacgatgacagccattgaagccactaccgactctgtgccaagctctgggctctgctctgtatctgttaattcatttattcctcccaatcctagacactcatgtcacctccttttcacagatgaaaaaaatcaaagcacagagaggctaagtgacttgcccaaggccacacagccaggaagcaatcagctgggatttgaacccacacaacccgactcccgagcccacgatgatcacccgtgtgttccactgcctcacccctgagtgaacctcactgaccatgagagatggggtaggaagagggctcacacctgctggatatcctcacccacctgggcaggtaactcgccgggcctctctctcctgcctcagctcttcccctcgatccacacgggagatcacgtcggatttggacccaggcagccctgcccctggggaaagatacaagagttggctgtgggtgccagaatcacagggaggtctacagggaaggtgcacgcactgagcgcctaatgattggacgtacaaatggccaacgccaagacttatttgttgtgtgcttagcacactgcagagaggctgagccaacttatttgttgagtgcttaggacactgcagagaggctgagctctgacaaagctgtttaaggctccgcgtctgtgctgttcgagttaactgcactgtgacagtataagaaacatcgtcttctgtgtttcgaagacttactaaagaaaaaaacagtaaaatctctcaatcatttgttaattgattattatttcagtgtgtcaagatgataagattttagatagcttgaggtgaataaaatgtattattaaaattaa

SEQ ID NO: 396 - DNA, 9327 bp, Homo sapiens
  source 1..9327: mol_type = genomic DNA
gaagcacacaggaaaaggagcttagctgctggtaagttggggactgacaatttaaaatttatcaatggaactcctgctctctgacaaacacctcctaaattctagagcagtgctgtaatggagcatccacttgccacaggtggcttttgagtgcctatgtttctatcttgatctgaaatgtgcttaagtgtaaaatatacttagtgtagtttaatcattagtatgatcaaaataatacaatttatctcgttaataactttcattttggtaacgtgttccaatgattttttttatttgcggggttaaatgaaacatattattataattaatttctcccaatgattttacttttttaacatggctactagaaagttgtaagtcacgtgtgtggctggcatttagggcttgcattaccctgtctctactaaaaatgcaaacaacaaactagccaggcgtagtggtgggagcctgtaatcccagctactcaggaggctgaggcaggagaatcgcttgaacctaggaggccgaggttgcagtgagccgatatcgtgccattgcactccagcctgggcaagaagagtgaaactctaactcaaagataaataaacatgtgaaggagccaagtgtgaggagcttaagaggaagagcatggtaggcagaaggaacagagaaggcagaagccccgagatgacaatgagctgcatgttcaaggaatcagagcccgttatgggtggagcccagtgtgtcccacgagagtgcagagatgaggtctgaggaatgcacagggcaggtccaggggtacttgagggaacttaagataaggataagttagaagtttggaagccattagaaggtgttgaaaatagcatcaccattttattggaccttttttttttttttttttgagacagaatcttgctctgtcgcccaggctgaagtgcagtggcgcagtctcggctcactgcaaactctgcctctcagggtcaagcgattctcctgcctcagcctcccaagtagctgggattacaggcacccgccatcacgcccagctaatttttgtgtttttttagtagagacggggtttcatcatgttgggcaggttggtcttgaactcctgacctcaggtgatccacccacctcagcctcccaaagtgctgggattacaggcatgagccactcccggcccttattggactttttttttttttttgagacagagttttgctcttgttgcccaggctggagtgcaatggcacgatctcagctcactgcaacctccgcctccctggttcaagcgattctcctgcgtcagcctcccgagcatctggaattacaggcacgtgccaccacgcccagctaattttgtatttttagtagagatggggtttcttcatgttggccaggttggtctcgaactcctgacctctggtgacccacctgcctcggcctcccaaagtgctgggattacaggtgtgagccactgcacctggcccttattgaactttttaaaagctcatttggtttccttctggagattggattgtagggcaggggaaagtaggaccaggaacaacctatttgcaaagttggcgcaaacattcctgcctgacaggaccatggacacaggttgtagagatagagatggctctggctgtgcattcagcagattctgtagatagaattaataggacttggatgggattgtggtgagagaaagtgaaatgaaagataagttctagtttggaagttttaacaactgaatgtttaaactcaaatagacacaaaatattggaagagtggcaggtttgggaggatgagacaatcaactgtttggttgagccacgttaggtttgaaatgtctacgggactcccgtggggagaggttatatcagactggagcaccagagagaggccaaggctgatagtttagatgaaaagagagcatgatattttaagccctgagactggataatatcacctatagaaagactatatagagataagagaggtggggaacaagtaaaagctgcgggacactcctaaatttagagtcaaatttagagcagaaaatactagcaaaggggactgaaaagcggtggccaattgagcttcaaatgcaagtgaaagtgtgttgtgtgtacatttatcatctcatggcacaggaaaaacgtgatttaaggagaaggaagcgatccaatgggaagaagagatccaatggatcctctatcacgaagatattgagataagaaccaatatggatttgcacccactgcatttgcagccttgaggtcataagcatcctcaggaaaatgcaccaggtcagtgctaaggactggagtcaatacagactggattcaggagaaaaagtgaggcagggaatcaaagggagcaaacacagaaaactccttccaaaatctggctgcaaattcttttcatagaaagaattctctcaggagaaatagggttaacaccagaaaggaatatagtccaagatctttttggttgttttttgttttgttttttggggtggtttttattttgtttttgtttagttttgttgttgtttgtttgtttgtttttgagacggagtcactgttgcccaggctggagtgcagtggtgcgatctcagctcactgcaacctccgccttccggtgttcaagaggtcttcctgcctcagcttcccaagtagctgggattgcaagcgcgtgccatcacgtccagctaatttttgtatttttagtagagatgaggtttcaccatgttggccagtctggtctcaaactcctggcctcaagtgatccacttgcctcagcttccctaaatgttgggattacaggtgtgagccacggcacctggccaaggatggtttctttttaaagggaggggatatgatttatgtaatgtttatgtaatagtgagaatgatctagtagaaataaaatcttgagggtttgtttttggcagaaaatggaaggacaaatgcagggggaaagtttgtgggaagatgagagggcatcctgggccaatgcagggagggaaattattggaaagaacaagaagtctttattcacagtgacagaggcaggtagactgagggtcaggggaggaccggctgaaaatttcacatctagttattaccattttctcattataatgtcagtcaagggcatctgctgagagtgggaaaaacagagtaaatgaggtactttttggagaaagcaggactgaaataattaaggtgtgggatagcgagtgcgctggagaagtagagtaacctaatgaggaactgctgagttttcatttgaaatctgtggtcataaattcaattgcaaccctcgataattgtgaaagtcacttccgctctctgagccgtactttcctacctgttacacaaggacagcacttgtcccaaagcaagggtattgtaatcagagatgataaaatatatagtgactggcacatattaaggactcaccaaatagcagacctcataatcagtacaggtatcatctgtggttcgcagttctcctccttacattacaactagggtggacccaaaactttgcaatttttgccttgttaatttgtcctcacctgtcattgcacaatcatccttccttgttgcatcaacatttttttttttctgagacagagtctcgctctttcacccaggctggagtgctgtggcacgatcttggctcactgcaacctctgcctcccagactcaagtgattctcctgcctcagcctcccaagtaactgggattacaggcacccaccaccatgcccagctaatttttgtatttttagtagagacagggtttcaccatgttggccaggctggtttcaaattcctggcctcaagtgatccacctgtcttggcctcccaaagtgctaggattacaggcgtgagccactgcgcccagcctgtatcaacattttaaaatgaatttgaaattatggatagatcatgtcttctaagtgtcttgtagaatgtttggagtgtggatagagaaaatctgagtctgttgaggaactatggggtggaaaagggttaacagcacaattctgttgtaatcaatctggctgagctccaattctgtctctactctttctacctggtaacgttgaacaattaacgcagcccatctaagtcttaacttcctcatctgtacaatggttatactaattatcaggctgctgcaaaagtacttgtggtttttgatattattttcaatggcaaaaacagcgttacttttgcaccaacctaatatcactaagattaatcaatattcactgtgtctcaggagtgctcagtgttcacacatattaacacagcccatccacagatcctgtgagaggcgttgatagggttaaaggaaaagctcttggtgtgtgggtaatgttcataagtagaaacaactattgctatgagcatcgttcttgtcctgaccttgaacttcataatggattgagccccacgacacagcacacagcctggtgagggccaagagttcccatttgtcatagatatactcagtctagcctaaaagatttccacatctattctcacttaatcctcacctgaaagttagacttcaccataaaattgtcctcgttctgcagagcagaaaactgaggctcaaagagatatcactgactaaaaactcatagtgaggagacatcacagatgagattagaagagagatgtagctgacttcagagcccagtatatatatatattttagacagagtctcgctctgtcccccaggctggagtgcagtggcacggctcactgcaacctccgcctcccgggttcaagcgattctcctgcctcagcctcccgagtagctgggactgcaagtgcatgccaccaggcccggctaattttttgtattttcggtagagacggggcttcaccgtattgcccagggtggtctggaactcctgacctcaggcaatccaccccccttggcctcccaaagtgttgggattacaggcgtgagccaccgtatctggctgagcccagtattctttgtaacagtgactctcaattgggggtgactttgcctccgaggggacctttgacaatgtttatggaacctgttgattgtcatttctggagaaggagttgctactggtgtctgtggatagaggccaggggggctgctcaacatcctactgtgtccagaacagtctgccacaacgaagaattacccagacccagatgtcaaaggtgccaaggttgagaaaccctgagctacattaaataacgtcccatggaatacctcagtgaaactcactggtaatagcaggaagaaaaggaggaaataaggaaaaggaagaaggctaaaaatcaccagactgaggcatagccctatcctagtaatcttgggggaatccctttcaaaggcaggacttccgtatgcaaaggcagtggctctggagttgttcatctcggtttccgtatcttgctgcctccactgactggctgggcatgatgttgaaaaaaactacagaagtccccgggccatgaattcccccagatgtgatggctgtttcccaatgttattatgagcattagatgtgaacaagtgctatggaattgctatttctcttaaagatgctgaatagcccagtctgagatgattctcaaattctcatggccatagcaaatcatcctggcttttacacatacagattctagaatgagatttatggatataattgtttttcatttttattataagttcaggggtatatgtgcaggtttgttatacaggtaaacttgtatcctggtgttttcttgtacagattatttcatcactgagatattaagcctaatacccactacttatttttcctgatcctgtccctcccctcaccctccaccttccggtaggccccagtgttcccctctttgtgtccatgtgttctcatcatttacctcccatttgtaaatgagaacatgtggtatttggttttctgttcctgcattagtttgctaaggataatgaatacaattttaacaggcagcctggatgtttctgataaagtccacagaccacggcataagaaaatgtgctcaggtgacgtgggactttgtgttgaactggatacaaatattacagatgtgatccggaccagaggcagggactacatgttttgggtttttgttcttaaaagaaaaaaacaaaaacaaaaaaacttgatctgagaagctctgaagggtcatattcttacaatgttattgtccacaatttagtcacgtgtccactaccaaagcaatcccttgcaaagtaaaagggattctggttagtgctaattagactagtcaggatttactcccaacatggagaaaagacaccttctctgcagggtgagtaactaaacacaattgtggtttttcaagcagagaagaatggggaaccgttgctgggtgggcaaccagcaatatctgtcaagcgtaagggtttagaagtcagaccatgccaaactgaagtcctgaatctattatctactacctaagtgaccttcaacacatttcacaattgccctgagctttcatttattctaatgaaaactagaagtaatgaatattacatagctattacataggccaaaccggatcccatatgtagtaattaacacaatgcatagtctctaataagaacttcacaagtattaatacaacttattattcttatagtctttatcccacagacaccaaagctatacaaatcggcactgattatttgcattccaaacagagaagagctccacatcaagcagggacagggaaaagcagagggtagaaagcagagatggaactctctttgctgacttcctctagtgcagaatcctcaggatataacatactactacatgttaccagtgactcctcaaaattctcttcaacaataacctcaagccaaaccctcaaactttatcttgagtactagccaagcaataggtcaagggttctcacagtttgagggacaggagttgggagactggaagaacctggggctgaaagagattgcagagcttgccagcatgtttgcattgaatggtgggagacacagatgtgagccttctgattctgagtcatgtgccttcctcacaatgctgaggctgcctatgctcaattttccattgtccatacaacataagttcagtatgagccttgtaatcctcttggtgaagtgatcagcccgataagcgaaatgcatattgataatgatgggaatatggaggactatcccttcccaaaggagcatccaagagaatgccaattctatagcaccgttgtcaacaaggcttggtagatagagtgggtctcctggtaggagtgggagctttagtggaagttgatgtgagctataaatacagatgctgtaagatggttccacagctgagaaatggccattgttggaatgtttcaggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataaggggaagactttaaagtataaagtaaaatgtttgctgtaggttttttatagctattaaaaaaaatcagattatggaagttttcttctatttttagtttgctaagagttttctgtttctttttcttacatcatgagtggactttgcattttatcaaatgcattttctacatgtattaagatggtcatattattcttcttcttttatgtaaatcattataaataatgttcattaagttctgaatgttaaactactcttgaattcctggaataaaccacacttagtcctgatgtactttaaatatttatatctcacaggagttggttagaatttctgtgtttatgtttatatactgttatttcactttttctactatccttgctaagttttcatagaaaataaggaacaaagagaaacttgtaatggtctctgaaaaggaattgagaagtaattcctctgattctgttttctggtgttatatctttattaaatattcagaaaaattcaccagtgaa

SEQ ID NO: 397 - DNA, 7138 bp, Homo sapiens
  source 1..7138: mol_type = genomic DNA
cgatccaatgggaagaagagatccaatggatcctctatcacgaagatattgagataagaaccaatatggatttgcacccactgcatttgcagccttgaggtcataagcatcctcaggaaaatgcaccaggtcagtgctaaggactggagtcaatacagactggattcaggagaaaaagtgaggcagggaatcaaagggagcaaacacagaaaactccttccaaaatctggctgcaaattcttttcatagaaagaattctctcaggagaaatagggttaacaccagaaaggaatatagtccaagatctttttggttgttttttgttttgttttttggggtggtttttattttgtttttgtttagttttgttgttgtttgtttgtttgtttttgagacggagtcactgttgcccaggctggagtgcagtggtgcgatctcagctcactgcaacctccgccttccggtgttcaagaggtcttcctgcctcagcttcccaagtagctgggattgcaagcgcgtgccatcacgtccagctaatttttgtatttttagtagagatgaggtttcaccatgttggccagtctggtctcaaactcctggcctcaagtgatccacttgcctcagcttccctaaatgttgggattacaggtgtgagccacggcacctggccaaggatggtttctttttaaagggaggggatatgatttatgtaatgtttatgtaatagtgagaatgatctagtagaaataaaatcttgagggtttgtttttggcagaaaatggaaggacaaatgcagggggaaagtttgtgggaagatgagagggcatcctgggccaatgcagggagggaaattattggaaagaacaagaagtctttattcacagtgacagaggcaggtagactgagggtcaggggaggaccggctgaaaatttcacatctagttattaccattttctcattataatgtcagtcaagggcatctgctgagagtgggaaaaacagagtaaatgaggtactttttggagaaagcaggactgaaataattaaggtgtgggatagcgagtgcgctggagaagtagagtaacctaatgaggaactgctgagttttcatttgaaatctgtggtcataaattcaattgcaaccctcgataattgtgaaagtcacttccgctctctgagccgtactttcctacctgttacacaaggacagcacttgtcccaaagcaagggtattgtaatcagagatgataaaatatatagtgactggcacatattaaggactcaccaaatagcagacctcataatcagtacaggtatcatctgtggttcgcagttctcctccttacattacaactagggtggacccaaaactttgcaatttttgccttgttaatttgtcctcacctgtcattgcacaatcatccttccttgttgcatcaacatttttttttttctgagacagagtctcgctctttcacccaggctggagtgctgtggcacgatcttggctcactgcaacctctgcctcccagactcaagtgattctcctgcctcagcctcccaagtaactgggattacaggcacccaccaccatgcccagctaatttttgtatttttagtagagacagggtttcaccatgttggccaggctggtttcaaattcctggcctcaagtgatccacctgtcttggcctcccaaagtgctaggattacaggcgtgagccactgcgcccagcctgtatcaacattttaaaatgaatttgaaattatggatagatcatgtcttctaagtgtcttgtagaatgtttggagtgtggatagagaaaatctgagtctgttgaggaactatggggtggaaaagggttaacagcacaattctgttgtaatcaatctggctgagctccaattctgtctctactctttctacctggtaacgttgaacaattaacgcagcccatctaagtcttaacttcctcatctgtacaatggttatactaattatcaggctgctgcaaaagtacttgtggtttttgatattattttcaatggcaaaaacagcgttacttttgcaccaacctaatatcactaagattaatcaatattcactgtgtctcaggagtgctcagtgttcacacatattaacacagcccatccacagatcctgtgagaggcgttgatagggttaaaggaaaagctcttggtgtgtgggtaatgttcataagtagaaacaactattgctatgagcatcgttcttgtcctgaccttgaacttcataatggattgagccccacgacacagcacacagcctggtgagggccaagagttcccatttgtcatagatatactcagtctagcctaaaagatttccacatctattctcacttaatcctcacctgaaagttagacttcaccataaaattgtcctcgttctgcagagcagaaaactgaggctcaaagagatatcactgactaaaaactcatagtgaggagacatcacagatgagattagaagagagatgtagctgacttcagagcccagtatatatatatattttagacagagtctcgctctgtcccccaggctggagtgcagtggcacggctcactgcaacctccgcctcccgggttcaagcgattctcctgcctcagcctcccgagtagctgggactgcaagtgcatgccaccaggcccggctaattttttgtattttcggtagagacggggcttcaccgtattgcccagggtggtctggaactcctgacctcaggcaatccaccccccttggcctcccaaagtgttgggattacaggcgtgagccaccgtatctggctgagcccagtattctttgtaacagtgactctcaattgggggtgactttgcctccgaggggacctttgacaatgtttatggaacctgttgattgtcatttctggagaaggagttgctactggtgtctgtggatagaggccaggggggctgctcaacatcctactgtgtccagaacagtctgccacaacgaagaattacccagacccagatgtcaaaggtgccaaggttgagaaaccctgagctacattaaataacgtcccatggaatacctcagtgaaactcactggtaatagcaggaagaaaaggaggaaataaggaaaaggaagaaggctaaaaatcaccagactgaggcatagccctatcctagtaatcttgggggaatccctttcaaaggcaggacttccgtatgcaaaggcagtggctctggagttgttcatctcggtttccgtatcttgctgcctccactgactggctgggcatgatgttgaaaaaaactacagaagtccccgggccatgaattcccccagatgtgatggctgtttcccaatgttattatgagcattagatgtgaacaagtgctatggaattgctatttctcttaaagatgctgaatagcccagtctgagatgattctcaaattctcatggccatagcaaatcatcctggcttttacacatacagattctagaatgagatttatggatataattgtttttcatttttattataagttcaggggtatatgtgcaggtttgttatacaggtaaacttgtatcctggtgttttcttgtacagattatttcatcactgagatattaagcctaatacccactacttatttttcctgatcctgtccctcccctcaccctccaccttccggtaggccccagtgttcccctctttgtgtccatgtgttctcatcatttacctcccatttgtaaatgagaacatgtggtatttggttttctgttcctgcattagtttgctaaggataatgaatacaattttaacaggcagcctggatgtttctgataaagtccacagaccacggcataagaaaatgtgctcaggtgacgtgggactttgtgttgaactggatacaaatattacagatgtgatccggaccagaggcagggactacatgttttgggtttttgttcttaaaagaaaaaaacaaaaacaaaaaaacttgatctgagaagctctgaagggtcatattcttacaatgttattgtccacaatttagtcacgtgtccactaccaaagcaatcccttgcaaagtaaaagggattctggttagtgctaattagactagtcaggatttactcccaacatggagaaaagacaccttctctgcagggtgagtaactaaacacaattgtggtttttcaagcagagaagaatggggaaccgttgctgggtgggcaaccagcaatatctgtcaagcgtaagggtttagaagtcagaccatgccaaactgaagtcctgaatctattatctactacctaagtgaccttcaacacatttcacaattgccctgagctttcatttattctaatgaaaactagaagtaatgaatattacatagctattacataggccaaaccggatcccatatgtagtaattaacacaatgcatagtctctaataagaacttcacaagtattaatacaacttattattcttatagtctttatcccacagacaccaaagctatacaaatcggcactgattatttgcattccaaacagagaagagctccacatcaagcagggacagggaaaagcagagggtagaaagcagagatggaactctctttgctgacttcctctagtgcagaatcctcaggatataacatactactacatgttaccagtgactcctcaaaattctcttcaacaataacctcaagccaaaccctcaaactttatcttgagtactagccaagcaataggtcaagggttctcacagtttgagggacaggagttgggagactggaagaacctggggctgaaagagattgcagagcttgccagcatgtttgcattgaatggtgggagacacagatgtgagccttctgattctgagtcatgtgccttcctcacaatgctgaggctgcctatgctcaattttccattgtccatacaacataagttcagtatgagccttgtaatcctcttggtgaagtgatcagcccgataagcgaaatgcatattgataatgatgggaatatggaggactatcccttcccaaaggagcatccaagagaatgccaattctatagcaccgttgtcaacaaggcttggtagatagagtgggtctcctggtaggagtgggagctttagtggaagttgatgtgagctataaatacagatgctgtaagatggttccacagctgagaaatggccattgttggaatgtttcaggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataaggggaagactttaaagtataaagtaaaatgtttgctgtaggttttttatagctattaaaaaaaatcagattatggaagttttcttctatttttagtttgctaagagttttctgtttctttttcttacatcatgagtggactttgcattttatcaaatgcattttctacatgtattaagatggtcatattattcttcttcttttatgtaaatcattataaataatgttcattaagttctgaatgttaaactactcttgaattcctggaataaaccacacttagtcctgatgtactttaaatatttatatctcacaggagttggttagaatttctgtgtttatgtttatatactgttatttcactttttctactatccttgctaagttttcatagaaaataaggaacaaagagaaacttgtaatggtctctgaaaaggaattgagaagtaattcctctgattctgttttctggtgttatatctttattaaatattcagaaaaattcaccagtgaa

SEQ ID NO: 398 - DNA, 30924 bp, Homo sapiens
  source 1..30924: mol_type = genomic DNA
aaaacactcattttgttttatagcatgacaggctgtctgattccatctttataaccaaagccaattaagatcttaaaaccaaacatataacttcatctttttacaagtacttagagcctgagttgctccacaggaatccaggaactgggcacaggaaaaggatctaagctggtggtaagttggggtctgaaaattttaaagttattgttgaaatgcctgctatatgacagagcccttctaactctggagtagcgtagtccagtgaagaatccacttcgttagtatgaaaacaatgttaactatttcattaacagtgtttaatttggttacatgttccagtaacattctttttttttttttttttttttttttttttgatggagtcttgcgctgtcacccaggctggagtgcagtggcacaatctcagcccactgcaacctctgcctcccaggttcaagcgattctcctgcctcagcctcctgagtagctgggattacaggcacctgccaccacgcctggctaattttttgtatttttagtagagacggggtttcaatatgttggccaggctggtcttcaactcctgacctcgtgatctgcccacctcggcctcccaaagtgctgggattacaggcgtgagccaatgtgactggccaattctttatcatatatgtaattaaataaaatttattactaaaataatttccccaaaggtgttttacttttttaaaaacagtggctacaaaaaaattttgagtcccatatgtagctaaagttaacacattatatttctactggacatgtagcattgtagagatgtagcattgaaggatcttgatagtcctgtggagcttacgtactagtgtggagggtatttaagagagaagataaatgaacaaacaaataaaggagaaaagtatctggtgagataggctgtacctgagcattctgctttgcagagtgggtgaggtgggatctctctgaaataatatttgacctgaaatatgaatattcaggatgagccaggtgcaggaagctcaagacgaagagcacggtaggcagaaggaatagagaaagcagaagccctgagatgacaaagagctgcaagttcaaggaattagagcccagtgggtggagcccagtgtgtctgatgagagtgcagagatgaggtctgagggatgcacagggcacatgtggcagtggataagggaacctaggataagggaacctaagataagggtaacttagaagtctggaagccatcggaaggtattgcgaataacatcaccatcttattggacctttttaaagctcatttggtttctgtctggagaatggatcttaggggagggggcagcaggaccaggaaaaagctatttgcaaggcttgtgcaaatatccaagcctgacagggccatggacaccggtcgtggagatggcaatggctctggctgtgcattcagcatgttctgtagatagaatgagtaagacgtggatggcgttgggtggtgaggaaaagagaaatgaaaggtgagttctagatctggagctttaacaactgaatatttaatctccaaatagatacagaatattggaagagtggcaggtctgggaggcagagaacatcaacagtttggtaaaaccatgtgaggtttggagtctatgggactcccacggggagaggttttatcagacttgagtgccagggagaggccacggctgataatttagatgaaaagacagcataatggtttaatcccagagactggatgatatcatttatagaatgtgagataccccaacatttagagtcaaatttagaatagaaaacaccgtaaattggactaaaaagaggaagagaatcgagctgtagagacgaccaagagtgtattgtgtgcacatatctcttggatatatctcatggcataggaaaaatgtgtttgaaaagggagaaagtgatccaatgggtcctgtgtcattgggatatcaggtcttaaaaactgagaaggactcactggatttggcagcctgggggtcataagcatccttgggaaaatgcattaggtggagtgctaaggacagaagtcaatgtggagtggattaaggagaacagctgaggcgaagaaggaaaaggaagaattagagacattctctttggatgtttggctggaaattctgtcttacagacagaccttacagagaggtcatttggctagatagggttgaagctggaaagaaatatgcttcaaaggaggtttctcttgaaagagagggggcgtgattatgtgatagaatgatctagtagaaatacaattttcaatttttttggtataaaaaatgatcttttatccctcaccacatcccacctcaatctaagtcttaactttctcgtctgtacaatggttatacaaattaaaactaacattaatcaatattcaccgtgtctcagggtgtgttgagtgcttacacatattaacacatcccatccacagagcctatgagaggagttgtgagggttaagggagaagctcttggtgtgtggataatgttcataagtagaagctactattgctataagcatcgttcttgtcctgaccctgagcttcatagtgcagggttcgggattgtaccccacaacacaacacacagcctggtgagggctaagagttctaatttgttacagatttaccgacctatcctagatgatttccatgtctattctttttttttttttttttttttttgagacggagtctcgctctgttgccaagctggagtgtagtggtgcaatctcagctcactgcaacctctgcctcctgggttcaagcgattcccccacctcagcctccagtccatgtctattctatttaatcctcccctgaaaatcagtctttatcaaaaaaccatttcagttctgcagaggggaaaatgggggctcaaagagatgtcactgatcaagaatttacaccatcgaggtgtcagagataagatcagagtagagatctaactgactccaaagcctggtactctttacactgttacagtgacacccaactggcagggggagggggtgggaggtattttgcctcccaggggatctttgacaatgtcttttggttgtcactcctgaatggggagttgctactggcatctctggatagcggccaggggtgccgctaaacatcctactgtgtacagaacagtccaccacaacaaagaattaaccagcccaaaatgccattggtgtcaaagctgagaaaccctgagctacactaaacaatgtccctgggaagacctcagtgaaagtgactgataatgataggaaaaaagaaggaaatgagtaaaagaaataggagaaaaaatttattatacgagggcaggaccctatcctggtaattttggaagaacgcctttcaatggcagcacttgagcgtgcaaaggtagtggctctgttcggtctggtttacaaatcttcctgtctccactgactggctaggtatgatgctgaaaaaactacaggagtccctgggccatggattctccctagtaaaaaagggatgatgatggctgcctcacagtgttattatgagtattagatgtaaacaagtgctacataattgctatcattcttaaagaggctaaatagcccagggtgggaagattctcagattttcatgatcatagaaaattgctgtagcttggctgggcgtggtggctcacacctgtaatcccagcactttgggaggccgaggagttcgagacagcctggccaacatggtgaaaccccatctctactaaaaatacaaaaaattagccgggcgtggtggtggtgcccagctactggggaggctgaggcagaagaattacttgaacccaggaggcgaaggttgcagtgagccgagatcacaccgctgcagtccagctgggtgacagaggaaaaaagggaaccattcggacatttgcccctgaacttgaagtgcgccacaccccactcccactgccagttgccacccccgtcagctctctttctgcctgtcctcttgctcctctgagtgtggcctccagatgtctcatgtacctcccggggtctgtgaatactaaaacctctcgaactttaacactgtcgtcgcctcattgaagccgcacccacaatccaacccacgatgtgaggctgcccgaaagcgacctgggcagttggatcccctcttgatgttcttttgtcctgacctctggtggctgctgaggatggtcactagcagctgagttgatagagaaacttgaagagcttcatttaatactactggcatagcaggcaggcttttggctgtgtcttggacacaatcccaatgtctgtgtgtgtggatgactcacgcacttcctgcatcagacagcccagtcggtctggcccagacggcactactgcttgctggtgctccattttgctgcttcgtgcagcttagtactgctgtcctcagcagttaacttggagattctccagaaattccagtgaccgtggacggctctttgaggctccaggctccccagcagctgcaggagggcagatcctattgtaatgagggtgtttccctgtgggacatcagaaaccctttctgggatcaggcccctgacagggggccactactggagggcatgttgccccttgagccatacatgcttctctggtgacctagggcctcggtagtggtccggcctgtattggctctaagtagcaaagtactggcctccagccagagagagctggccaggatgctgagctggccacccggtagcccatggctcgatcctcagctctacctccatcttgctgatgatagggccatgggccaccaggctcctggggagcagcgattccaccatagtgaagttgaagaggatgacagaatgctggcttcagtgtgtcagtgaaggggagctgggtgaaagggtccagtcgcctaactctaacctgtgacacggcaactgcacctgagtccccagggcaccttgcaagagccggtgctgctgaggccagtgcctccttggttgctgcattccttggtgctatcacttctcgttctcccagcccctcagaggtcgatcgggtcaccctggaaagaaaagcggctgcctacaaggccagtgcaagtggagctcattgttcggttttgaagagaaagtgagattaaagaaagacacacaaagacagagtgtctcaacagcaaatgcaggcatttatgtccagtataaacctgcagaggtgccagtgcccaccactgcttacaggctggggcaattacaggcctgggtgggagaggtctggaagtggagcatggcccgttgcctgggaaaatgttgataacatgttcccatgatgaggcggtttggcacttgttcctgcagaatgtgatagtgatgttccttgggcctttgcccggcagagtgtgataaggatgttcgtgtgccttgtggtcaggtggttgggcaggatgtttctcatggcccgaaaccccatggaatgtttcactttgaccaaagtctgcaaaatggtggggggcttacaaagtggtgcagtttggactaactctcaataccatttttttttcttttttggtaacaatgtgtaaagtgaaaacagcagagtgctactccataccactgggatcttgtccagtaaacatccagagagtgaggttaggaaataaaaagtatataaatattagatgcctagaaatgcaagtcactttaaagattttatgtgaaatagaaaaaaaagagaggagagggactcattgtcttgtaatgggtccttcccagagagaggtgactgtccagtggcaccgggcccttttcctccttccccttttactcttatcaactaggacagaaactaagaattttggcttcaagtggctaaaagactgatgggggaaaaaagaaaatagaaaaaaataacagagagactgacgctctaggcagttacaagtccaagaaaaaagacagaaacttttaactttaagtattgagccaaaaccaggtctagcaaacataatgctggccctagattatttattaatttatgaagaaacttctagatatgggggtgacaaaaggaaattaaatccattatatatgcatatattttaatgtaaatatataatagataaattatgtatacataatatagaaccaaattgaaacagttttacaatttggtttgactggaaattcaaaatccatatattaatttttgtagtaaaagtttatgtaaaaaaagacaaaaaggacactgattggcttttgttcctctacaatataggttctaacttaacttctaacattagcggccggacgcggtggctcacgcccgtaatcccagcactttaggaggccgaagtgggcagatcacctgaggtcaagagttcgagatcagcctggccaacatggtgaaaccccatctctactaaaagtacagaaattaaccgggcgtgatgctgggtgcctgtaatcccagctactcaggaggctgaggcaggacaattgcttgaacctgggaggtggaggttgcagtgagccgagattgtgctactgcactccagctgcacgaattgacaaaatttatggacttcatagtgggattcaaattatagttatacatagggatctcattaaatttacttactctactcccataatcttgagaagctaactaaaattttgaaaaatgagtagacctcactttatctgtagcgtcgcctaaatttcccagtcatacagtcattgctctaaaatattctatgttggacatagattctgtgacacaattaataacaaattaaaattaaagtaagcttttggcacttacaaattggcttgatcaaatgaggccccttagtcccccagttaagataatttattacggcccaatagaagttgaaacagcaccttcaaggattaaaatttattatataaaaccgaattaataaaagcgtgattatcgacaccacatctccatttagcaacccaaaagttcttcctgttcccaaatctgaaaaaaaaaaaattcgtaaaaatgccttacgatggatgactacagcagacgggctgttgagggctgcctcagctcttcagcccagaccagtgacagagctaccaacactgcttcacctcctgcagaggtagaggtacaggcaatgagaggagggggtcagggatattttttagccctttctcatcctaccctcatgccagtcccagctttatctacccttgagtcatattaagccattcaaggatgagtggatgaagtttttaatcaggaaaaaatacttccatgccccccaatttgagagtaagaaatagaaaatgaggctattgtgggtgtcatttctaatttctggacctcagcctgtaccctggggtaagtggaagtggaaaaaaactacaagaaaacagaaagagtggtggggatttgtaaggcttggatgagatagtatatattaaagggaaaacttaattactttacccttaagtgtaatgtttgctgtcacctttttgtatctttctctttttaatcagactgttgaaggtgtcttctattcttactttttaagagttctcttcttctattgcttaaattatgaatggatgttaaatgttttcaaatgtaatatctgccaatattaacatgattatttttattctttcatttacatcgttacagattattttattgtatacaactgtatacaaacttcatatggttcctttcatataataagaatgtaagctgtctgagggcaggaattgtggtctgtattgcttacagatgaatcctcaccctctatgtgtaaaatagtgtctgacatgtggtaggcactcaataaatactgaattaatgaatcaataaatagtgtcacctagatatttaagtgagaaacatttgatgtctaattaaaattatctctgttacaaattattttattaaattaaattaatttaactaaaattaaaataacgtgaaccaagtcatgtctagtaaattctcatcctcatgtgcgcaatatttataaattcccaggtggcttccattttcatgaacaccttaaattttgagtttccacttcaatacagtactctcactaacaactgcctaatgactttgtatttaaataaataaactcataactcagccctttaccttgctttctccacaaaaacactcagaaattgtcaattttgtattgtgtaacatactttcctgatgcactggcaaaagacaccactcaacatgaataccaaggaatcctgttatcaatgtcctctctcactccactgctttactcattcttctcgtcttctctagagttctgtgcatttccaaggcagagcagtttgaccatttcattcacacttttgactcctataaatgctttcaatttccaaaaaaaaaaaaaaaatgtatattctttaatgcccaactaagttgtggccatagaaaatgaggaacaatgaaaaaaatgcaagacagaaagtcaggagccacgaaggacagcgtgagacctctagataggagagccagggcttccagatgggctaattaatagactccctctactgccaggacaggggattcttacctttccttcccactggccttggttaattgcagtagaacagtgtccgctacatctcccttttttcttttcctcattaggagtttccattgtggattcccaattctcattgcatcgtggtatattggggctttgaagctaagtattcttttaagttatgggacacttatcacaaagaaacttcaacataaaacgttggggatctcatccttgggaaggatggctctacttcttctatttggaagaagagtgtaaagggatcttgagtacctgaaggcataattctggccaagactgacagctgcctaaccaacattaatcacccttcttcactgcagtgaatgcttataagggtctgttgcctcggcatccagtctaaatacaagcttaattttctcatacgaggctcagggctcagtcacccttgacacagtttccagttctacaccacagtcacgagtacaagaaaaaaaaaagaggaactttaaatttaagtactgggcagaatccagatctaggaaacgtaatcctagccctggaatacttactgatttatgaacaaacttctaatgggagggtgataaaaaggaaattaaatacatcatatgtatatatgtatataatattttaatgtaaacataggacaaataggtgaattatgtacatttaatatataaccgcatcaaaacaaagttttacaatttgatttgattgggaattcaaaattcatatattaatttttataccaaaaaaattatgtaacaaaaggataaaaaggcactgatttggttttgtgcctttacaacataggtactaacttaacttcaacaacagcaaaaatgctcaaattgacaaaaatttatggactttacattggggctcaaattatagttatatatgaggatctatcgagcacccgattctgtggctgttcggggcgccactatgtaacctgccatgatccctggtggactgaacaaaggggggtgaatgcaggaataaaagacaagagacaaaagagtatatttggaagaaggggtccgggggcaccttgcctctagtggacaaggccctgagctttacacggccctctgtatttattagagaaaagcgatagtgagaaggggggtggaagaagaggtcagttggttggtccagagtaggcttgcaagactgcattctctagatgttccagtagataacttcaaagagcttggcgtcaggaagcgattgccctcagcaaaccttctggcggcaggcacagtcgtgagtttgctcacatcctgtattcatgataaacagtttgctgtttgatcatatagcctccagtggaatgctgagttggtcacgtcccatgggccttcggctccctgcatatccccctgtttatgaattaattgaaagaatgtaagaccaggctgggcagctctcattctccgattggcggtccatccgattttacagactataaacagaagacagagacaaaacaacattactccaagaactacatataagatgttactgtggtactttagataggtccaagggttgaggctctccaggccttcctggaattcagtccagtcttctaaagaaggctgaaattcttgagtgtgcctatttaaatcaagaattttgttttgtaattcactaatatcaaaggtgatgttggatgtgaaagctccttgcaaatgggctttcacaaggtcccacggatactcacttttgttatattctaagttggttacacaaatacgagtgtgattaaaatgacagcgcaattgccgctgcaactgcaagctttatacttgttcccctaaccacagaaccatggatttcaacattgccacttcagtttgtaactcagtgttaattttattctgaagtagcctcgcttggttggctgtacgtgtccaattctctacgtactgagccgtttgaacagaactatgcaaagttacagaggacatcacaacagaagttattagtgtgaccaaggaaacgatagcaaaaattatcatgcctaaggctctacgggcacaataagtaacctgaagtagaagaagtttcacaaaatgcaaagcaggtgtggcagcccaagcctcggacagattaacaggaatccctagcccagggatgcaacctaaaatcatcaaagtcgagatattatgtgttcgcaatgtgctatgattaatgcagtgatataactggcaagatttacaggtcaactgggtattgtttacctggagctggtccttctgagctgccaaaaagacataaggattaaaaacacaaaccacaaattgagtggtgatattctttacaaatgtaacattaagactgtgtcgtgactccagtcggccttctctccatctttgcactcaggctcagctgactcatggctcgtaccggagggactgggcccatggttggccaccccatgtttctccagtctcccattccagggttgcaagcaccttgagggcacccacatggcttgtcaatctcctgtaaacacacaagcataccctcttccccatgtcagtaaatccaccgggcctttccattgtccttcttctggggatttccataacactttcagataaactttcctcttttcctctaacacttgccaatgtctttctgctggagtcttaccatccgtaccaggagtcaaaaattttaaagtaaataaggctaaatgtagttttgattgaggtggtagttggcctcctataccccctttttgtcttttcaacattcgttgtaatgtttgatgtgcccattctataatgccttgtcctctaggattataaggaattcctgttttatgggttatagcccaaagctgtaggaaattttgaaaagcatgactagtataagcaggtccattgtcaatttttaattgtttaggtattcccatatgagcaaatgatgacagacaatgtcgctgtacatgaccagctgtctcacctgtttggcatgtaccatgcagcatatgagaataagtgaaacaaattaagcagttctgggtctagcgtacttttaactgtagcagtttctatgcgaatggctaaatttacaacataagctgaacaagaagaatctccttgcagggtttggtaaagatgtgtaagttgataggtagcaatacctaacatcgggcgtagccaattaatatctcctaataattgctgaaaatcatttaaagtctgtaacctgtctttatggttgacaatgttgattgtagcctgccacgatccctgatggactgaacaaaggggacgagcgtgggaataaaagacaagagataaaagagtatatttggaagaagcggtcagggggcagcttgcctctagtggacaatggccctgagctttacacagccctccgtatttatcaggcaaaagagatagcaggaagtggggggggtggttgctggctagcagcctgattcacagcaggcttgcaagactgcattcttaaaacagtaggcgctagatttctcaatagataactctcaatagataacttcaaggagccagggagtgaggccctccacaaaccttttggtggcagcgcagtgtgagtttgccacatcctgcattcatgataaacagtttgctgtttgatcatatagcctccagtggaatgctgagttggtcacgtcccatgggccttcgggtccctgcagttgataggatctgaagctgtgagctgtaaaacctcacagctgactgcaactagctctgagcattgacctgaaaccccagagatccttattgtttgagtatgttttagtccatagatggcagcatgacctttggaagagccatcagtaaaataagtctgtccacctggaataggtttgtgatgagtaatcacaggaagaatgaaagaatggattttataaaactgtaaaattttgtctgagagtagtggttatctatcacgcccatgaagtctgcgaaagcagtttgccaggcagtcgacatttcccaagctgcagcttgttgctgagagtctaaaggaacaataattttgtcaggatcatatcctgtaagcatttgtgacctatgcctgcccatagtcacaatttgtgtaattaaagaaagataaacttgcaaggttttgactgtttgattagatagaaagaaccattctattactgttacagactagtctataaactggcccaaaagtcctgttggagagtagggggtaggaagaataaacaaaagcaaaggtttttgtggttgtagccatgaggcatgtctctgctgtaacatttgctctacaagctgtaatttggcttctgcctctttagttagttgctgcagggaatttaaagaatctccgtgcagggtttggtaaatatgtgtaagttgataggtagcaatacctaacatcggtcatggccaattaatatctcctaataactgctgaaaatcatttaaagtctataacctgtctttatggagaactactttctgagtccatacacttctctctgtaacaatagttcctaagtattggtatggggaagttgtttgtaccttttctagagctattttgagattccatttagtcaaagcctgctttgtttctctgaataactgatgtaggttttgatctgtaggagcagccaaaagaatatcatccatataatgaatgatgtaagcagtaggaaacatattccgaggcttctttaatgcctgtcctacaaaatgctgacatagcgtaagactgttaagcatgccttggggtaaaactctccattgataatgagaaacaggttctctttgattaatagaaggcacagagaatgcaaatcaaggcttatccttctcgtgtaagggtgtagtaaagaaacaatccttaagatctattactacaagaggccagtctcttggaatagccgctggagatggtgaaagtttttgtaaggcacccatcagttttatgtgtacatgaatagctcttaaatcatgtagtagtcgccatcttccggacttttttggaaaaacaaacactggagaattccaagcttatgtgtccggcatcccattgttcttttactagctgctgaagttgcatcaggttctcctgagataggggccattgatccacccacacgggtttgtcactgagccattctaatagtgaggcagtgggcagaggagaaatatcaatgaccctcgtcagaaatcctgacgtcctagcccttttctatctgtttttccagttactgatattgggttaggatttccttgaagaaattttcctaaacattttcccctctgatatctcatgttcttcaacattttaaatcctgggttatcaaagttttcatttgtaagtctcatattccatgttataagtaagtctcaaccccataaattgatagctatattttcaacataagactgaaaagtacatgactgtccatctggaccaagacaaggtaaaatctcagtgctctgttgaacactttgagctgttcctactcccactagggatgtagaagttaattgcaagggccaggatgggggccaactgtctttagatatgactgacacatcagctcccgtatccataagcccataaaatttctttcctttaatgtgtactacacaggtaggtctattagaggctatgggttgggatagatagatttctcatgtagttgtgctcccaacctctttattttctcatttctcctttcatggagaagggtgtgatttgcagggaataagcaataattgagcagtatattgtcccagctcaaaacccaaagatcttgtgacattaaaactacttgaatttctccttcataatcagagtcaacaacttctgggactacagtaatgccctgtaagttaaggcagattttgcctaaaattagtttcacatatcctgctgataaaggtccccaaatatcagtgggaactttgatgggtttgtctgccccaactaacattacccattctttgactgggagatctaatcctgcactccttgtgttcctggggtgagggaatcaatgtgcctctgggaacccatgcctggaacggggttgaggtctggactgggaatgccctcattgtttgtggggcctgggtccaggcccccatctcatttcccagcaggggggtgccattctgatgaaattttgagcggcactgattagcccagttatttcctctgttacgcaaggacaaagtcctggcattttttccactgggtggggcactgcattgtaaggtcctttctgtactgagatctggcggcattcctttttaaaatgtccaggtttttcacaattataacattttcccactttagggtttgacccttggctccttttagatttgtcaactgctaaattagccactgcttgcgctaatattgcaaagtgatgaagctcagttcctacatcttgacaagctctgagaaaacttcccaagttttttatacacctcaccagtgccagtgcatgtttacaatccgcgtttgcatcctcaaaagctagagttaaggttagcatttctgcagccgtggtatgaggaatctgacgcttcactgcctcttgtgatcttgtaagaaattgcacatagggttcctgtgacccttgcatatgtaaaaaggattgtactgggactccctcttcaggaattgcggcccaggtgcatttaacagcctgtgcacactgctgataagcagcgtctgggagtgccatttgactttccaggtctgaataagggccattacctaatagcatatcctctgtaatgtctccgtgtccagcaacatggttctgtttagcctggtctgcacacatttcttgccaatttaaattccatgtcagatatgcactagtggacaagcaagttcgcatcaagtgtctcacatcaaagggtaaaaaacgcatagcaccaaacacagattctagcaatcctaaggtcaaccggctctgtatgccattatttaccactctcgcttttaattccttcaacaacttactctagtggggtgtgttcatgaataacctgctgtggattgttgggatcaggccttatggaaataggaaaagtgcaaggtcctaggggctctccagctatggcagcagagcataaaattctttgtattggggtctctagttctgctaccaaaggaggcaatacagatgtttctgcaactggaggaggctgtataggccaatttttatcctccctctcctgttttttattttcatctggagctgtgagtgggacaacagattctttcagatttttagattcagcctgttgtcccacagaataataaggagataatggcagaagtacagtatgaactaaactccaagtggagaaaacagaaggatcaattttaagacctttttgatgagcccattttaatccttctgctctgtcccaattttccacatcaagggtgctgcctgtggaaaccatgggttatgtgtaataacctcctgcagcagctaagttaatgtctgagaactaacctgagcaccagtttgtttcaacagaactctaagcaactgcacataattatttttttcagtagacgaattctgccccatgttaccgtgattcagaaaacttcccattcccagtacttctttaaggaactgatcccagtacctctttaggcgctgacctcatgtgcgctgccagctgactcatcccagggtccccatttgcgttgtcaatttcagttcctctattccaggagatcttcttcattcacatcctcatagtcccgtgttcagactgtcgcctgtttgagtgccacttgtagagcccctgattctgtcgctgttcggggcaccactatgtaacgtgccatgatccctggtggactgaacaaagggggatgaacacgggaataaaagacaagagacaaaagagtatctctggaagaaggagttagggggcaccttgcctctagtggacaaggagctcggcaccaggaggcgactcgccctcagcaaaccctctggcagtgggagtagtcgtgagtttgcccacatcctgcattcatgataaacagtttgctgtttgatcatatagcctccagtggaatgatgagttggtcatatcccatggggtcttcggctccctgcaaggatcccactaaatgtactcactttgcccatattgtcttgagaaggcaactacatataaaattttgaaaaatgagtatacctcgctttaactacagccttgcctaaattacccatagtcatacctattgttctaaaatagcctatgttggaggtaggttgctctaaaacagaatatgttggaggtagacataataaataatacattaaaattaaagtaaattgtttgcacttagagattggcttgataaaatgggatcacttagtcccccagttaagatagttaatatggcccaacgtagggtgaaataatggccttcaataattaaaatttgttaaacaaaacgtgattaataaaagggtgactatccacattgcatctccacttaacagcccaaagtgcttcttgttcccatatctgaaaataaaaaatatcacaaagaatgtcttatgatggatgactacagcactaaggctgtagtcccatctatcagggcccccatatctaacatctaatattattaaaaattgctaatactattcaatcaagaactggtaaacattttgctctcattcatttggctagcatgttctgttaagtgcttatttctacagaccctcagctacagttgcctccacctctgaagaaacacaatacacctttccaggctacctaggggtaccctcatagctttggcatcacacacaagctttgcagacaggagcttaatgacatccacagtctccataagcacaggtgcagcattacattgaggacaacctcctctaagaagattcacttgatacacacattacagtcatttaattcgtctcttagtccattcaaggtactataacaaaatttattatgctggataatttgtaaacaacataaatttaggccagacgtgggggctcatgcctgtaatctcagcattttgagagtctgaggtgggtgaatcacctgaggttacaagtttgagaccagcctggccaacatggtgaaactctgtctctacccaaaaatacaaaaattagcaggcatggtggtgaacctgtagttctagctactggggaggctgaggtaagggaattggttgaaccctggagatggaggttgcaatgggccgagatcacgccactgcactccagcatgggtgacagagtgatgctctgtctcaacacacacacacacacacacacacacacacacacacacacaccccataaatttattgatcacagttctgggggctgtaaagtccaagatcaaggtgctagcagatgcagtatctggtgagggccattactcacagacagtgctttctatgagtcctcacatggtaaaagggaaagacaagtgcctataggactcttataaggcactcatcctacctatgagggcagaacaatcataattgaaaacctccaccttttaataccatcaccttggtatgagcaacctcatttatatttttatttttatttttatttttggcccagggaatgatctaaggatgtcatgtttcagtggtgaaagataaggacaggtcctgaagagactctgaaggagtctttataaaggaggatgggatgttttccttttttttgagacagagtctcactctgtcacctaggctggagtgcagtggcgtgatctcggctcactgcaagctccacctcccgggttcacgccattttcccacctcagcctcccgaatatctgggactagaggtgcctgccaccacgcccagctaattttgcttttgtatttttagtagagatgggttttcactgtgttagccaggatggactcgatctcctgacctcgtgatccacccacctcggcctcccaaagtgctgggattacaggcataagccaccgcagctggccgatgttttcctcctttataaaatgagacaggcatgtgaatgaagccagtttttttgtttatcttcatccttctggctctggagggcccgttgatgtgatgtccagaacagtggcagccattctgtggtcactttcaagaagcccctggaagaaagccaataggatggtgaagcaaagggcttaaatgaaaaccaatttttatttagactcagattctatctccttgcaaaactttttgtaatagtaaattccttcttggtttatgtgcttcatatgtttactatactttatcactgaaaacatcctttggtatagtgattcggggagaaaagaaaaaatagttgactcctgttttctgcgtctccacttgtcttcatggttgtgttgtttcagccggaggacaatgtcctgatgttgcttaaaatctcagaaagggcccatctcctccgatttagacctttaactcttctcagattaagatatttgaactaaatttgttgtaattttgtctattaactaatccttagagctgcgttgcaggtcccacaaattatctccctctggagcagaaggttaaggggttaatcttggtaatgatattggataacgggtactctctcatgcatctgcctcacctctcaaggtttttgttttttgtttgttttgtttttttgttttgagacagagtccagctctgtcacccaggatgaagtgcagtggtgtgatctcggctcactgcaacctccatctgctgggttcaagtgattctcctgccgcagtctcctgagcagctgggactacaggcatgtgccattctgctgggctaatttttgtatttttagtaaagatgggttttcgccatgttggccaggctggtcttgaactcctgactcgggtgatctgcccacctcggcctcccaaagtgcagggattacaggcatgagccactgcactcggcctaaaaaccactttttttgtttgtttggtttggtttgagacacagtctcactctgtcccacaggctggagtgcagtggcgccatctcagctcactgcaacctccacctcctgggttcaagagattctcctgccccagcctccaaagtagctgggactacagccgcctgccaccacgtctggctaattttcgtatttttagtagaggcggggtttcaccttgttgcccaggctggtcctgaactcccgacctcaaatgatccgcccacctcggcctcccaaattgctgggattgcaggcgcgagccaccttttatcacatctcattttatgttagtgaggttatttagggcgaggtcccttgataggctcaggttagggctgaccaccacaaaaatcaagtgactagagggttggagctttcagccccacccattgactttcaggaaggggaagtggggactggagattgagctctataaaaaaatgttggctgggtgcagtggctcatgcctgtaatcccagcactctcgaaggccgaggtgggtggatctcaaagtcaggaattcgagaccagcctggccaacatgatgaaactctatctctactgaaaatacaaaaattagccaggcatggtgatgtgcgcctgtagccccagctactcaggagactgaggcaggagaattgcttgaactgcttgaacctgggaggtggaggttgcagtgagccaagatcccgccactgcactccagcctgagggacagggtgagactctgtctaaaaaaaaaaaaggtagacaccaggcacggtggctcacacttgtcatcccagcactttgtgaggccaaggtgggcagatcgctttaagcccaggagtttgaaaccagtctaggatacatggcgaaaccctgtttgtacaaaaaattagtcaggcgtggtatctcacgcctgtagtccccactacttaggaggctgaggctggagaatcccttgagcccagggaagtggaggttacagtgagcagcgatcatgccactagactccagcctgggtgatagaatgagaccctgtctcaaaaaaaaaagaaaaaagaaaaaagaaaaagaagaagaaaaagaaaagaaaagaaattagccaggcatggttccaggtacctacagtcccagcaactcaggaggctgaggtgggaggatcacttgagcccaggagtttgaggctgcagtgagctgtgactgcaccactacaccccagactggggaagagagtgagatcctattaaaaaaaaaaaaaaaacccttgagaaatgagattagatgagcttcttgagttggtgaacacaaagaggtgccggaaggctgagtgcctgaagagagagcatggaagctccatgtaccacctcaacctctcccttgctatatacttgccctatgcatctattttgactgtttttgagctgtattcttttctccttttttttgagacagaatctcactctattgcccaggcttggagtacagtggcatgatctcggctgactacaacctcttcttcctgggttcaaatgattctcgtgcctcagcctcctcagtagctggaattactggcatgtgccactacacccggttaatttttgtgtttttagtagagacaaggttttgccacattggccagactggtctccaaatcctggcctcaagtgatccaccagcctcagactctcaaagtgctgggattactggcgtgaaccaccatgcctggcctaagatgtactctttagaataaaccaataaatgaaagcaaagtgatttattgtgttctgcatgccattctagcaaattacaaagctgatgagggggtcacaggaacccctgatttatagcccatcagtcagaagtacaggtggccacatgggacttgcattggtatctgaagtgaagacagtcttgtgggagtgagacctttaacttgtgcgatctgatgctatctccagttagacagcatcagaactgaatttcattgtaggatagacagtggtgtctccagagaattggagacttgctctgtttggaaaaaagcccacacatatgctgttagaagtatgtgtgtaaatagagaagtgagtttttgcttaatcatacatctttgttgtttattgttttcctctcattttttcaccttggtaattttttgtttcatttccctgaatctctgaagaagaaagggcctggactctcatattccttgacccttgttatttggagggatgaactccagtctcccacagaaggttagaggtgaaggaacattcagacacataggtttctaagatgagtagtttgatgacatctccaaggtgtcttctgggaatggtaagaaaccctgagtttctgtcactggattgattccagctccattgttcccttgtccttcagcaaagtctctgctgaagcctattatgtaaaaatcacaggacaccattggtttaaactgagctactgtactacactcaacaaacaaaaccaaaatagagtcactcatactaaagttctatgtcaccaaaccaaaaactaagttgtttatctggctttccaagaaatcataaagagagagagagagagagaaaatagccaaattcccaaacaggtcactttcagtagccatgaaaatgcctctgctttaatccttacaaaagaagtaacgtaagtaaccatgtcagtcaatctgttttgtttttttttttaaattattgtttccctattcccactgtatggaaaaagcaactttgaaatgaccattcagcttttttttctttgtttctgctttctttagccctcctctccctataaaatcaaacttctctgttctactcatcaatacaggcattctgttttgagggatgaggtgttgtctgattctagaattatgaataaagccaataaaaactttacactaaattagttgtaattttgtcttttgacaaatccttggagcttgtgttgctcgacaggaagccagggactggccacaagaaaaggaactcagctagtggtaagttggggtctggcaatctaaaaattattgttggaatgcctgctgtatgacagacatttcctaaactctggagcagggctgtgcgatgaagtatctacttgccaaatacagcttttttgttttgttttgttttttcagtcttttttttttcttttttcttttctttacttttcttttattatactttaagttttaggaaatgatgagttcacgtcctttttagggacatggacgaagctggaaaccatcattctcagcaaactgtcgcaaggacaaatacagcttttgagtgcttgctatttttctcatttaaccttaagtgtgctataaatataaaatgcatctcatgtcttctaagacttagtatgaaaaaagaacgccatgtatctcattaataatttttattctgattaaatgttccaatgataccctttttgatatataggattcaagaaaatatattattggtgttaatttcccaaatgtttcctactctgtttacacatggttacctgaaaactataagacacaaacacggcccgtgtttacagaccacattgtgtttccattggacagtgctatgctagagacacagcactgaaagaaggtgctacttgtggagtttgtatatcagtgcagaaagtatttatgatagaaaataaatgaacaaacaaataagaaaagcatctggtgacataggctggacctggggcagctgttttgcaaatgggttaagagaatacctctgaggacaagatatttaagctaaaatataaatattcagaaagagccaggtgtggaaaactccagaggaagatcatagtaggcagaaggaagagagaaagcaaaagccctgaaatggcaagaagctggcatggtcagggaatcaaggagtccaccatgggtccagcacagtgtgtcaggtgagagtgcagagatgaggtctggggatacacaagacaaatctcagggtgcttgagaagtgtgagttagaaatgtggaagccatagaagagtgctgagaagaataacatcattgtcttatttttccttttgaaatataatttgtctgtgtctggattttagcagagggaatagcaggaccaggaacaaactatctgcaaagtttgtacaaatatccaagcctgacagggccatggacatgggtagtggagatggagatggctctggctgtgcattcagcatgttctgtagatataatcaataggacttggattgtattgggtggtaaggaaaatgaaaggtgagttctacatttagagctttaataactgaatatttaaactccaaatagatacagaatattggaagaatggcaggtttgggaggaagggacaagcaacagtttagtttgggcaatgttgggtttggagtgtctatgggactgcaggggagatatcaagaagtcaattggttatatgagactagagctcctggggaggccagtgctaataattcagatgagaggatagcatggtactttaagctgtgatactgaatgatatcacctatagaatgtgggacaccctaaatttagagacatttagagcagaaaactggactgaaaagaggtggccaattgagctgtaaagacaaccaagagtggattgtgtgtacatcttatcatcttatgatatggaaaaaaaatgtgtttgaagtaggagaaagagatccagtggttcctatgtcactggaacatcaggataaaaactgagaaaggtccactggatttggcagtctggaggtcatgtgtatccttaggagagtgcattagctggagtgctaaggactaaagtcaatatagaatggattcagcagaataggtgaggtgagaaaaaaaaagcaagcaattagagacaaccatttctaaagtttggctaggaattctctttacagaaaacacttctcttaaagaaatagggttgaagcttggaaagaaatatgggccaagattggtttctttttaaagggaagggataggataatggttacttggtaacaagaaggatctagtagaaatcaaatcttgagggtttctttttagcagaaagcagaaggacaaataccatttcttgggaagacgagagacagtgggatggaaagcaaatgtaaagagggaagtcactgggaaaaagaagtctttattcacaatagcaagggcacgtaaattgagggttaggaaagaaaaggctaaaaaatgcacatctaattgttacagttttctcattaaaattcagccaaggccatcagctgagagtggaatagtagaggaagttggttagtttgaggagaaagcagaagggctgaatgttattttaatgcatcagaaatcacacgtgctggagaagcacagatgctaacaaggaagtgccgagtttccattatagattacattccaatctgtaatcatacatccagttgtacctctcaataattgtgacattgaacaagtcacttcccctctctgagccatggtttcctatggattatacaagaacaatatttgtcccagagcaaggatgttgtaattagaaataataaaatacacattggttgatacacattgggattgcaccaaatagcagccctcataatcagtacaggtatcatctctggtccacggttctcttctccactttgtaactagggtggatccaaaattttacaacattgtcttgttggcctgtccccacctgtcactgcacattgttggaatgtgtcaacatttccaaatgacttagagattattgatacatcatactgtctgaatgtcttctaggatatttggagagtggtagagaaaatctgagtctgttgaggaactagggaatgggagagggttaaccatacaattctgttgaaatcagtctgattgagctccaactctggttctacccctttctgactgggggctttaaataattaatgtaaccaatataagtcaacttcctcatgtgtacaatggttatactaattaaaactaaggttagtcaatattcaccgtgtctcaaggtgtgctcagtgctcacacagattaacacgtctcatctgcagaggctgtgagagcagttgttagggttaaaggagaagctcttggcatgtgagtaatgttcataagtagtagccactattgctatgagcattgttcttgtcctgaccttgagcttcaaaaggcacgacccaggattgagccccatgacacagcacacagcctggtgaggaccagaagttcccatttgtcacagacactcagtctagcctagaagatttccatgtccagtctcacttaatcctcacctgaaagttagacttcaccacaaaactgtccttgttctgcagaggagaaaactgaggctcaaagagatatcactgaccaagaacccatattggcaaggtgccaacgataagagtagcgatctaactgaccccaaagcccagtgttctttactctgtaacagtgatgctcaactggggggagttttgcctcccacgggacctttgacaatgtctatagacactttcagttgtcactcctgaagggggagttgctactagcatcggtggatagaggccaggggtgttgctaaatatcctactgtgcacagaacagtcccccacaacaaagaattacacagccccaattgtctgtagtgccaacgttgagaaaccttgagctacattaaacaatgtcccatgaaagacctcagtgaaagtgactggtaatgacaggaagaaaagaaggaagagagaaagggaaaggaggaaaaaaccatgatactagggtatgaccacatgctggaaatatctggggaactcctttcaaatgcagcattttagagttgcaacggtagtggctctaaagttgctcatcctgaatttcaaatcttgctgcctccactgaccggctggacatgatgctgaaaaaaaaaaacctacaaaaaccccaaggccatgaattccctctggtacaaaaaggggtaatgatggctgcccacaatgttattatgagtattatttgtgaacaagtgctgtataattgctgttacttttagagaggctggatatcccaaggtaggaagagtctctaattttcctggccataaaaatcactgtagcttttacacagagagattctagagttgggttcatgaatatgcattttaacaaataccttggatgtttctgatacagcccacagaccacagtataagcaaatttggtcaagtggcaaagacacaagggacacagagacctttgggttgagttggatgcaacagcttcccatgtgacctggtgcagaggcagggactgtaattttgtgattctgtttcttaaaagcaaggaaatagatcccagaaagatgccaggatatcctcccatagtgttattgcccagaatttagtcatgtttccaccaataaagcaatcccttgcaaagcaaaaggaattctagttagaacaaattagaaaatcaagatatgcccgcaaagatggaggagggataccttcccccaaaagagtgagtaactgaacaaaattgcgatttgatttgcagagaagaaatgaggaacagttatttgtggggggagggggcatcaccagcaatatctgtcagaattgttgcatagagaaagggcttagaagtcagactaagctagattaaagatctttgtctactgtttcctacttaagtgaccagcagatttcacaattgctctcaacattgagtcattcctgtggaaactacaaacaatgaatattacagagctactatgcagaccaaactacaacccatatgtagcaattaacacagtgaatagtctctgataagaaccctacaaatactagctaaatattcatgctcattctgtttatcccacagaccttgaagatatacaacggatgctaagtagggacaatgaaaagcagacgggagaaagtaaatatagggccctctttgttgacttcatctagcacagaatctataggatgtaatatatttctgctctttttttttgtggggggaaatggaatctactctgacatccagactgaagtgcagtggcacgatcttggctcactgcaacctctgcctcccaggttcaagcaattctcctgcctcagcctcctaagtagctggagttacaggctcttgccaccacacctggctaatttttgcatttttagtagagatggagtttcaccatgttggccaggccagtctccaactcctgatctcaagtgatccactctcctcaacctcctaaagtgctggggttacaggcatgagtcaccacgcccggcctatagcatgtaatatatgtctatatattacaagtaatggttcaaaatcctcttcagctaactcaatccaaaccctaaaacttcaaattaaatatcaactaaaaaataggtcaagggtcctcacagtgggagggacaggagctgggagactgggagagcatggggccgaaagaagttgcagagcttgccagcatgtttgcattgagtgatggaggccacagatgtgaaccttctgactctgagtcttgtgccttcctcacgaagctgaagctgcctatgctcaattttccattgtccatacactctcagttcagtatttccgctggtggacagagccctttaatcctcttggtaatcagcttgataggtggcatgcatattaataatgatgggaatatagagaactatcgtttcccaaaggaactccgagagagtgccaattttatgttataaccattcacaaggctcactggggagggtctgctggtaggaggaggagctacagtggaagttaatgaatagttgtattgtaagatggtgtcacagctgagaaatggccattgctgaaatgtttcaggtgtgggaagatggaaaccaacttctccattcctctgaatgaaactgaggaggtgctccctgagcctgctggccacaccgttctgtggatcttctcattgctagtccacggagtcacctttgtcttcggggtcctgggcaatgggcttgtgatctgggtggctggattccggatgacacgcacagtcaacaccatctgttacctgaacctggccctagctgacttctctttcagtgccatcctaccattccgaatggtctcagtcgccatgagagaaaaatggccttttggctcattcctatgtaagttagttcatgttatgatagacatcaacctgtttgtcagtgtctacctgatcaccatcattgctctggaccgctgtatttgtgtcctgcatccagcctgggcccagaaccatcgcaccatgagtctggccaagagggtgatgacgggactctggattttcaccatagtccttaccttaccaaatttcatcttctggactacaataagtactacgaatggggacacatactgtattttcaactttgcattctggggtgacactgctgtagagaggttgaacgtgttcattaccatggccaaggtctttctgatcctccacttcattattggcttcagcgtgcctatgtccatcatcacagtctgctatgggatcatcgctgccaaaattcacagaaaccacatgattaaatccagccgtcccttacgtgtcttcgctgctgtggtggcttctttcttcatctgttggttcccttatgaactaattggcattctaatggcagtctggctcaaagagatgttgttaaatggcaaatacaaaatcattcttgtcctgattaacccaacaagctccttggccttttttaacagctgcctcaacccaattctctacgtctttatgggtcgtaacttccaagaaagactgattcgctctttgcccactagtttggagagggccctgactgaggtccctgactcagcccagaccagcaacacagacaccacttctgcttcacctcctgaggagacggagttacaagcaatgtgaggtcggggatatttttgggctctgtctctttctaccctgcgttaagcggaaaaaaaaaattctgacagtgtttttcttcctctttcataccaccaccaccacaatcatcaacataaaggaagtctgtaccaaatctgtagggggtttttcccacaaccaagcaatagacaccagctgggtgtcctacaattaaattccaacactatctacctggagctactgtcagatcccacaggtttaagggctcattccccaagtctgctcctccagttgagacacaagtcacaaatccaggcttctgaaacttcggaccaaccagcttcaatcagggttcccactaccccctctttgggggtagagtggctcatggaactcagagaaacatttatttcggcttgctggtttattataaaagcaaggtttattataaaagatactacaaaggatacagatgaagaggcacatagggcaaggtacggggttccacgccctccctgagtgcatcaccctctgggaacctccgtgtgttcacgtctcatgaagctctccaaatccagtcctcttgggtttttatggaagcttcatgatgtcagcattctttcctccagtgtataggatgggatcctctctggggagggtcttaagacccacaattagaaaggcaagggaagattagagtcctgctttggggtagatgaaaggaaaggagagagattctgtttcctgaggcttaatacacccaacattataacaaaggactgtagcaagggctatgggagttctgaagcagaaaccatgggctaaaaccaacatacatcttaataccagataccctaatcccagtcctaacttcatttaaccttggtcacattgagtcattccaggatgagtggctcaagtatttcctcagggaaaatacttctgtgccccctgatttgagggtaagaagtagataatgaggccactgtgggtgttattttttcatgtctggacctcagcctatatcctgagactaagtggaagtgggaaaagagtacaagagaagagacaaagtggggatatttgtaaggcttagatgagatagtgtttttttagaaaaaaactttatcttaccattaagtaaaatgtttgccataggctttctggggctttctctttttaaagtcagactgttgaaggtttcttctattcttatttgttaagagttttcttttattgtttaaatcatgaatgaatgttgaattttattaaatgcagtttctgtaaatatt

SEQ ID NO: 399 - DNA, 32134 bp, Homo sapiens
  source 1..32134: mol_type = genomic DNA
tggagctgtaagacaagatatataatgacattgctctgaggatgaggctttttgaggatttccaagcttatttgtctcctctgatacaagggtggtggttgaaggctgatggtcttcatggctactgtggttctgaggctgctgttttccaacggtaatgcagatctggggaaagggatatagaagtaggccaaattaaaattccacataccccactatttttaatgaggttcaaaatttttttcttgaaaagaaaatgctgttcaaaatattgtaagcctttggttattttccaaaattgactgtgatgatgtttatgttgttttaatgaaaggatggatacgcagaggccttgtctctgctattctggacatcatgccttatcacataatttattttttgcacagtaatctctgggataaaaatttattaactttacaagtaaataccctaagtcttctaatgattaaatggtttaccatgggttatacagttgatacacaaagccattactgtttatcaatatataatactgcaccaatttaataattgtgctaatgaactgttaaaaattcgaatatgtccccagattatttctacccaacctcacctccatgcttccatcaagtatctcaaagaaaaaatacagagaacatcaggataatgctaacagacagttttgtgtttatttggttgtatgcctgccttctgagtaaagagtaaagcctctacatcgctaagtcaatgtcatacaaatcctttaattatccgtattttgggtgtatgtctgtcatattctagacatccacatacccttgctttcttaagtgaataaccagattctctgaagaagagacactgttgtgaacaggaccatcagtaattttggattttttttcaccatttaagacgagaaacttggtgctcggggaccttgaacatcaagatcggggggctgagggagggataatatactgcatgaaaggtggtagtatattgcagccagaggcttgattggaaaagaacagcattatgaatgagcaggatagaactgataaagtaaaacgaaatgaaagtacttcctagaagcagcatgatttgaatggcttttgcctcaggggagaatctgtaggagctgctgagggtgtgaatgcgcctcactctaccatgtagacaccagctccaaccatgagtccatgaagacaacatctgggaaagtcaagagaaatgtgtattttgtgtaatctcagcactttgggaggccgaggcaggcggaacatgaggtcaagagatcgagactatcctggccaacatggtgaaaccccatctctactaaaaatacaaaaattatctgggtgtgatggcgcacgcctgtagtcccagctgttcaggaggctgaggcaggagaatcgcttgaacccgggaggcggaggctgcagtgaaccgatatcgtgccaccgcatttcagcctggcgacaaagcgagactccatcaaaaaagaaaagaaaggaaggaaaagaaaaggagaaaggagagaaagaaagagagaaagaaagaaggaaggaaagaaagaaagaaagaaagaaagaaagaaagaaagaaagaaagaaagaaagaaagaaagaaaagaaaaaacaaagaaaggaaggagaagaaatgtgtattttgcagtagatgtttcaggatttttagaagagcatagaccacaatttcatatcttggtagaattggggatatgccgaagggcctctacatgtttaagaacaaagatttttattgtaggttgaagaaccaatacagaaagcaggagaaaccgatgttcttcaaagctctgtctttgaacctcatccacccaccagccttcgggtgggtgattgcctgagaactgctcaagtggcaagtgactgtagctttcaggctgctcaccagaaatatacagatacatatatatctgtacacatacacacacacacacgcacacacacaaaactctaagaacctattatctcatgtgctgctttcaaatctaagattattattttaaaattttttgtagagatggagtctcgttacgttgcccaggctggtctcaaactcctgggctcaagggatcctccaaaggatccacctgtaatcccaaagtgctgggattacaggtgcgggccattgtgtctggcctgcttttagtctttgagctttacagggccctgaaggcctatctttgaattcccttactctcaccagatatgctcccactgcacaggaaaggctcccacccagctaactccccaatcagctgaactagctgcacccaacatggtcctcaatctatattcagcccatggaattatacaaagcaattgcattcttccacagaaaccatgggcacgttaccctctcattatataaagcctacttcccacaatctccgtgcttgttcactctattcctgagtgcaatacctatatgcaatgaccatttctctcaggctgtatctgtgactaataaactgctgtcaatttcatctagccagtgtcaggtgttgtgttcagccattccatactacttagggtagggagtccctccctcatgcaccagggtgaataggaggttgtcagaacatatgacacacacaaacacacacagaaaaatgttgcaatggtcaaatccagattagtgtttagtactccttaaacatctttatgtctgaagattttcataataaaatggtgaagaaaagatttcttgacaactgtcaaacaaaatggggaaggggcaaaaatctagagaaaaaaataagcaagattttgctggtacatttttacagaattccttgcaaaacaataggtttcactgataaccaaaataagtcagttatttcacatggaggtaaaaaaaaaccttgctttttaataactagaatacccactagaagttttatagaagattcagtcaagtaagtctcattttgttaaaaaaaagtccatatttgaagtgccagagttcatgcaatatttttctttttaaatatatttttcttcatgtaaaaattcaaatattaacaattttagagtgtacaattcagtgaagtttagcacattcacaatattatgcaaccaccatctctatctagttcaaaaacattttcatcattctaaaagaaaaccccatacatactacgcagatagattgcattctcccttcccctctagtgcccaataaccactaatttgctttatttctctatagatttacctattcagagtatttgatataaatgaaagtataaaatgtggaatttgcatttggcttctttcactcagtatgttttttggggctcattcatgcaacatgtcatcagtacttcattcatttgtataactgaccatttatgtattcatgtgtacatgcatgtagcacattttatttattcatcctttgataggcatttgagttttttcaaccaaatgctattttggctattgtgaacagtgctataaacattcatggacaaatatttggttgagtacctgttttcaattctcatgggtattttacttaggaatggaattcctgggtcatatggtaagtctggatttaactttttgaggaaccaccaaaggaatggcatattatcataacaaatcaaaagtttcggtgtgacacaaacttgaaatatatagccataaactcacctcatataacctcacacttttttcttccattactctaatgtgttgctggtttttaaatattttaggtaaatcttttataatctttggatgtttcagagttataaggctctagaaaaatgtaaacttctacttgtgatggatcatcacagtgggcaaaaatactacaaatgacagcaaaaataaggaattcacacttacgtggtataatcctttagactccttaataatgagtcaaatatgtattacaagacattttgattcataagaaaaaaacattttatttgcactacattgaattattcaacattttgtcttatgttgagaatttctttaaccctgaaaattgtttcttcgtgtaattccaagtaaacaatgaagtttataaatatataaagtacatgtcacatagtacagtccacaacacaacccctaagatcctttgtcactattcgactaatccttattatattcttatttttcatatattcaaaaggaatatttgacaatgaaatgtctaatatttatagaatattctctggaatcctttctataataattatgcaaaaccattataaaattatatatacaggcaagggtaattactcaaatctaaagtgccatcacacatttaaaaagccctgacaattactatgacattccagatcataagatgcttcacaatttaagacatggtaggatgtgaagaagtgaatccatgaaataaaaaataacttatcactgatgcttttaccactttcactgcattcataaaatctctgtatggagcaaattctgctcctatatttaaaagcttgtgatgtttaatgctatctaatcctccacagaaattatttcctgtgaccagaaccattgcttttaggtaaatgtatgactctgctgaagcagaatagatatggctccattaggattttatacctgcattgaacctaaatattattgccttcgagaataggatctttctgataactgagttagggggcaattcagctctgaattttaaataaagaattttagacaatcactgcaattctttcctgctatgcaatgggttttgtggccaatggccaagtttaactctatcgttttcccttctgatttaagtatctgatgtatatgtcactttcaaaagctttccacattccgtttcagaaggacctatctaccacatgagtttgctgatataattagtgacctttggtatctacatgaaggctttaccacatttactatattaataggggtttcctcttgtatgagtttgctataacaagaaagataaacattaactgggaagactttatcacaatcacattcactgtatctatgagatttctctcgtaaacaagatattcaaagagttttgactttcagattttaatttttacctgcaatgaggtgtgattcttcttagctttcctgcattccctccatctgtagggtccttctcctgaatgaataccctaatgtgtaacaaatataatttgagaatgatttatcattttcattacatccactggtgctgcctactaaatggaaagcttctagttttctaataaacttttttgacaatcactgcactcataattgactctctctttttttttttttttttttttttgagacagagtctcactctgtcacccaggctggagtacactggtgcaatctcggcttactgcaacctccacctcctaggttcaagagattctcctgcctcagcctcctgagtagttaggattacaggtgtgcacaccacacctggctatttgtttttttttttttttgtatttttagtagagacagggtttcatcatgttggccaggctggtctcgaactcccaacctcaagtgatctgcctgcttcagcctcccaaagtgctgagataacaggcatgggccaatgcgcctggccaatgattcttcttgtgagatctctacggtaaacgagggatatcttcaaaaaagaaggcttaaaatattcattgcatctataaggtttctctcccacaagagttccaaaagggcccattacaatcatagtattcatggaacttctattgtgtctgagctgatgtgactaatcaaaaaagctctctcatattccaagtcactgcatggactttcttccttcctgctggggtttctgatgattagtaatagctgatttctgagtaaagctttttgacattcactgcatctatagggcctctttcctgtgtgagttctctggtgaccaatgagagtttacaaagtagcgaatgctttcttacaatcactgcatttatatggtttctctcctgtatgaattctctaatgtacagtgagacaggatttaactatgatggctttattacacatgctacatttgaggagtttctcacctgtataggttctctgttatataatgagagttgacttacaggacaaaaccttcccacatccactgtatccataagatttcattcttgcatggcaagtttttcgatgcttactgagacctgtcttttgggtgaaagcttgttgaccttcattgcatcatagggtctctctcctgtgtgaattggctgatgagtcatgagatataccttactggagaaggccctatcacagtctgagcattcatatgatttatttcctatatgagttctctgatatacaatgagatttccctttgatgtgaaggctttatcacatacattgcatttgaagggtttctcacctgtatgggttctctgatgtataacaaagttttttttggaggataaaaccttcccacattcactgcattcatgggatttccttactgcatgatgagttttcttatgattgttgagatccaacttccagatgaaagcttcttgacattcactgcatccatagggtctttcttctgtatgaattcactgatgcttcataagctgagcctttttcaagaaggctttctcataatccaagcaagcatatggtttctctcctgtgtgagttctctgatgtatagttagctgtgttctaaccatgaaggctttatgatagactttgcacctgaaaggtctctctcctgaatgagttctgagatgcaaaatgaggttcgacttccaaggaaaagctttcccacatttactgcatccatagaattttccttttctatgaagaactttctgaggataactgagctcagatctggtcttcaaagctgtttgacattgaatgcattaatagggtatctctcctgtgtgaattcactgatgaatcatgaataaagccttttttgagaaggctttttcacaatctgagcaagcatatggtttctctcctgtgtgagctctctgatgtacagtgagatgtgtcctaaccacaaagcctttatcacatactttgcaaatgaacggtctctctcctgaatgatttctttgacataaaatgagttctgacttccaagggaaaacttctccacatttgctgcatgtacagactttcccttctctatgatgagttttctgatgatacacaagccctgaatttgtaatgaaggctttttgacattgattgcatcagtagggtctcactcctgtttgagtttgctgatgagcaatgagctttaactcactgggaagggctctcctaaaatcatgagattcctgggatttgtttcctgcatgagttctctgaggcatggtcatgagtagtttacaagtattcactgcacattcactgcatccatatgatttctttccaaaaagaattggttataattagcaagctctgacttctggatgttatgaaagctagtgtacgcacaacagagtaagtgagataacaagaagaggtccagaaaaaggcttcttttcccatttaccataaaaagatattagtaagatggttaaatttgagtaagctctgtattttaaataataatactatatcaatgtcaatattctgattttgatcacagtattctgattatgcaaaagaatgctcttcttcctatgaaatacacacttgggttttagggtagagttcagaaaaaccatatgtacctgtgtgtggtgtgtgtgtatagataaaataaagcaaattggtaaaatcatattttggggaaatttgcaaaaagaatgtgcaagaattttgtgtatcattttggaacatctcattaaatctagaccatttggagacaagcattttcaaaaggagaaaataaaaataaagatattgatgaaaacatacatagggacactaagtataatggcctgaatgtaaaagagataaacagtgtaatattcacccaatgccattctgcacaggactcagattcttgatctaggtgctggttgcacagtgtgctgactagaaagttacctagctgtataattacattatatgtatgttataccaaaacatttttcattaataagtaaacaaaaacgtttaggccgaaatcagggaatgctcccttgtaggaggatcctgaaaagaatttggatcttgtgctaacagtaacaggatgccattaccaatgatagtgggagcaggatgacatgtcctgatttccaatttaaaagcaacatcctgtgtgtatgtttatcagtaattaacactgaccatgtcttaaatattatggcatgaatatttttaggcttgcaccctgtgaatgagtacagatttgctacatcatatagcattttttagaccataatttagatctttccatcctccaactaagatttacctttttatatgaagctttaattactttccgcaacacttttgtcaaaatctgaagtcttttaagaaccaagatgtttctgatgtttattttaatgttcagggattttggaggtgaggggctagaaacactgactcctgcccctgactcccgcccctgactcccgcatttattttcataaatgaaaatagtaaaataaattcattaagggtattatgtggagaatagaaacaagagtaaaggactgagagtatattagagaaaactatcataattttggcaagagataatggacatcgaagcttgagtgaaaataactgttagagaaaggagtagaggacctcgagatataaggagaaagtaaagtctaaacttgctaaatggactggatttgtgggatgagtgaaacggtgaagcaaggatgacttgaagtttgagttagctattagatctccaagcaattcccaggcaaatgtaggaggataaggaaatatctagcctgtagagagaaatctgtgagtcatcaacatataaatagcattgttaagtccatgaaatcgaagaggtcacactgggaacaaagaaaagaaattaccaatgatgaagcacccttacgccctccaactctgaaggctttgggagaaggagatgcccagagaatggaaaaagtccatccatcacgctcaaacaataagtacccagaaaagaggccaacttaagtcttaggaaccaacatctgtgggaagcaagataaaatgaagtcttctcagctcttcacataaatgtaagtgctgtcactctgtttcagattcattcttctttaattctgcatgcaacagtcaatgaactttcccaaagattttttttttcttgagacggagtttcgctcttgtcacccaggctggagtgcaatggcgcaatctcagctcactgcaaccttcgcctctagggttcaagtgattctccaaccgcacctctggagtagctgggattacagggcactcgccaccatgcccagctaatttttgtatttttagtagagacagggtttcgccatgttggccaggctggtcttgaacttctgacctcaggtgatccacccacctcggcctcccaaagtgctgggattacacacgtgagccaccatgcccgcgccttcccaaagatttctaacaccatatatacaggaacaccactgtggtgagcactcccaccttctaggttgctttgatacattctcatatgattcactcaggtctgtaggaaatacaaaaatcaggccaaatatccttaccccaggataaaaggcagtgctgtgatgatgtgtcgattgtgagaatctaagtcaatataaagagagaaaaaggcacattttctttgaaacgccaaacaaaagagagcctcatcaatgatctaggtatctgtagtcaccttccaagtctttgccctgttaaacacatttggaaggggtccaaccctcatggtcagctcctttactttccaggtctcccatcttgttggttctcactcacctgaaatgcactgacctcacattttatcctctattctccatgtttgaaattaaatatcactggctgggtgcggtggctcacacttgtaatcccagcactttgggaggctgaggcgggcagatcatgaggtcaggagattgggaccatcctgaccaacatggtaaaaccccagctctactaaaaatacaaaacttagctgggtgtggtggcacacgcatgtaatcccagctactcagaaggctgaggcaggagaattgcttgaactcgggaggcagagattgcagtgagctgagatggcgccactgcactccagcctggcgacagagcaagactccatctaaaaaaaaaaaaaaattaaagatatctggtttggtagcttaagagcctgtttatgggaaatgacaaagacttgaacacttataattgggcttgatgggaggtgtctatgaacagcacagaaatgtttctggaactgacacactttcagctcggcagattcaacatctactatgacagaggctgcagtgagccaagattgcaccactgcactccaacctgggtgacagagcaagacctgtctcaaataaaaattaaaaataaaaaaaagtaaaataaatacataaggaaccacccccagctgacagccagcaaagaaacaaatctcagaattagtctgccaataccctggataagcttggaagtggattcttcccagattcttccaataagagccctgttggcccacaccttgacttcagtctttgaaacccagatcaaagaaaccagtcaagccaatccagacttctgacctaaagaactgtgagacaataaatttgtgttgtttcaagctgctaaacgtttgtgagaatctgttttggcatcaacagaaaattaatacattattgacaccagaaacatcagaaacaggccagttgtggtggctcatgcctataattccagcactttgggaggctgagatgggcaaatcacctgaggtcaggagtttgagaccaacctggccaaaatggtgaaatcccatctctactaaaaatacaaaaattagccaggcgtggtgacacacaccttaatcccagctactcaggaggctggggcaagagaatcactggaacccaagaggcagaggttgcagtgagccatgatcgtgccactgaacctgtgtgacagagtgagataagaagaaagaaagagagagagagagaaaaggaagaaggaaagaaagaagaaagaaaagaaagaatcagaaacaacttaagtacatcatacattcttacatatttattcacctgtattcacacttaaggcactctgtatgaagctacatttcctcattccacctttacctgaatcttgattttatggtttctgtttagttttccttaaatttttaaattacaaatgtatgtatttccatttaatagttatttgtcttaagccttgcaaagtcattggaaagaaaggcaaaagaaagaagcaaaacctcaccggggcttttatcgtttttttcttcggttcttaggaaaaggatatcatttctaaggtatgatctagatattgtcttttctgattctgaacatcggacaaaagatctcttttcaagagaaaagaagacatgtcagagagaggcccagcttttagaattgtgacaattactcaatttccctcccttaatgaaggacaactttttaaaaacacaaagctggccaggcgcggtggctcacacctgtaatcccagcactttgggaggctgaggtgggcggatcacaaggtcaggagttcgagaccagactggccaacatgatgaaaccccgtctctactaaaaatacaaaaaaaaaaaaaaaaattagccgggtgtggtggcaggcacctgtaatcccagctactcaggaagctgaggcaggacaatcacttgaaaccggaaggtggaggttgcagtgacccacgattacgccactgcactccagcctgggcaaaagagcgaaactccatctcaaataaacaaaaaacaaaaacaagcaaacaaacaaaaagaacaaagctagggttggaaaaagccctcagaggtcagactaatcagcaccaatgaggaatttctagtcctctacccccacccctaaatacagatacagaaaaaggcaatgagaacctggaatgtcttctcccttgcatgggatcagagccaggcaagttctggtgggagagctgacactggatttctactctgaggtctggcaggttctagtatttacagacccaagttctaaactgggaatcaagacaaagtggatggaatctgtaaatctgtgcaccagcagttgtaggtttttaagtgtgtcaaatttctttatacataaatcatcttcccacttgtaatagaagttctttttaaaagttgctgacttagtcctcaaagcactgcattgtagacactgttctagaagctttctgttaacagtgatgcagttgttaataggccagttccggacactccataggacacagacacctacacacctaaaaaagtttcatctggggtgtaaaaggagaaagtcagcagagtaaggttaggtaagacccatgccctgagtcccctccccagcctccaacatgggatccatctggcccatgagagcaggaagaacaagggcaaacatgtcccacacaacaatgggattctgtaggactgcttcccacctcagccacacagcagggcagactcaccaagaaccgactgggtctgacccaccaaagactgccccagccaaagcagaactgccagatgagctcagaattaatatgcccaaggccaattccctcataatgttgcctacagaagccccagcaagcaccggctaaggttctgactactaccgtcttcaactgccttgaacacccagatagaattcactcatgtgtgtgggggaaagaaagatagatcagactgctactgtgtctatgtagaaaaaggaagacataagaaactctattttgatctgtactaagagaaattattctgccttgagatgctgttaatctgtaaccctagcctcaaccctgtgctcgcagaaacatgtgctgtgttgactcaaggtttactagatttagggctgtgcaggatgtgctttgttaaaatgtgtttgcaggcagtatgcttggtaaaagtcatcaccattctccagtctcgagtacccagggacacaatgcactgcggaaggccgcagggacctctgcccaagaaagcctgggtatcgtccaaggtttctccccactgagacagcctgagatatggcctcgtgggaagggaaagacctgaccgtccccaagcccgatacccataaagggtctgtgctgaggaggattagtgaaagaggaaggcctctttgcagttgagataagaggaaggcatctgtctcttgctcgtccctgggaatggaatgtcttggtgtgaaacccaatcgtacattctatttgctgagataggagaaaaccaccttatggctggatgtgagacatgctggcagcgatactgttctttactgcactgagatatttgtgtaaagtcaaacataaatctggcctatgtgcacatcgaggcacagcacctttccttaaacttatttatgacacagagtccttcgctcatgtttcctgctgaccctctccccaccattaccctatagtcctgccacatccccctctccgagatggtagagatagtgatcaacaaatgctgagggaactcagagaccagtgccggtgcgggtcctccatatgctgagcaccggtcccctggggccactgttctttctctactttgtctctgtgtcttatttcttatttcttttctcagtctctcgtcccccctgacgagaaacacccacaggtgtggacgggctggaccccttcaatgtggagaaaaatggccaaaggcagatgtgtgccagaaacccctacaggggctaaacagtcaagacacaccagccgctaactagaataagttgttaggcctcctaactgtacttcccataaacctcaactgcccagcacaggtgtctcaagcactgcccatggccaaactacacttcctaggaagctcagcagccctgttcaaaagcctcagttcccagagaaggcaaagaggggctaaacaccgggtagactacactgcacaaattcagctgagcttgcttctccctctcagggaacctggtgctgattgctggtaattgcctccttctggtccctccctgggaggattaacatcctaggggcattgggtccagtgcgtagactgagcttcatctgccccttgttcaggtggggggaacccatcagtaaattatagtttttataatccacttgattcatatgggacatttatagcagctatttctaacatccttttctgctataagtgtgccacttctgggtctctactgagttttcttcatgttatggggttatattttcctgcttctttgcacacctgggtaagtttgtattggatgccagacatggtcaattactgactggtagattgctttctatttctttattagtctctgtttggaaaattgctaacttacttggaaagtatggccttttcatggcttgcatgtatgctttgtgaggagagttcgaggcagcctttactgtagagcaaatctgagccacccacagaggcaatactccttacttaaggtccactgtgattctccaaatgttaggaggcgtttccactccagctggtggaaatgcttgtgtgtaatccaaggatttttctgcgtgttcatttcttcctgttcttcctccagcctagggggggtttctcacatacatatgctgattatgactcaaaaggcttgtgggggaaactctacagaactctcaattcttgagtgcagctcttctccaataatccaattcatgaatttgggccaccttgaattcctcaaaccctaaactctgtctcaattcagagagatggctgggatctgcttgggtttctcctcccaatcctgcagactggaaactttctccaggcactaagctggggcaatcataaggctcatctcattgtttcctttctgtcatggaaagctgtcctaagccctttacttctcaatgtctgatgaagttcattcatatattttgtgcatcttttttagatatttaaggcaggagattatatacattagacatttactgtaaaagaaaaagggactgtttgggttggctatgaaaaagttagtcaatatccaggtgcattatgtcatatgcattccgtactcataatgaagtatgttagtttcttttccccccttttttagagtcagagtcttattctgtcacccacgctgtagtgcagtggcatgatcatagctcactgcagtcactgcagcctagaactcctggactcaagcaatcatcttgcctcagcctcccaagtagctgggactataggcacacaccaccatgtccagctattattatttttttttttttttgtagaggtagtctcgctatgttgcccagggtggtctcaaacttgcgggctcaagtgatcttcctgccttggcctcccaaagtgctgagattacaggtgtgagccactgtgcctggccaggtaggttaatttatataatttcagaatagatacaaatttacgtttagcaacatttcaagcaccataaatctcatgttctttttggacatttaggagttattttccagtgctgatgtgattttaacatttcaagagcatctataatgctcacatataacaatcatagcataagattctctgattatagaataaaatcttaacatacttgcctcataataagatagggagattatcctggcttatctgggttttcacagtgtaatcacaagggtcctcaaacatggaagagggagacagaacactcaagtgtttgagtgatgtaagactgattggccattgctggttttgaaaggaggccccaaaccacagaatttgggcagcttctagaagctggaagggcaaagaaagacgctcccctagagcctccaaaaagaaaagcagccctgtcaacagcttgatgtagccccgtgagatgcatttggacttcagtcctccagaactgtaagataatgattttgtgttgttttaagccattaaatttgtgttagtttggtgcaacactcataaaaaactaacacaattttacttccatatttgttatattcataggttttcattacataatactattcctggggttcaagatttcattaaacacgtccctccaagactctcaagacataaaagtatgatacatgagttaatttggtgagttgccatcatttcttactttcaagagtttttcttttctacaaattctcccatattttacgaaaaatgttttccatatccattgcctctacagttgtctatgtttctttggcacacgaggcacaatttagcgctaaaagcaccatcacaatctttcataaatattcctgtaagaattcttttgataccaattgagatatcatctccaggtaaagacttcctcataacagctgcatttctacccaacatgatttcaatggtgtttaacaggtttgacttctcacagaaatgtcctccacaaccactgcctccacagtgtttcagccctaaatgagctctctgggatataatggctggaggattcctactaaagattttcccacctttctggtatcagaagatttattctgatacaatatctgtaagatacaagatataatttattactgatggggccacattcacttcatttgtgaggcttattctctgttcaaattcctgattaactacaaaggcttgatttcttggaaaaggttgttccacaatcactacatttctgcccactaggcgctcactcttgtttaacaatggcggggttcctgaggaaggcatttctataggtactgtgttcacagtcttttgctcttgtatgagttcgctcatgtataaggaggtatgactccttgaggaaggtttctccaccgtcagtgaatttatggctgtctctcttatgtgagttttctcatgtttaatgaggactgacatgtgggcaaaggctttgccacattctctgcatgaatatggtctctctccagtgtgagtacgctgatgctgaatgagcttcgacttgcttctaaaggctttttcacactcactacattcataaggtttctctcccgtatgaatcctctgatgtctggtcaggtctgacttaaaatagaaggttcttccacaatcactgcatttataaggcttatctcctgtgtgaagtctctggtgtgcagtgaggtatgccttctgagaaaaggctttcccacacacactgcacccatagagtttctctccagtatgtgatcgctgatgtctattgagccggcacttccggctgaaggcttttccgcatttgctgcatctgtagggtttctctcctgtatgggttctctgatggaccatgagctgtgactttctggagaaggcttttccacattcactacattcatggggcttctctcctgtgtgagttctctgatgctcagtgagctgaatcttcctcatgaatgttttcccacattcaccacatccatggggtttctctcctctttcagttctctgatgttgaataagctgtgctttcctggagaaggctctcccgcacacactgcattcatgtggtttccctcctgcacaaattttttgtaggtcattgagctgtgatttagggctgctgggtttaacacatctatggtatttaactccagtaagagttttgtcacgcttgatatggaggcatgatctcccatatccaccaaatgcatcagaatcttttcctgcatatcttctactctggattacaaaacctaaatgagatttcaaacttttacaatgcgagccaaacttattgtgtctttacattaaaggaacaatgctcttacataaaccaaacttatttccaagggcataactttgttgacatctttcaaaatgtttaagctcattttggttttctgggtaccactgcatatggtaaaccccccaaatttctcctaggaaaaagcacaatatgaacatccatgataattttttgtggaggtggcagaaggtgcaaaaatgccatggttttggctggcttttataagatctcagtctcagagtaatgtacctcacactctgtgaaaaaggatgatactataaaacagcaaaaggaaaatacagcaacttcagcaacaacaatggatactctataatgaatcaatacaacttgggctgcctcccaaatcggaccttgcaaatggagacagaatagaaacagaaacacattgcaactggaataaatcaaaaatagatggaggggatggatgtattcacccaacaaacactgaatagactggtatttgggatactacagtgactaatcattattctctctctccatgaacctgtcattcaggtaaagacagagaatcaacaggtatgcaaagacgtaagaaaattacagaatgtgaagaacagtacaaaggaagtggctcacatcatagggtaagaaaaagcaatgttatgcaaagaacaaaataaagaacattccaagaaaagggaacagccagtgtgaaaacccagaggcagaaaaaacttaggtgtgataaaaaaaaaaaaatgtaagagaagctggtttacccggaatatcctgagcttgagtgaagtagaaatacaaaagtttggcaaggctggcaggattaaaaacatgaagattttggaggaagactttgttagaaactggaatttatgctaagaacaatggcagtaagccaccaaacatttttttgccaagaaaacatgttctgaattgacagttccaaaacatgactgtcctatggagaatgaattgaaaagatgaaattatagaagggaatatgctggaggttatggcagaattcagatggcttgatcaggaataattacaatggagatggagaaatgtgaaaaaacaagaacataagtatggaggaggaaaagataggattcactcttagaacacatgttcccagcagaaaagcgaagaattgaggataactgctcagtatgtggcttaaaacacctatgtaggtgctggtgccatttaataaaatgagggtaaaagaagcctcataccaaccagtaaaacacacacacaaaacaatatatgaccattactaagttagtgcagcatagacacaaaggagataaaagtcagaaaagagggtggccaggcgcagtgcttcacgtctgtagtcccagcactttgggaggtcgaggtggatgggaggagttcaagaccagtctggccaacatgctgaaaccctgtctctactaaaaatacaaaaaaaaggattagctaggcgtggtggcaggtgcctgtaatctcacctactcgggaggctgaggcaggagaatcccttgaacctgggtggcagaggttgcagtgagccaagattgggccactgcactccaacctgggcaacaaaagcaaaactctgtcacaaaaaaaaaaaaaaaaaaaaagagagagctccaaatgtgccctggcatagtcaaaaactagttcttggaagtaaaacaagagccgacagcgaaagagggcagtatctggatgtaaaaatgcaacgtgatcaaatgcacagatgtcagtcctcatgttatttgacattatctgtagcattcaataaaatatatgtcttcctcctccttggaataattttgtcacttatttcatggacatcttctgactctcccaccacaaccctgatactttttctatgtggctgggttctcctcttttgaatctctgaatatatgtggacctcttctttcttcaagcaacactcactcctcatgtcttctcatcaagttccagtgctttgatggcccctgcccagaggggaatgaagccatcacatcaaatggaactcacagaaaaagagaagtcagtcaaacgtgcagcaatggaggcgataagaacctctactaccatggcctactgtgaagtgggacttcaagagtagagtgttcaaaacaataaaaattaacaggagcagctgagacattcagacgtagaacagagtaaaccgagaagactcaaggcaactccaaggtgaccaggcaccggagtgatgagcaatacagcagaacctaaatataatgcacagggagggaaaggattttccaggaggaaagagaatcacagtttctaaccctgaagctgagggaagaagaatttcacagaatactcgtccagggtgctggcaaaatatagaataagaaggcaggtgagattacagaaaaggagatatctgcatgaagctatttgtcagaagacacagctgaaatctttagtatatgtgagtatactacatgatggtagaaacaactgggagaaaggaggattctggtttcacatcctggaagaaggaaatattcggagagctgtcctggtggctggcgacacgcagcgggttagagtgcagatgagacgttagtagcagacatgctactttgcgagtctccagcaggggccagagagctcaggccctgagagtgaattaaacttctaccaggagaatcagcagaagataaaaaaaaaaaacagaagctggaaaggcggggagcagtgggtgagtaagtcgacagagatgccccaagagacatggtgtggaggcattgacgtgagctaaggtgaggtgattttcagtgaaggaaatcaggcctttccagaggggccgggatacacttttaagcgacagaagtgctaaaagtaatgcaatccagccaggcgcagtggctcatgcctgaaatcccagcactttgggaggccaaggtgggtggttcatgaggtcaggagtttgagaccagcctggccaatgtagtgaaaactcgtctctacaaaaaatacaaaaaaattagccgggcctggtggccggcacctgtaatcccagctactcgggaggctgaggcaggagaatcacttaaacctgggaggtggaggttgcagtgagccaagatcacatcactgcactccagcccagccacagtgcgagactccgtctcaaaaaaaaaaaaaaaaaggcaacataatccagatgggttacgaggggaatttcaaagcaagtaaggaaggggcaaaagtcaggagcaggctgggaagaatggaaccaggtaagaattcaaggtcttcgatgacatggactgaaatcagatccagaaaatagaagaaaggaagacattatcctttgagagccggctctattagggatggacacagatgcagaaaggctgattaggtttctgggccaccaactactgtgaagtcctctaaagaacactttaaaagcatcaacccttctccgaccagctgggatttgcatgccatttctccccattttcttagttttcactcacttacctggacagatttgactgtgggctgctccttctgctatccctgggggttctccttgctccaacttgaagagcgaatctggcttggtgcctcgataccctgtaaatgggagatcactgaacacttggcacgtgtgcttggggaatggatgaagatggagagggttatgtctcaggaaccacagcatttgcactttgataaagcaaaactctttcactcaggaaaagagcacaaccacttcgtgccagggaggaaaataacagtctgcgtgacacacccatacccattaggatggctactatcaaaaaaacaaacagacaaacaaaaacagaaaataacaattgttggcaaagatgtggagaaactgggaccctgtgtactcttggtgggaatgtaaaatggtactgacattgtggaaaactgttcctcaaaaaattaacaatggaatgaccatatcacccagcaattccacttctgggtatataccccaaagaatggaaagcagggtctcaaagagattatttgtacacccatattcatagcaacatgattcacaagcgctaaaacatggaagcaacccagtgttccttaacagataagtggataagcaaaaggtggtatatatatatacaaaagaatattattcagccttaaaaaggaaactctggcacatgctacaacatggataaaccttgagaacatcataataagtgaaataagccagacacaaaaagacagacactatataattccacttatacgaggtacttagagaagtcaaaatcctaaagacagaaagtgaatggtggtcaccaggagctggggagaagtgggggaatgagtagttgttgttttgtgggtacagagtttcagttttagaagacagaaggtagtgttggtggctgcataacactatgtgcgcgaatgcatttaacccactgaactgcacgcttatggttaagacggtaaattttatgttatatattttaccaccacaacaaaaaatctataacatataatactttagtctaaaccattaaatatttatgggaccgtacagtggtcaccaaataagaaagaaaaggtaagtgacggcaatgctgtccttacctattgatactaggttgatgtagttctccaacattacttccttgtacaagaccttctgagactggtccaaaaactgccactcctccctggtgaagcccacagccacatcttcgaatgacaatgacccctataataacaattccaatgcaatctgaggtggataacaatagatgatgcggagaagagggacggggacatgtcttgatccttttctccatgacaacgtatgcacaccatggctatttcacataccaaaggaccatggaattccaccaattctgcctaccctaaaagcacgaaggcagtactagcatagatatgaaacaacatgtaataagactgttcattattcctttgtttctcataatgaaaaacttaccaataatctaaatgtctatcaaaagcagacagggttaaattacagcacctccatgctataatatactgcaaaaatgttaaaatcaatgaggtagatgtatacatacccacatgattatcaatgatctccaaggcagtctcttaaatgcaaaaaattaagctcccaaataatatatgatctaagacatattttaaaaatgtaataatacggctgggcgtggtggctcacacctgtaatctcagtactttgggaggccgaggtgggcagatcacaaagtcgggagattaagactatcctggctaacacagtgaaaccccatctccactaaaaatacaaaaaattagctgggcatggtggtgggcacctgtagtcccagcgacttgggaggctaaggcaggagaatggcatgaacccgggaggcagagcttgcagggagccaagattgcgccactgcactgcagcctgggcgacagagcaagactccgtctcaagaggaaaaaaaaaaaaaaagtaataatatggctgggcatggtggctcacgcctgtaatcccagcactttgggaggctgaggcagggggctcatgaggtcaggagttcgagaccagcctggccaacatggtgaaacccccatctctactaaaaatacaaaaattagcagggtgtggtggcacgcacctgtaatcccagttactcaggaggctgaggcaggagaattgcttgagcccaggaggcagaggttgcagtgagccaagattgcgccactgcactccagctctgggcgacacagcaagactccaacttggggggagaaaaaaagtaataatatttataattacatatgtataagtatacacaagtatgtatacataaatgtacataaatatgaatatattctaccagatgtcaatcacagggaggaactagatagagacccaaactatgaacacttatttagtatcctttgggttgaagtttgggcagaaaaagggtgaaaggagatactgtcttttgatacaaatgcttctgtttgcttgaatctcttgcgtgcaaatgtagccatgtatcatttcagtaattaaacatagaaaaagcaaaacaagccgaactggtgctttgttttttgaacctggagttaagaaggtaagaaagaagcattgtcagtatctgcattccaagctgttaccaaagaatggagctgttaattgtctcctgctgtctcaataacaaaaatctggatgagagaattcttcttcagggaggatcattcaaaggtcaagcagcccattcattctactggatactccaggctttatcactgggcaaagtcagatgaccagaagcctctattttcaaggcacgctattttcgaagaattttgtccaatccagttttcctttggcattactccttagcttaccccactaaacaacaggaaaaagccatagaaaacatcccatgcctttattacaaggctgactttgaggataccgtcaaccacaaaagctctctgaaggaaagaagtttctcaagctctcacagcaatgacaaatttacctcccctgaagaactgccttgctctctcctcacagacattacaatcgtggcatttttcatgtgtttcctgttatttcagctgccaaaaaaaaggagacacagtttaaagcagagaaaacccacagggtcttaacagtcacttagctatgttccgacattaagaactttcacaaaccccctgatccatatatcttgtttcttaatttgccaggattttaagattccaacttaaacttattttcccacagatcctgatttttatcagcatacactatctcatttaaccagactgtcttttacaagcttccacagacccattgggaaacaaacgacaaaataggtaaaacaaacctcacctgggccttgcccatttcgttcaactcttaggggctagcaactctagtatgttctctctcttctgtctattctgggccttcccagaagtggtggtcaggtatcatctcaggtcaagctaccactggaaatgatgatcttccccagcctggaagctccttcttccattactgaaaatgtcttgttcctataggccagaacctgtggattcaagaccaaattcaatgataagaagacatgctcctaggatcacaagtctccaattgccatctggactcacattaacatcaggttccaatatttcatctgtctccttaacaccctggaagccattacatcatggggcagtgatccagaggaagatatggaatgtgcaagaggaatgcctttttttttggttatgtcagaaatagagtggatgtgaaacaggagaaagtaaacaaaaaccacctatggtcttgtccactgccaagttctcacatatatcagttttaggtaagacaatgaaggaagtggtaaagccagacatggtggcatgtgccctagagttccagctattgtagaggctgagatgggtggatctcacctgagctccagagttcaagaccagcctggacacatggcaagactctgtctctaagaataaaaacataaaagaagtggtggctcaagaaactgacttaaaatcaccaccggcagccacatgctcctaaatttttggtttattgcactgtcttactaatcatacaaaccataagcactgtcttactaaaccctcgatactactttataaggtactcattattatttccatcctaaacatgagtaagctgaggcttgctgagacaacgtgtgttgtgcaggttaacattcttcctcattagtagcatgggaacttgaatctacatctggggtctctcccttgtgatacttccctcctacaacagccttacagtgcaaatttgttctctttcctacccacttttagaactttacttcccagcactttacactgcggggtggccacatagtcacagctacacaaacaagggcctgtgatctcctaatgcaatattcagtgtggatgctcagcctgctccttccacacagacaggaaagcaaaggcggtcccatctttgccccagaagcagcagttcagagatcagtctccccaagaaccactctagaaactcacactctgagaacacccacactgtgagaacaacttgaattttgctgtcatcccagcaagtcattctcaagactctctagcaagcctgtatcctttacacccagagagctgatctccaagccattttctgacccactggtaaacgcactggtcaagatgcaaacctcctctaccttcaatcctgagaccgcttcatcccagccccagcccttcagtctagcctccctacaggaccagtccaaaaacagtggtacccaacccaaatgcagaaatccatatggatagctaagaggtagaaaaggccattacgcatgaatgggttggagctgagatctccagggttgaaaaatccaggatccaaccattcccagaagctcatggcaggctttccctcatacataatacatcagaattgcaccaaatactcacgcggagaacatggcaatgtaaccgagaagggcaatgataccaccctgactggtaaggataatctggatttcctactgaactgaggttcaggtcaaatgtccagaggacactacctaaattaaagaggaattttcttaagaaagggggcttggttgtcagattggcagccaacagtatccaataaaaaaaaaaaaaaaactagggtctgctgtgttggctcaggcctgtaattgcagcaattctggaggtgaaggcaggagaattccttgaggccaggagttcaaaaccagcctgggcaacataccaagaccttgtctctacaaaaaaaaattaaaaatttgccaggcatggtggtgcatgcatgtagtcccaggtacttaggacggtgaggcaggaggatcgcttgagcccaggagttccaggctgaattgagtttatgaccgcatcactgcaccccaacctgggcaacacagcaagatcctgtctcaaaaaaaacaaaaggcaaaaaaaaggcttccacttcaaataaaagttaggatgcttccaaaccattacaagccctcagccttatctgcttttgggaggaatgaagcagggaggaaggaaacaggtgatttctcccatatgatgtcctacctttggatatggctgactgctgtatcagggtatcattttgtgtgggctttttaaaaaaaatttttttttttttttttttgagaaggagtctcaatctgtcgccaggctagagtgcagtagcgcgatctcagctcactgcaacctccacctcccgggttcaagcaattctctgcctcagcctcctgagtagttgggattacaggtgcccaccaccacgcccggctaatttttgtatttgtagtaaagacgaggcttcaccatctttgccaggctggtcttgaactcctgaccttgtgatccacctgcctcagcctcccaaagtgctgggattacaggtgtgagctactgtgcctggccaaattttttttttttatagagacaaggtctcgctatgttggccaggttggtcttgaactcttggcctcaagcaatcctcccacctcagcctcccaaagtgctaggattacaggcatgagcgactgctcccagcctcatggtatagtttaacttgttgttctctacctacccaactcccagtttttccttttaattaagtgagtagttcaacttagaggtttgattagtcccatgttcaatttttttaggtaagaatccttcatggatggtgctgtgtacttcctactgcaacatatgaagaggcatgagggcaaaaaaaacaaagaaaaaaaaagggggagctgttatagaattaaagagatctaagagatacaacaagcaaatcgaatgcacccacatcatttggatcatgattcaaacaatccaatgttaaaagacaatgatgagatgatcagaaaaaaactgaatgtggactaactattcaatgaactaaagaaataggctgggcacagtggctcacacctgtaaccccagtactttgggaggccgacatgggcagatcacttgaggtcaagagttcaagaccagcctggccaacaggaagaaaccccatctctacaaaaaaatacaaaaattagcctggtgtggtggcagatgcctgtaagcccagctactcgggaggctgaggcaggagaactgcttcaacctgggaagtgggaattgcagtgagccaagataacgccactgcagtccggcctcggtgacagagtgagagtccactcacccaaaaagataaggaaagaaattattattaacttggatacactgaaaatggtctaggatgggtgaagtggctcacacccgtaatcctagcactttgggaagccgaggcagaaggactgcttgagcccaggagttcaagaccagcctgggcaacatagcaagatcctgtctgtaaaagaaaaaacaaaaaggaaatggtctagtggttataaatttttttaatgaccttactggttagagattcatactgggatacgtacaagtttcaaggcatgaagccttggatttgctatgaaagtctccagactaaaacaaaagtggaggcacagataaatatgactgatatgacagatgaatatgaattgataaccattgaagctaagttatgggtaaatattatactcaatttccatgaaaaaaagttagagtcatcagagcctgatgagttctatctaatctttacagtacagagatgactccaatattatgtaacattcatcaatcacagaaaaagtgaagcctctctaacaattatataaaaccagcatttccaaacacaaatcaatagaataaaaaaaaaaagaattatagagataggtgcttttccattgattttcatccttccttcttttctaatacttgcattcaaggttataaatttcctccactgactgcttaggttaaattcaacaagggtttacatgtagaattcttattaaaatgcaattgaaaatatttccactgtgattttttgaactcagattatttagaagcgtatggcataattaacaatcattctgacaagaaaacagcatgttctgaattgatagttccaaaaagtcacatgactattctatggtgaataaatcattttgatattgatttatagcttaattccactatagttagagaaaatattctatatggttttaatcatttgaaatgtatttagacttgcctgatggccaaccatacggtgactttttataaatgtcctatgtgcatctgaggaaaattattgagtgcagtgttttatattggtcaagtttgttaattaggtatgtcattctaacctttcaggggttgggactattgtgggttagctgaatgtttttgtaaataatgttttatcagaacacagccacacccatttgtttacacattctgtacagctactttcattctataattgcagaacctagtagatgcagacaagaccatttagccggcagagactaaaatatttgtcatctgtctgcacctttacagaaagtttgccagcaatggttaatctatacccttttagctttttgtctgcctgttctctcagttactgagagaagtatgttaagaatttcccattatgattgggcatttgcggtttctccttgtgtctagcatactccattcctctatacttaacacactaagtatatgctctattgacttttttttgagatggagtttcattcttgttgcctaggctggagtgcaatggcatgatcccagctcactgcaacttctgtctcctgggttcaagtgattctcctgtctcatcctcctgagtagctgggattacagacacccgctaccacgccctgctaatttttgtatttagtagggatggggtttcatcatgttggccagatgtctcgaactcctgatctcaggtgatctatccgcctcagcctcccaaagtgctgggattacaggcgtgagctctcatgcccagccctcaatagaacttttatgcaccaaaagacatgtagaaaaacgttcatatcaacaatactcataactcccataagccataacaatgtctcttgatagtggaatggataatatggggtataatcatcaatggaatactacacagtaatgaaaaagaaacgagctactgctatatgcagcaacttagatgattttcacaacaaaaatattaagcaaaagaagccagccacaaaagaatgtgtaccttaggatttcatttatataaagatgacaaccaagcacatctatgatgtttttaagataataattacctttggagaggagagagaagatgagggcttctgggatgctacattattctatttttttaacctggtgattttcaagtataatcacttgaaaaaaacttaagagaccaatttctcttataaatgtataggcaaaaaaattttttaactttctactatgaaaaatttcaagcaaaagaacagtatactcaaattccacatattcatcatgtgacttcaagaatgacgaactcacatctaattttgttttatctataccaccattcagtccctctccagcaatggattatggattattccgaagctaatccaagatatcttttcattttttgatgcaaaaatattaaataaaattttagcaaataaaatccagtctcatattaaaagaacaaaccattattgacaagtatggtttattccctcaggaatacatgaaattgggaaatagagcaacacaaatcaaagaaaattttaaagagaaaaaaataaatgaaaataattgtaatggtcaaaagcccttaggaaagagaaataaaaacttgataaatcacagtaattatttattcagaccatactacgtacctagtactacactttgaacatacttaaagaacatttgctcacttaatcttcataatgattccatgaaaaagaaactatgacagcttttttccacaaataaggaaactgactcagagattaacgtacccaagtcagaggcagaggcaggtacttcttactccacagtccatacacttgccacctggctaaaattatttgcagatgacaaaaatgctcaactagaaaaaagacgtcaatttataagttatatgtaatgacatgagtacaatgaagtgacagaataaacatatatatttttaacttctgttcttgtcaactaagtaaaattaggaacaaaaaaggaaagggggaggggtcttatgcaaaaaaaaagtcacgatttacaacaaaaagtattaactatgtagaaataagcataaccagaaatgtccaagatacgtatggaaaaacactacagatagtcaaacaaataaaaatattgggttaatagaaatccatcacatgttcctgaaagtgttgtatctagatctacatcaattctacccaaattaaagcaaccacttgatgaaactgcagcaatttaaaaaactctcaaagagcatgtaatatgggaatacgaagttgacaagatgttattaaagacgaataaaattataccaatacctagacacctgatcccaacattaaacatgaaatacactaaaccagagttattttctggaggagtatttaaaatgatggggatgttattacttgggtcgcaatgaacctgaaaacccattttctacagaatatacagcagcagggaagcaaggggaccagcagacccctttttaagtacgcatgtgataagcaatgaacacgaactgcccagagcagtctccaacactgacacgattcgcttccccaccacgacgccctagcgctactgtgcaacgaagacctcccaagcactggttccaatgcggagaccatgggctcccagactctgggaactccaacacgactgcgaaacgaactccgagcgaggactccccgagagctccccgcaacacggacctcacgcgctagcgaacaacagaaaaaaaaaagcgcgctctccctgcccctgaaacattcccagaagcccacgcagaccagaccgatgacctgtctccactgctggaggcgagtcagggacccgaagtctctaaacactcgcctctacccgccgccccgcgaaccccacacactgcagacgcg

SEQ ID NO: 400 - DNA, 16640 bp, Homo sapiens
  source 1..16640: mol_type = genomic DNA
tttgtagaggtagtctcgctatgttgcccagggtggtctcaaacttgcgggctcaagtgatcttcctgccttggcctcccaaagtgctgagattacaggtgtgagccactgtgcctggccaggtaggttaatttatataatttcagaatagatacaaatttacgtttagcaacatttcaagcaccataaatctcatgttctttttggacatttaggagttattttccagtgctgatgtgattttaacatttcaagagcatctataatgctcacatataacaatcatagcataagattctctgattatagaataaaatcttaacatacttgcctcataataagatagggagattatcctggcttatctgggttttcacagtgtaatcacaagggtcctcaaacatggaagagggagacagaacactcaagtgtttgagtgatgtaagactgattggccattgctggttttgaaaggaggccccaaaccacagaatttgggcagcttctagaagctggaagggcaaagaaagacgctcccctagagcctccaaaaagaaaagcagccctgtcaacagcttgatgtagccccgtgagatgcatttggacttcagtcctccagaactgtaagataatgattttgtgttgttttaagccattaaatttgtgttagtttggtgcaacactcataaaaaactaacacaattttacttccatatttgttatattcataggttttcattacataatactattcctggggttcaagatttcattaaacacgtccctccaagactctcaagacataaaagtatgatacatgagttaatttggtgagttgccatcatttcttactttcaagagtttttcttttctacaaattctcccatattttacgaaaaatgttttccatatccattgcctctacagttgtctatgtttctttggcacacgaggcacaatttagcgctaaaagcaccatcacaatctttcataaatattcctgtaagaattcttttgataccaattgagatatcatctccaggtaaagacttcctcataacagctgcatttctacccaacatgatttcaatggtgtttaacaggtttgacttctcacagaaatgtcctccacaaccactgcctccacagtgtttcagccctaaatgagctctctgggatataatggctggaggattcctactaaagattttcccacctttctggtatcagaagatttattctgatacaatatctgtaagatacaagatataatttattactgatggggccacattcacttcatttgtgaggcttattctctgttcaaattcctgattaactacaaaggcttgatttcttggaaaaggttgttccacaatcactacatttctgcccactaggcgctcactcttgtttaacaatggcggggttcctgaggaaggcatttctataggtactgtgttcacagtcttttgctcttgtatgagttcgctcatgtataaggaggtatgactccttgaggaaggtttctccaccgtcagtgaatttatggctgtctctcttatgtgagttttctcatgtttaatgaggactgacatgtgggcaaaggctttgccacattctctgcatgaatatggtctctctccagtgtgagtacgctgatgctgaatgagcttcgacttgcttctaaaggctttttcacactcactacattcataaggtttctctcccgtatgaatcctctgatgtctggtcaggtctgacttaaaatagaaggttcttccacaatcactgcatttataaggcttatctcctgtgtgaagtctctggtgtgcagtgaggtatgccttctgagaaaaggctttcccacacacactgcacccatagagtttctctccagtatgtgatcgctgatgtctattgagccggcacttccggctgaaggcttttccgcatttgctgcatctgtagggtttctctcctgtatgggttctctgatggaccatgagctgtgactttctggagaaggcttttccacattcactacattcatggggcttctctcctgtgtgagttctctgatgctcagtgagctgaatcttcctcatgaatgttttcccacattcaccacatccatggggtttctctcctctttcagttctctgatgttgaataagctgtgctttcctggagaaggctctcccgcacacactgcattcatgtggtttccctcctgcacaaattttttgtaggtcattgagctgtgatttagggctgctgggtttaacacatctatggtatttaactccagtaagagttttgtcacgcttgatatggaggcatgatctcccatatccaccaaatgcatcagaatcttttcctgcatatcttctactctggattacaaaacctaaatgagatttcaaacttttacaatgcgagccaaacttattgtgtctttacattaaaggaacaatgctcttacataaaccaaacttatttccaagggcataactttgttgacatctttcaaaatgtttaagctcattttggttttctgggtaccactgcatatggtaaaccccccaaatttctcctaggaaaaagcacaatatgaacatccatgataattttttgtggaggtggcagaaggtgcaaaaatgccatggttttggctggcttttataagatctcagtctcagagtaatgtacctcacactctgtgaaaaaggatgatactataaaacagcaaaaggaaaatacagcaacttcagcaacaacaatggatactctataatgaatcaatacaacttgggctgcctcccaaatcggaccttgcaaatggagacagaatagaaacagaaacacattgcaactggaataaatcaaaaatagatggaggggatggatgtattcacccaacaaacactgaatagactggtatttgggatactacagtgactaatcattattctctctctccatgaacctgtcattcaggtaaagacagagaatcaacaggtatgcaaagacgtaagaaaattacagaatgtgaagaacagtacaaaggaagtggctcacatcatagggtaagaaaaagcaatgttatgcaaagaacaaaataaagaacattccaagaaaagggaacagccagtgtgaaaacccagaggcagaaaaaacttaggtgtgataaaaaaaaaaaaatgtaagagaagctggtttacccggaatatcctgagcttgagtgaagtagaaatacaaaagtttggcaaggctggcaggattaaaaacatgaagattttggaggaagactttgttagaaactggaatttatgctaagaacaatggcagtaagccaccaaacatttttttgccaagaaaacatgttctgaattgacagttccaaaacatgactgtcctatggagaatgaattgaaaagatgaaattatagaagggaatatgctggaggttatggcagaattcagatggcttgatcaggaataattacaatggagatggagaaatgtgaaaaaacaagaacataagtatggaggaggaaaagataggattcactcttagaacacatgttcccagcagaaaagcgaagaattgaggataactgctcagtatgtggcttaaaacacctatgtaggtgctggtgccatttaataaaatgagggtaaaagaagcctcataccaaccagtaaaacacacacacaaaacaatatatgaccattactaagttagtgcagcatagacacaaaggagataaaagtcagaaaagagggtggccaggcgcagtgcttcacgtctgtagtcccagcactttgggaggtcgaggtggatgggaggagttcaagaccagtctggccaacatgctgaaaccctgtctctactaaaaatacaaaaaaaaggattagctaggcgtggtggcaggtgcctgtaatctcacctactcgggaggctgaggcaggagaatcccttgaacctgggtggcagaggttgcagtgagccaagattgggccactgcactccaacctgggcaacaaaagcaaaactctgtcacaaaaaaaaaaaaaaaaaaaaagagagagctccaaatgtgccctggcatagtcaaaaactagttcttggaagtaaaacaagagccgacagcgaaagagggcagtatctggatgtaaaaatgcaacgtgatcaaatgcacagatgtcagtcctcatgttatttgacattatctgtagcattcaataaaatatatgtcttcctcctccttggaataattttgtcacttatttcatggacatcttctgactctcccaccacaaccctgatactttttctatgtggctgggttctcctcttttgaatctctgaatatatgtggacctcttctttcttcaagcaacactcactcctcatgtcttctcatcaagttccagtgctttgatggcccctgcccagaggggaatgaagccatcacatcaaatggaactcacagaaaaagagaagtcagtcaaacgtgcagcaatggaggcgataagaacctctactaccatggcctactgtgaagtgggacttcaagagtagagtgttcaaaacaataaaaattaacaggagcagctgagacattcagacgtagaacagagtaaaccgagaagactcaaggcaactccaaggtgaccaggcaccggagtgatgagcaatacagcagaacctaaatataatgcacagggagggaaaggattttccaggaggaaagagaatcacagtttctaaccctgaagctgagggaagaagaatttcacagaatactcgtccagggtgctggcaaaatatagaataagaaggcaggtgagattacagaaaaggagatatctgcatgaagctatttgtcagaagacacagctgaaatctttagtatatgtgagtatactacatgatggtagaaacaactgggagaaaggaggattctggtttcacatcctggaagaaggaaatattcggagagctgtcctggtggctggcgacacgcagcgggttagagtgcagatgagacgttagtagcagacatgctactttgcgagtctccagcaggggccagagagctcaggccctgagagtgaattaaacttctaccaggagaatcagcagaagataaaaaaaaaaaacagaagctggaaaggcggggagcagtgggtgagtaagtcgacagagatgccccaagagacatggtgtggaggcattgacgtgagctaaggtgaggtgattttcagtgaaggaaatcaggcctttccagaggggccgggatacacttttaagcgacagaagtgctaaaagtaatgcaatccagccaggcgcagtggctcatgcctgaaatcccagcactttgggaggccaaggtgggtggttcatgaggtcaggagtttgagaccagcctggccaatgtagtgaaaactcgtctctacaaaaaatacaaaaaaattagccgggcctggtggccggcacctgtaatcccagctactcgggaggctgaggcaggagaatcacttaaacctgggaggtggaggttgcagtgagccaagatcacatcactgcactccagcccagccacagtgcgagactccgtctcaaaaaaaaaaaaaaaaaggcaacataatccagatgggttacgaggggaatttcaaagcaagtaaggaaggggcaaaagtcaggagcaggctgggaagaatggaaccaggtaagaattcaaggtcttcgatgacatggactgaaatcagatccagaaaatagaagaaaggaagacattatcctttgagagccggctctattagggatggacacagatgcagaaaggctgattaggtttctgggccaccaactactgtgaagtcctctaaagaacactttaaaagcatcaacccttctccgaccagctgggatttgcatgccatttctccccattttcttagttttcactcacttacctggacagatttgactgtgggctgctccttctgctatccctgggggttctccttgctccaacttgaagagcgaatctggcttggtgcctcgataccctgtaaatgggagatcactgaacacttggcacgtgtgcttggggaatggatgaagatggagagggttatgtctcaggaaccacagcatttgcactttgataaagcaaaactctttcactcaggaaaagagcacaaccacttcgtgccagggaggaaaataacagtctgcgtgacacacccatacccattaggatggctactatcaaaaaaacaaacagacaaacaaaaacagaaaataacaattgttggcaaagatgtggagaaactgggaccctgtgtactcttggtgggaatgtaaaatggtactgacattgtggaaaactgttcctcaaaaaattaacaatggaatgaccatatcacccagcaattccacttctgggtatataccccaaagaatggaaagcagggtctcaaagagattatttgtacacccatattcatagcaacatgattcacaagcgctaaaacatggaagcaacccagtgttccttaacagataagtggataagcaaaaggtggtatatatatatacaaaagaatattattcagccttaaaaaggaaactctggcacatgctacaacatggataaaccttgagaacatcataataagtgaaataagccagacacaaaaagacagacactatataattccacttatacgaggtacttagagaagtcaaaatcctaaagacagaaagtgaatggtggtcaccaggagctggggagaagtgggggaatgagtagttgttgttttgtgggtacagagtttcagttttagaagacagaaggtagtgttggtggctgcataacactatgtgcgcgaatgcatttaacccactgaactgcacgcttatggttaagacggtaaattttatgttatatattttaccaccacaacaaaaaatctataacatataatactttagtctaaaccattaaatatttatgggaccgtacagtggtcaccaaataagaaagaaaaggtaagtgacggcaatgctgtccttacctattgatactaggttgatgtagttctccaacattacttccttgtacaagaccttctgagactggtccaaaaactgccactcctccctggtgaagcccacagccacatcttcgaatgacaatgacccctataataacaattccaatgcaatctgaggtggataacaatagatgatgcggagaagagggacggggacatgtcttgatccttttctccatgacaacgtatgcacaccatggctatttcacataccaaaggaccatggaattccaccaattctgcctaccctaaaagcacgaaggcagtactagcatagatatgaaacaacatgtaataagactgttcattattcctttgtttctcataatgaaaaacttaccaataatctaaatgtctatcaaaagcagacagggttaaattacagcacctccatgctataatatactgcaaaaatgttaaaatcaatgaggtagatgtatacatacccacatgattatcaatgatctccaaggcagtctcttaaatgcaaaaaattaagctcccaaataatatatgatctaagacatattttaaaaatgtaataatacggctgggcgtggtggctcacacctgtaatctcagtactttgggaggccgaggtgggcagatcacaaagtcgggagattaagactatcctggctaacacagtgaaaccccatctccactaaaaatacaaaaaattagctgggcatggtggtgggcacctgtagtcccagcgacttgggaggctaaggcaggagaatggcatgaacccgggaggcagagcttgcagggagccaagattgcgccactgcactgcagcctgggcgacagagcaagactccgtctcaagaggaaaaaaaaaaaaaaagtaataatatggctgggcatggtggctcacgcctgtaatcccagcactttgggaggctgaggcagggggctcatgaggtcaggagttcgagaccagcctggccaacatggtgaaacccccatctctactaaaaatacaaaaattagcagggtgtggtggcacgcacctgtaatcccagttactcaggaggctgaggcaggagaattgcttgagcccaggaggcagaggttgcagtgagccaagattgcgccactgcactccagctctgggcgacacagcaagactccaacttggggggagaaaaaaagtaataatatttataattacatatgtataagtatacacaagtatgtatacataaatgtacataaatatgaatatattctaccagatgtcaatcacagggaggaactagatagagacccaaactatgaacacttatttagtatcctttgggttgaagtttgggcagaaaaagggtgaaaggagatactgtcttttgatacaaatgcttctgtttgcttgaatctcttgcgtgcaaatgtagccatgtatcatttcagtaattaaacatagaaaaagcaaaacaagccgaactggtgctttgttttttgaacctggagttaagaaggtaagaaagaagcattgtcagtatctgcattccaagctgttaccaaagaatggagctgttaattgtctcctgctgtctcaataacaaaaatctggatgagagaattcttcttcagggaggatcattcaaaggtcaagcagcccattcattctactggatactccaggctttatcactgggcaaagtcagatgaccagaagcctctattttcaaggcacgctattttcgaagaattttgtccaatccagttttcctttggcattactccttagcttaccccactaaacaacaggaaaaagccatagaaaacatcccatgcctttattacaaggctgactttgaggataccgtcaaccacaaaagctctctgaaggaaagaagtttctcaagctctcacagcaatgacaaatttacctcccctgaagaactgccttgctctctcctcacagacattacaatcgtggcatttttcatgtgtttcctgttatttcagctgccaaaaaaaaggagacacagtttaaagcagagaaaacccacagggtcttaacagtcacttagctatgttccgacattaagaactttcacaaaccccctgatccatatatcttgtttcttaatttgccaggattttaagattccaacttaaacttattttcccacagatcctgatttttatcagcatacactatctcatttaaccagactgtcttttacaagcttccacagacccattgggaaacaaacgacaaaataggtaaaacaaacctcacctgggccttgcccatttcgttcaactcttaggggctagcaactctagtatgttctctctcttctgtctattctgggccttcccagaagtggtggtcaggtatcatctcaggtcaagctaccactggaaatgatgatcttccccagcctggaagctccttcttccattactgaaaatgtcttgttcctataggccagaacctgtggattcaagaccaaattcaatgataagaagacatgctcctaggatcacaagtctccaattgccatctggactcacattaacatcaggttccaatatttcatctgtctccttaacaccctggaagccattacatcatggggcagtgatccagaggaagatatggaatgtgcaagaggaatgcctttttttttggttatgtcagaaatagagtggatgtgaaacaggagaaagtaaacaaaaaccacctatggtcttgtccactgccaagttctcacatatatcagttttaggtaagacaatgaaggaagtggtaaagccagacatggtggcatgtgccctagagttccagctattgtagaggctgagatgggtggatctcacctgagctccagagttcaagaccagcctggacacatggcaagactctgtctctaagaataaaaacataaaagaagtggtggctcaagaaactgacttaaaatcaccaccggcagccacatgctcctaaatttttggtttattgcactgtcttactaatcatacaaaccataagcactgtcttactaaaccctcgatactactttataaggtactcattattatttccatcctaaacatgagtaagctgaggcttgctgagacaacgtgtgttgtgcaggttaacattcttcctcattagtagcatgggaacttgaatctacatctggggtctctcccttgtgatacttccctcctacaacagccttacagtgcaaatttgttctctttcctacccacttttagaactttacttcccagcactttacactgcggggtggccacatagtcacagctacacaaacaagggcctgtgatctcctaatgcaatattcagtgtggatgctcagcctgctccttccacacagacaggaaagcaaaggcggtcccatctttgccccagaagcagcagttcagagatcagtctccccaagaaccactctagaaactcacactctgagaacacccacactgtgagaacaacttgaattttgctgtcatcccagcaagtcattctcaagactctctagcaagcctgtatcctttacacccagagagctgatctccaagccattttctgacccactggtaaacgcactggtcaagatgcaaacctcctctaccttcaatcctgagaccgcttcatcccagccccagcccttcagtctagcctccctacaggaccagtccaaaaacagtggtacccaacccaaatgcagaaatccatatggatagctaagaggtagaaaaggccattacgcatgaatgggttggagctgagatctccagggttgaaaaatccaggatccaaccattcccagaagctcatggcaggctttccctcatacataatacatcagaattgcaccaaatactcacgcggagaacatggcaatgtaaccgagaagggcaatgataccaccctgactggtaaggataatctggatttcctactgaactgaggttcaggtcaaatgtccagaggacactacctaaattaaagaggaattttcttaagaaagggggcttggttgtcagattggcagccaacagtatccaataaaaaaaaaaaaaaaactagggtctgctgtgttggctcaggcctgtaattgcagcaattctggaggtgaaggcaggagaattccttgaggccaggagttcaaaaccagcctgggcaacataccaagaccttgtctctacaaaaaaaaattaaaaatttgccaggcatggtggtgcatgcatgtagtcccaggtacttaggacggtgaggcaggaggatcgcttgagcccaggagttccaggctgaattgagtttatgaccgcatcactgcaccccaacctgggcaacacagcaagatcctgtctcaaaaaaaacaaaaggcaaaaaaaaggcttccacttcaaataaaagttaggatgcttccaaaccattacaagccctcagccttatctgcttttgggaggaatgaagcagggaggaaggaaacaggtgatttctcccatatgatgtcctacctttggatatggctgactgctgtatcagggtatcattttgtgtgggctttttaaaaaaaatttttttttttttttttttgagaaggagtctcaatctgtcgccaggctagagtgcagtagcgcgatctcagctcactgcaacctccacctcccgggttcaagcaattctctgcctcagcctcctgagtagttgggattacaggtgcccaccaccacgcccggctaatttttgtatttgtagtaaagacgaggcttcaccatctttgccaggctggtcttgaactcctgaccttgtgatccacctgcctcagcctcccaaagtgctgggattacaggtgtgagctactgtgcctggccaaattttttttttttatagagacaaggtctcgctatgttggccaggttggtcttgaactcttggcctcaagcaatcctcccacctcagcctcccaaagtgctaggattacaggcatgagcgactgctcccagcctcatggtatagtttaacttgttgttctctacctacccaactcccagtttttccttttaattaagtgagtagttcaacttagaggtttgattagtcccatgttcaatttttttaggtaagaatccttcatggatggtgctgtgtacttcctactgcaacatatgaagaggcatgagggcaaaaaaaacaaagaaaaaaaaagggggagctgttatagaattaaagagatctaagagatacaacaagcaaatcgaatgcacccacatcatttggatcatgattcaaacaatccaatgttaaaagacaatgatgagatgatcagaaaaaaactgaatgtggactaactattcaatgaactaaagaaataggctgggcacagtggctcacacctgtaaccccagtactttgggaggccgacatgggcagatcacttgaggtcaagagttcaagaccagcctggccaacaggaagaaaccccatctctacaaaaaaatacaaaaattagcctggtgtggtggcagatgcctgtaagcccagctactcgggaggctgaggcaggagaactgcttcaacctgggaagtgggaattgcagtgagccaagataacgccactgcagtccggcctcggtgacagagtgagagtccactcacccaaaaagataaggaaagaaattattattaacttggatacactgaaaatggtctaggatgggtgaagtggctcacacccgtaatcctagcactttgggaagccgaggcagaaggactgcttgagcccaggagttcaagaccagcctgggcaacatagcaagatcctgtctgtaaaagaaaaaacaaaaaggaaatggtctagtggttataaatttttttaatgaccttactggttagagattcatactgggatacgtacaagtttcaaggcatgaagccttggatttgctatgaaagtctccagactaaaacaaaagtggaggcacagataaatatgactgatatgacagatgaatatgaattgataaccattgaagctaagttatgggtaaatattatactcaatttccatgaaaaaaagttagagtcatcagagcctgatgagttctatctaatctttacagtacagagatgactccaatattatgtaacattcatcaatcacagaaaaagtgaagcctctctaacaattatataaaaccagcatttccaaacacaaatcaatagaataaaaaaaaaaagaattatagagataggtgcttttccattgattttcatccttccttcttttctaatacttgcattcaaggttataaatttcctccactgactgcttaggttaaattcaacaagggtttacatgtagaattcttattaaaatgcaattgaaaatatttccactgtgattttttgaactcagattatttagaagcgtatggcataattaacaatcattctgacaagaaaacagcatgttctgaattgatagttccaaaaagtcacatgactattctatggtgaataaatcattttgatattgatttatagcttaattccactatagttagagaaaatattctatatggttttaatcatttgaaatgtatttagacttgcctgatggccaaccatacggtgactttttataaatgtcctatgtgcatctgaggaaaattattgagtgcagtgttttatattggtcaagtttgttaattaggtatgtcattctaacctttcaggggttgggactattgtgggttagctgaatgtttttgtaaataatgttttatcagaacacagccacacccatttgtttacacattctgtacagctactttcattctataattgcagaacctagtagatgcagacaagaccatttagccggcagagactaaaatatttgtcatctgtctgcacctttacagaaagtttgccagcaatggttaatctatacccttttagctttttgtctgcctgttctctcagttactgagagaagtatgttaagaatttcccattatgattgggcatttgcggtttctccttgtgtctagcatactccattcctctatacttaacacactaagtatatgctctattgacttttttttgagatggagtttcattcttgttgcctaggctggagtgcaatggcatgatcccagctcactgcaacttctgtctcctgggttcaagtgattctcctgtctcatcctcctgagtagctgggattacagacacccgctaccacgccctgctaatttttgtatttagtagggatggggtttcatcatgttggccagatgtctcgaactcctgatctcaggtgatctatccgcctcagcctcccaaagtgctgggattacaggcgtgagctctcatgcccagccctcaatagaacttttatgcaccaaaagacatgtagaaaaacgttcatatcaacaatactcataactcccataagccataacaatgtctcttgatagtggaatggataatatggggtataatcatcaatggaatactacacagtaatgaaaaagaaacgagctactgctatatgcagcaacttagatgattttcacaacaaaaatattaagcaaaagaagccagccacaaaagaatgtgtaccttaggatttcatttatataaagatgacaaccaagcacatctatgatgtttttaagataataattacctttggagaggagagagaagatgagggcttctgggatgctacattattctatttttttaacctggtgattttcaagtataatcacttgaaaaaaacttaagagaccaatttctcttataaatgtataggcaaaaaaattttttaactttctactatgaaaaatttcaagcaaaagaacagtatactcaaattccacatattcatcatgtgacttcaagaatgacgaactcacatctaattttgttttatctataccaccattcagtccctctccagcaatggattatggattattccgaagctaatccaagatatcttttcattttttgatgcaaaaatattaaataaaattttagcaaataaaatccagtctcatattaaaagaacaaaccattattgacaagtatggtttattccctcaggaatacatgaaattgggaaatagagcaacacaaatcaaagaaaattttaaagagaaaaaaataaatgaaaataattgtaatggtcaaaagcccttaggaaagagaaataaaaacttgataaatcacagtaattatttattcagaccatactacgtacctagtactacactttgaacatacttaaagaacatttgctcacttaatcttcataatgattccatgaaaaagaaactatgacagcttttttccacaaataaggaaactgactcagagattaacgtacccaagtcagaggcagaggcaggtacttcttactccacagtccatacacttgccacctggctaaaattatttgcagatgacaaaaatgctcaactagaaaaaagacgtcaatttataagttatatgtaatgacatgagtacaatgaagtgacagaataaacatatatatttttaacttctgttcttgtcaactaagtaaaattaggaacaaaaaaggaaagggggaggggtcttatgcaaaaaaaaagtcacgatttacaacaaaaagtattaactatgtagaaataagcataaccagaaatgtccaagatacgtatggaaaaacactacagatagtcaaacaaataaaaatattgggttaatagaaatccatcacatgttcctgaaagtgttgtatctagatctacatcaattctacccaaattaaagcaaccacttgatgaaactgcagcaatttaaaaaactctcaaagagcatgtaatatgggaatacgaagttgacaagatgttattaaagacgaataaaattataccaatacctagacacctgatcccaacattaaacatgaaatacactaaaccagagttattttctggaggagtatttaaaatgatggggatgttattacttgggtcgcaatgaacctgaaaacccattttctacagaatatacagcagcagggaagcaaggggaccagcagacccctttttaagtacgcatgtgataagcaatgaacacgaactgcccagagcagtctccaacactgacacgattcgcttccccaccacgacgccctagcgctactgtgcaacgaagacctcccaagcactggttccaatgcggagaccatgggctcccagactctgggaactccaacacgactgcgaaacgaactccgagcgaggactccccgagagctccccgcaacacggacctcacgcgctagcgaacaacagaaaaaaaaaagcgcgctctccctgcccctgaaacattcccagaagcccacgcagaccagaccgatgacctgtctccactgctggaggcgagtcagggacccgaagtctctaaacactcgcctctacccgccgccccgcgaaccccacacactgcagacgcg

SEQ ID NO: 401 - DNA, 16680 bp, Homo sapiens
  source 1..16680: mol_type = genomic DNA
tttgtagaggtagtctcgctatgttgcccagggtggtctcaaacttgcgggctcaagtgatcttcctgccttggcctcccaaagtgctgagattacaggtgtgagccactgtgcctggccaggtaggttaatttatataatttcagaatagatacaaatttacgtttagcaacatttcaagcaccataaatctcatgttctttttggacatttaggagttattttccagtgctgatgtgattttaacatttcaagagcatctataatgctcacatataacaatcatagcataagattctctgattatagaataaaatcttaacatacttgcctcataataagatagggagattatcctggcttatctgggttttcacagtgtaatcacaagggtcctcaaacatggaagagggagacagaacactcaagtgtttgagtgatgtaagactgattggccattgctggttttgaaaggaggccccaaaccacagaatttgggcagcttctagaagctggaagggcaaagaaagacgctcccctagagcctccaaaaagaaaagcagccctgtcaacagcttgatgtagccccgtgagatgcatttggacttcagtcctccagaactgtaagataatgattttgtgttgttttaagccattaaatttgtgttagtttggtgcaacactcataaaaaactaacacaattttacttccatatttgttatattcataggttttcattacataatactattcctggggttcaagatttcattaaacacgtccctccaagactctcaagacataaaagtatgatacatgagttaatttggtgagttgccatcatttcttactttcaagagtttttcttttctacaaattctcccatattttacgaaaaatgttttccatatccattgcctctacagttgtctatgtttctttggcacacgaggcacaatttagcgctaaaagcaccatcacaatctttcataaatattcctgtaagaattcttttgataccaattgagatatcatctccaggtaaagacttcctcataacagctgcatttctacccaacatgatttcaatggtgtttaacaggtttgacttctcacagaaatgtcctccacaaccactgcctccacagtgtttcagccctaaatgagctctctgggatataatggctggaggattcctactaaagattttcccacctttctggtatcagaagatttattctgatacaatatctgtaagatacaagatataatttattactgatggggccacattcacttcatttgtgaggcttattctctgttcaaattcctgattaactacaaaggcttgatttcttggaaaaggttgttccacaatcactacatttctgcccactaggcgctcactcttgtttaacaatggcggggttcctgaggaaggcatttctataggtactgtgttcacagtcttttgctcttgtatgagttcgctcatgtataaggaggtatgactccttgaggaaggtttctccaccgtcagtgaatttatggctgtctctcttatgtgagttttctcatgtttaatgaggactgacatgtgggcaaaggctttgccacattctctgcatgaatatggtctctctccagtgtgagtacgctgatgctgaatgagcttcgacttgcttctaaaggctttttcacactcactacattcataaggtttctctcccgtatgaatcctctgatgtctggtcaggtctgacttaaaatagaaggttcttccacaatcactgcatttataaggcttatctcctgtgtgaagtctctggtgtgcagtgaggtatgccttctgagaaaaggctttcccacacacactgcacccatagagtttctctccagtatgtgatcgctgatgtctattgagccggcacttccggctgaaggcttttccgcatttgctgcatctgtagggtttctctcctgtatgggttctctgatggaccatgagctgtgactttctggagaaggcttttccacattcactacattcatggggcttctctcctgtgtgagttctctgatgctcagtgagctgaatcttcctcatgaatgttttcccacattcaccacatccatggggtttctctcctctttcagttctctgatgttgaataagctgtgctttcctggagaaggctctcccgcacacactgcattcatgtggtttccctcctgcacaaattttttgtaggtcattgagctgtgatttagggctgctgggtttaacacatctatggtatttaactccagtaagagttttgtcacgcttgatatggaggcatgatctcccatatccaccaaatgcatcagaatcttttcctgcatatcttctactctggattacaaaacctaaatgagatttcaaacttttacaatgcgagccaaacttattgtgtctttacattaaaggaacaatgctcttacataaaccaaacttatttccaagggcataactttgttgacatctttcaaaatgtttaagctcattttggttttctgggtaccactgcatatggtaaaccccccaaatttctcctaggaaaaagcacaatatgaacatccatgataattttttgtggaggtggcagaaggtgcaaaaatgccatggttttggctggcttttataagatctcagtctcagagtaatgtacctcacactctgtgaaaaaggatgatactataaaacagcaaaaggaaaatacagcaacttcagcaacaacaatggatactctataatgaatcaatacaacttgggctgcctcccaaatcggaccttgcaaatggagacagaatagaaacagaaacacattgcaactggaataaatcaaaaatagatggaggggatggatgtattcacccaacaaacactgaatagactggtatttgggatactacagtgactaatcattattctctctctccatgaacctgtcattcaggtaaagacagagaatcaacaggtatgcaaagacgtaagaaaattacagaatgtgaagaacagtacaaaggaagtggctcacatcatagggtaagaaaaagcaatgttatgcaaagaacaaaataaagaacattccaagaaaagggaacagccagtgtgaaaacccagaggcagaaaaaacttaggtgtgataaaaaaaaaaaaatgtaagagaagctggtttacccggaatatcctgagcttgagtgaagtagaaatacaaaagtttggcaaggctggcaggattaaaaacatgaagattttggaggaagactttgttagaaactggaatttatgctaagaacaatggcagtaagccaccaaacatttttttgccaagaaaacatgttctgaattgacagttccaaaacatgactgtcctatggagaatgaattgaaaagatgaaattatagaagggaatatgctggaggttatggcagaattcagatggcttgatcaggaataattacaatggagatggagaaatgtgaaaaaacaagaacataagtatggaggaggaaaagataggattcactcttagaacacatgttcccagcagaaaagcgaagaattgaggataactgctcagtatgtggcttaaaacacctatgtaggtgctggtgccatttaataaaatgagggtaaaagaagcctcataccaaccagtaaaacacacacacaaaacaatatatgaccattactaagttagtgcagcatagacacaaaggagataaaagtcagaaaagagggtggccaggcgcagtgcttcacgtctgtagtcccagcactttgggaggtcgaggtggatgggaggagttcaagaccagtctggccaacatgctgaaaccctgtctctactaaaaatacaaaaaaaaggattagctaggcgtggtggcaggtgcctgtaatctcacctactcgggaggctgaggcaggagaatcccttgaacctgggtggcagaggttgcagtgagccaagattgggccactgcactccaacctgggcaacaaaagcaaaactctgtcacaaaaaaaaaaaaaaaaaaaaagagagagctccaaatgtgccctggcatagtcaaaaactagttcttggaagtaaaacaagagccgacagcgaaagagggcagtatctggatgtaaaaatgcaacgtgatcaaatgcacagatgtcagtcctcatgttatttgacattatctgtagcattcaataaaatatatgtcttcctcctccttggaataattttgtcacttatttcatggacatcttctgactctcccaccacaaccctgatactttttctatgtggctgggttctcctcttttgaatctctgaatatatgtggacctcttctttcttcaagcaacactcactcctcatgtcttctcatcaagttccagtgctttgatggcccctgcccagaggggaatgaagccatcacatcaaatggaactcacagaaaaagagaagtcagtcaaacgtgcagcaatggaggcgataagaacctctactaccatggcctactgtgaagtgggacttcaagagtagagtgttcaaaacaataaaaattaacaggagcagctgagacattcagacgtagaacagagtaaaccgagaagactcaaggcaactccaaggtgaccaggcaccggagtgatgagcaatacagcagaacctaaatataatgcacagggagggaaaggattttccaggaggaaagagaatcacagtttctaaccctgaagctgagggaagaagaatttcacagaatactcgtccagggtgctggcaaaatatagaataagaaggcaggtgagattacagaaaaggagatatctgcatgaagctatttgtcagaagacacagctgaaatctttagtatatgtgagtatactacatgatggtagaaacaactgggagaaaggaggattctggtttcacatcctggaagaaggaaatattcggagagctgtcctggtggctggcgacacgcagcgggttagagtgcagatgagacgttagtagcagacatgctactttgcgagtctccagcaggggccagagagctcaggccctgagagtgaattaaacttctaccaggagaatcagcagaagataaaaaaaaaaaacagaagctggaaaggcggggagcagtgggtgagtaagtcgacagagatgccccaagagacatggtgtggaggcattgacgtgagctaaggtgaggtgattttcagtgaaggaaatcaggcctttccagaggggccgggatacacttttaagcgacagaagtgctaaaagtaatgcaatccagccaggcgcagtggctcatgcctgaaatcccagcactttgggaggccaaggtgggtggttcatgaggtcaggagtttgagaccagcctggccaatgtagtgaaaactcgtctctacaaaaaatacaaaaaaattagccgggcctggtggccggcacctgtaatcccagctactcgggaggctgaggcaggagaatcacttaaacctgggaggtggaggttgcagtgagccaagatcacatcactgcactccagcccagccacagtgcgagactccgtctcaaaaaaaaaaaaaaaaaggcaacataatccagatgggttacgaggggaatttcaaagcaagtaaggaaggggcaaaagtcaggagcaggctgggaagaatggaaccaggtaagaattcaaggtcttcgatgacatggactgaaatcagatccagaaaatagaagaaaggaagacattatcctttgagagccggctctattagggatggacacagatgcagaaaggctgattaggtttctgggccaccaactactgtgaagtcctctaaagaacactttaaaagcatcaacccttctccgaccagctgggatttgcatgccatttctccccattttcttagttttcactcacttacctggacagatttgactgtgggctgctccttctgctatccctgggggttctccttgctccaacttgaagagcgaatctggcttggtgcctcgataccctgtaaatgggagatcactgaacacttggcacgtgtgcttggggaatggatgaagatggagagggttatgtctcaggaaccacagcatttgcactttgataaagcaaaactctttcactcaggaaaagagcacaaccacttcgtgccagggaggaaaataacagtctgcgtgacacacccatacccattaggatggctactatcaaaaaaacaaacagacaaacaaaaacagaaaataacaattgttggcaaagatgtggagaaactgggaccctgtgtactcttggtgggaatgtaaaatggtactgacattgtggaaaactgttcctcaaaaaattaacaatggaatgaccatatcacccagcaattccacttctgggtatataccccaaagaatggaaagcagggtctcaaagagattatttgtacacccatattcatagcaacatgattcacaagcgctaaaacatggaagcaacccagtgttccttaacagataagtggataagcaaaaggtggtatatatatatacaaaagaatattattcagccttaaaaaggaaactctggcacatgctacaacatggataaaccttgagaacatcataataagtgaaataagccagacacaaaaagacagacactatataattccacttatacgaggtacttagagaagtcaaaatcctaaagacagaaagtgaatggtggtcaccaggagctggggagaagtgggggaatgagtagttgttgttttgtgggtacagagtttcagttttagaagacagaaggtagtgttggtggctgcataacactatgtgcgcgaatgcatttaacccactgaactgcacgcttatggttaagacggtaaattttatgttatatattttaccaccacaacaaaaaatctataacatataatactttagtctaaaccattaaatatttatgggaccgtacagtggtcaccaaataagaaagaaaaggtaagtgacggcaatgctgtccttacctattgatactaggttgatgtagttctccaacattacttccttgtacaagaccttctgagactggtccaaaaactgccactcctccctggtgaagcccacagccacatcttcgaatgacaatgacccctataataacaattccaatgcaatctgaggtggataacaatagatgatgcggagaagagggacggggacatgtcttgatccttttctccatgacaacgtatgcacaccatggctatttcacataccaaaggaccatggaattccaccaattctgcctaccctaaaagcacgaaggcagtactagcatagatatgaaacaacatgtaataagactgttcattattcctttgtttctcataatgaaaaacttaccaataatctaaatgtctatcaaaagcagacagggttaaattacagcacctccatgctataatatactgcaaaaatgttaaaatcaatgaggtagatgtatacatacccacatgattatcaatgatctccaaggcagtctcttaaatgcaaaaaattaagctcccaaataatatatgatctaagacatattttaaaaatgtaataatacggctgggcgtggtggctcacacctgtaatctcagtactttgggaggccgaggtgggcagatcacaaagtcgggagattaagactatcctggctaacacagtgaaaccccatctccactaaaaatacaaaaaattagctgggcatggtggtgggcacctgtagtcccagcgacttgggaggctaaggcaggagaatggcatgaacccgggaggcagagcttgcagggagccaagattgcgccactgcactgcagcctgggcgacagagcaagactccgtctcaagaggaaaaaaaaaaaaaaagtaataatatggctgggcatggtggctcacgcctgtaatcccagcactttgggaggctgaggcagggggctcatgaggtcaggagttcgagaccagcctggccaacatggtgaaacccccatctctactaaaaatacaaaaattagcagggtgtggtggcacgcacctgtaatcccagttactcaggaggctgaggcaggagaattgcttgagcccaggaggcagaggttgcagtgagccaagattgcgccactgcactccagctctgggcgacacagcaagactccaacttggggggagaaaaaaagtaataatatttataattacatatgtataagtatacacaagtatgtatacataaatgtacataaatatgaatatattctaccagatgtcaatcacagggaggaactagatagagacccaaactatgaacacttatttagtatcctttgggttgaagtttgggcagaaaaagggtgaaaggagatactgtcttttgatacaaatgcttctgtttgcttgaatctcttgcgtgcaaatgtagccatgtatcatttcagtaattaaacatagaaaaagcaaaacaagccgaactggtgctttgttttttgaacctggagttaagaaggtaagaaagaagcattgtcagtatctgcattccaagctgttaccaaagaatggagctgttaattgtctcctgctgtctcaataacaaaaatctggatgagagaattcttcttcagggaggatcattcaaaggtcaagcagcccattcattctactggatactccaggctttatcactgggcaaagtcagatgaccagaagcctctattttcaaggcacgctattttcgaagaattttgtccaatccagttttcctttggcattactccttagcttaccccactaaacaacaggaaaaagccatagaaaacatcccatgcctttattacaaggctgactttgaggataccgtcaaccacaaaagctctctgaaggaaagaagtttctcaagctctcacagcaatgacaaatttacctcccctgaagaactgccttgctctctcctcacagacattacaatcgtggcatttttcatgtgtttcctgttatttcagctgccaaaaaaaaggagacacagtttaaagcagagaaaacccacagggtcttaacagtcacttagctatgttccgacattaagaactttcacaaaccccctgatccatatatcttgtttcttaatttgccaggattttaagattccaacttaaacttattttcccacagatcctgatttttatcagcatacactatctcatttaaccagactgtcttttacaagcttccacagacccattgggaaacaaacgacaaaataggtaaaacaaacctcacctgggccttgcccatttcgttcaactcttaggggctagcaactctagtatgttctctctcttctgtctattctgggccttcccagaagtggtggtcaggtatcatctcaggtcaagctaccactggaaatgatgatcttccccagcctggaagctccttcttccattactgaaaatgtcttgttcctataggccagaacctgtggattcaagaccaaattcaatgataagaagacatgctcctaggatcacaagtctccaattgccatctggactcacattaacatcaggttccaatatttcatctgtctccttaacaccctggaagccattacatcatggggcagtgatccagaggaagatatggaatgtgcaagaggaatgcctttttttttggttatgtcagaaatagagtggatgtgaaacaggagaaagtaaacaaaaaccacctatggtcttgtccactgccaagttctcacatatatcagttttaggtaagacaatgaaggaagtggtaaagccagacatggtggcatgtgccctagagttccagctattgtagaggctgagatgggtggatctcacctgagctccagagttcaagaccagcctggacacatggcaagactctgtctctaagaataaaaacataaaagaagtggtggctcaagaaactgacttaaaatcaccaccggcagccacatgctcctaaatttttggtttattgcactgtcttactaatcatacaaaccataagcactgtcttactaaaccctcgatactactttataaggtactcattattatttccatcctaaacatgagtaagctgaggcttgctgagacaacgtgtgttgtgcaggttaacattcttcctcattagtagcatgggaacttgaatctacatctggggtctctcccttgtgatacttccctcctacaacagccttacagtgcaaatttgttctctttcctacccacttttagaactttacttcccagcactttacactgcggggtggccacatagtcacagctacacaaacaagggcctgtgatctcctaatgcaatattcagtgtggatgctcagcctgctccttccacacagacaggaaagcaaaggcggtcccatctttgccccagaagcagcagttcagagatcagtctccccaagaaccactctagaaactcacactctgagaacacccacactgtgagaacaacttgaattttgctgtcatcccagcaagtcattctcaagactctctagcaagcctgtatcctttacacccagagagctgatctccaagccattttctgacccactggtaaacgcactggtcaagatgcaaacctcctctaccttcaatcctgagaccgcttcatcccagccccagcccttcagtctagcctccctacaggaccagtccaaaaacagtggtacccaacccaaatgcagaaatccatatggatagctaagaggtagaaaaggccattacgcatgaatgggttggagctgagatctccagggttgaaaaatccaggatccaaccattcccagaagctcatggcaggctttccctcatacataatacatcagaattgcaccaaatactcacgcggagaacatggcaatgtaaccgagaagggcaatgataccaccctgactggtaaggataatctggatttcctactgaactgaggttcaggtcaaatgtccagaggacactacctaaattaaagaggaattttcttaagaaagggggcttggttgtcagattggcagccaacagtatccaataaaaaaaaaaaaaaaactagggtctgctgtgttggctcaggcctgtaattgcagcaattctggaggtgaaggcaggagaattccttgaggccaggagttcaaaaccagcctgggcaacataccaagaccttgtctctacaaaaaaaaattaaaaatttgccaggcatggtggtgcatgcatgtagtcccaggtacttaggacggtgaggcaggaggatcgcttgagcccaggagttccaggctgaattgagtttatgaccgcatcactgcaccccaacctgggcaacacagcaagatcctgtctcaaaaaaaacaaaaggcaaaaaaaaggcttccacttcaaataaaagttaggatgcttccaaaccattacaagccctcagccttatctgcttttgggaggaatgaagcagggaggaaggaaacaggtgatttctcccatatgatgtcctacctttggatatggctgactgctgtatcagggtatcattttgtgtgggctttttaaaaaaaatttttttttttttttttttgagaaggagtctcaatctgtcgccaggctagagtgcagtagcgcgatctcagctcactgcaacctccacctcccgggttcaagcaattctctgcctcagcctcctgagtagttgggattacaggtgcccaccaccacgcccggctaatttttgtatttgtagtaaagacgaggcttcaccatctttgccaggctggtcttgaactcctgaccttgtgatccacctgcctcagcctcccaaagtgctgggattacaggtgtgagctactgtgcctggccaaattttttttttttatagagacaaggtctcgctatgttggccaggttggtcttgaactcttggcctcaagcaatcctcccacctcagcctcccaaagtgctaggattacaggcatgagcgactgctcccagcctcatggtatagtttaacttgttgttctctacctacccaactcccagtttttccttttaattaagtgagtagttcaacttagaggtttgattagtcccatgttcaatttttttaggtaagaatccttcatggatggtgctgtgtacttcctactgcaacatatgaagaggcatgagggcaaaaaaaacaaagaaaaaaaaagggggagctgttatagaattaaagagatctaagagatacaacaagcaaatcgaatgcacccacatcatttggatcatgattcaaacaatccaatgttaaaagacaatgatgagatgatcagaaaaaaactgaatgtggactaactattcaatgaactaaagaaataggctgggcacagtggctcacacctgtaaccccagtactttgggaggccgacatgggcagatcacttgaggtcaagagttcaagaccagcctggccaacaggaagaaaccccatctctacaaaaaaatacaaaaattagcctggtgtggtggcagatgcctgtaagcccagctactcgggaggctgaggcaggagaactgcttcaacctgggaagtgggaattgcagtgagccaagataacgccactgcagtccggcctcggtgacagagtgagagtccactcacccaaaaagataaggaaagaaattattattaacttggatacactgaaaatggtctaggatgggtgaagtggctcacacccgtaatcctagcactttgggaagccgaggcagaaggactgcttgagcccaggagttcaagaccagcctgggcaacatagcaagatcctgtctgtaaaagaaaaaacaaaaaggaaatggtctagtggttataaatttttttaatgaccttactggttagagattcatactgggatacgtacaagtttcaaggcatgaagccttggatttgctatgaaagtctccagactaaaacaaaagtggaggcacagataaatatgactgatatgacagatgaatatgaattgataaccattgaagctaagttatgggtaaatattatactcaatttccatgaaaaaaagttagagtcatcagagcctgatgagttctatctaatctttacagtacagagatgactccaatattatgtaacattcatcaatcacagaaaaagtgaagcctctctaacaattatataaaaccagcatttccaaacacaaatcaatagaataaaaaaaaaaagaattatagagataggtgcttttccattgattttcatccttccttcttttctaatacttgcattcaaggttataaatttcctccactgactgcttaggttaaattcaacaagggtttacatgtagaattcttattaaaatgcaattgaaaatatttccactgtgattttttgaactcagattatttagaagcgtatggcataattaacaatcattctgacaagaaaacagcatgttctgaattgatagttccaaaaagtcacatgactattctatggtgaataaatcattttgatattgatttatagcttaattccactatagttagagaaaatattctatatggttttaatcatttgaaatgtatttagacttgcctgatggccaaccatacggtgactttttataaatgtcctatgtgcatctgaggaaaattattgagtgcagtgttttatattggtcaagtttgttaattaggtatgtcattctaacctttcaggggttgggactattgtgggttagctgaatgtttttgtaaataatgttttatcagaacacagccacacccatttgtttacacattctgtacagctactttcattctataattgcagaacctagtagatgcagacaagaccatttagccggcagagactaaaatatttgtcatctgtctgcacctttacagaaagtttgccagcaatggttaatctatacccttttagctttttgtctgcctgttctctcagttactgagagaagtatgttaagaatttcccattatgattgggcatttgcggtttctccttgtgtctagcatactccattcctctatacttaacacactaagtatatgctctattgacttttttttgagatggagtttcattcttgttgcctaggctggagtgcaatggcatgatcccagctcactgcaacttctgtctcctgggttcaagtgattctcctgtctcatcctcctgagtagctgggattacagacacccgctaccacgccctgctaatttttgtatttagtagggatggggtttcatcatgttggccagatgtctcgaactcctgatctcaggtgatctatccgcctcagcctcccaaagtgctgggattacaggcgtgagctctcatgcccagccctcaatagaacttttatgcaccaaaagacatgtagaaaaacgttcatatcaacaatactcataactcccataagccataacaatgtctcttgatagtggaatggataatatggggtataatcatcaatggaatactacacagtaatgaaaaagaaacgagctactgctatatgcagcaacttagatgattttcacaacaaaaatattaagcaaaagaagccagccacaaaagaatgtgtaccttaggatttcatttatataaagatgacaaccaagcacatctatgatgtttttaagataataattacctttggagaggagagagaagatgagggcttctgggatgctacattattctatttttttaacctggtgattttcaagtataatcacttgaaaaaaacttaagagaccaatttctcttataaatgtataggcaaaaaaattttttaactttctactatgaaaaatttcaagcaaaagaacagtatactcaaattccacatattcatcatgtgacttcaagaatgacgaactcacatctaattttgttttatctataccaccattcagtccctctccagcaatggattatggattattccgaagctaatccaagatatcttttcattttttgatgcaaaaatattaaataaaattttagcaaataaaatccagtctcatattaaaagaacaaaccattattgacaagtatggtttattccctcaggaatacatgaaattgggaaatagagcaacacaaatcaaagaaaattttaaagagaaaaaaataaatgaaaataattgtaatggtcaaaagcccttaggaaagagaaataaaaacttgataaatcacagtaattatttattcagaccatactacgtacctagtactacactttgaacatacttaaagaacatttgctcacttaatcttcataatgattccatgaaaaagaaactatgacagcttttttccacaaataaggaaactgactcagagattaacgtacccaagtcagaggcagaggcaggtacttcttactccacagtccatacacttgccacctggctaaaattatttgcagatgacaaaaatgctcaactagaaaaaagacgtcaatttataagttatatgtaatgacatgagtacaatgaagtgacagaataaacatatatatttttaacttctgttcttgtcaactaagtaaaattaggaacaaaaaaggaaagggggaggggtcttatgcaaaaaaaaagtcacgatttacaacaaaaagtattaactatgtagaaataagcataaccagaaatgtccaagatacgtatggaaaaacactacagatagtcaaacaaataaaaatattgggttaatagaaatccatcacatgttcctgaaagtgttgtatctagatctacatcaattctacccaaattaaagcaaccacttgatgaaactgcagcaatttaaaaaactctcaaagagcatgtaatatgggaatacgaagttgacaagatgttattaaagacgaataaaattataccaatacctagacacctgatcccaacattaaacatgaaatacactaaaccagagttattttctggaggagtatttaaaatgatggggatgttattacttgggtcgcaatgaacctgaaaacccattttctacagaatatacagcagcagggaagcaaggggaccagcagacccctttttaagtacgcatgtgataagcaatgaacacgaactgcccagagcagtctccaacactgacacgattcgcttccccaccacgacgccctagcgctactgtgcaacgaagacctcccaagcactggttccaatgcggagaccatgggctcccagactctgggaactccaacacgactgcgaaacgaactccgagcgaggactccccgagagctccccgcaacacggacctcacgcgctagcgaacaacagaaaaaaaaaagcgcgctctccctgcccctgaaacattcccagaagcccacgcagaccagaccgatgacctgtctccactgctggaggcgagtcagggacccgaagtctctaaacactcgcctctacccgccgccccgcgaaccccacacactgcagacgcgacactcgcaagtttcggggatggcggccggcgagggccat

SEQ ID NO: 402 - DNA, 15818 bp, Homo sapiens
  source 1..15818: mol_type = genomic DNA
tactgtaagattattttattatacagtaagtgatataatgtccttgaagttagaatgataagttcatgattttctttcagtcagttcaggctactagaaaaaatacaccatagactgactgactgccttaacaaacattcatttctcacgttccagaggctgaggagtctctagaactggactctaaaacacaatcaaggtgttggcaggtctagtgtccagtgagagtccatttcctggtttatgcatggtcatctcattctgtcttcacatggcaaagagcagagaaagagaaaacaaactctcttctgtgttgtctcataagacacataatctcatcatgagggttccactttcaagatgtaattaccttccaaaggtcacacttcctaatgccatcccttagggattaggacttcaacatgtaaatttggagaggacataaatatgcaatccctcacaatgatgtatgctataaaatctcaaggaatcaaatgacaaggatttacagttaataagccaacaaaggagacaatatgtaatataaacacactcagctactctaagggaaagcagaaaaagaagaaaaggagaacaaagaagacatagaataaacaacaaatagtaagttagtaatttaaacctaaaaacatcaatacattgaacgtaaatgatctaaataccccagtaaaaagacagagattgttaactggataaaaaaggaaggcccaactgtatgttgcccactaaacacccactttaaatatgaaagcataaataggttaaaagtaaaaccatgataaataaagatatgaaagatataacagggaaaaacccatgtcaaattattagaggttaaaaattacaatttctgagagaaaacatactttggatgggattaatgacagattaaacactgtggaaaaaagattagtgaactgaaagacatagctatgagaactataaaaaatgaaataatgaagggtaaaataataaaaagcatgaacatcattttcatgtacatatgtgtatacacaaaaagatttgtgaacttgaacaaggcaagagatacaatctaaactacaaagagaacaaaagctaacccctaccttggcccccggagtaagagatatcattctgaggaacaccaagtggaagcctctaaaactgcccccctccccagccaaactctatgatcaagatagtaaatgaaaaacaatattgtgggaggggtagtgaggtttataagatataaaaaagtaaaatatatttcatatcttgtaaaccctactatacatattagtgcagggagccaaaggcccatgggacatgacaaactcagcattccgctggaggctatatgatcaaacagcaaactgtttatcatgaatgcaggatgtgggcaaactcacactgccctgccaccattgccacagttaccatattaacagggcttttcccctgcacatgttcactaggacttaagctgtgacttgctgtggaaggattttccaccttcactgaatccccccgtttctcccttgagtgtattctcttatgtttaacaaggcaagacatatagaagtaagctttctcacactcatcacagccatagggtctctctcccgtgtgagttctgtgatgtacaatgagcattgtctttgtaaggaaggctttcccacagtcactgcatttatagggtttctctcctgagtgaattttctgatgtctaatgagtcctgacttctgtgaacagggttgcccacattcaggacatacaaagggagtctttcctgtatgatatctctgatgtgctacaaggcaagacttctggctgaaggccttgccacagtcaatgcatccataaggtttctctccagtgtgagttcgttgatgtatgttgagattgcccttctgaatgaagccttttccacattcactgcatgtatgaggcttctctcctgtatgagttcgctgatgtacaacgagtagtgattttctggagaaagctctcccacattcgctgcattgatggggcttaattcccgtgtgaatcctttgatgttcagtaagctcagatttcctggggaaggctttcccacattcactgcacccgtatggtttctctcctttgtgagctctctcgtgttcagtgagcctgtacctcttgtagaaggctttcccacacaagctacacccgtggggtttctctcctctgtgagctctctcgtgttcagtgagcctgtacttcttgtagaaggctttcccacacaagctacacacgtggggtttctttcctgtatgaattctcttatgctcagtgagctgagacttcttgaggaaagctttcccacagtcagtgcattcatgggctttctctatgttgtgtgtttgctgatgtttaaggaattgtgacttggtgctgatgggttttctactttcagggaattcaatttccgtaggcatttgttcatgattatcatggagaaaagctccatctccattaaactcagcaggctcctttctgttgtatcttctgctctggttggttaaacctaaatatgatttcaaagttcttccgtgttcatagcgttgtcccgtcctcttcagtattttttggttttgcaagggctgctgcagatgatcatcagctttctcaatttctaagagagagaacaataaatccttccatgatcatcacacggaataaaactgcttcaaagatgccttggggttggctggctttttactggaacccctataataccaacatggaaggaattccaagtataagtgttccctatctgttaaaaaaacttttaagaattgtagttaaatacatataagataaaatttgccagctgggtgcggtggcttatgcctgtaatcccagcactttgagaggccaaggcgggtggatcacaaggtcaagagatcaagaccatcctggccaacatggtgaaaccccatctctactaaaaatacaaaaaaattggctgggcgtggtggcacgtgcctgtagtcccagctactcaggaggttgaggcaggaaaatcgcttgaacctgggagacagaggttgtagcaagccaagatcgctccactgcactccagtctgccaacagagcaagactccatctcaaaaaaaaaaaaaaaatttgccagccaggcacagtggctcatgcctgtaatcccagcactttgggagggtgaggtgggaagatcacttgagcccaggagtttgagaccagcctgggctacaatagggagactgtctctacaaaaactttttttttaatttaaaaaagaataatcctgagtagggaaacagcagacataggtagtagaataaatatcccagaaaggcaagttagaatgttggatacacagcctttgacttcatcctaatcctattagactgttgggtgctaaaatatgcccttctccattctgtagaccatcatcacgctaactttcctagagcaccaatctcatatttccaggaaaactgcagtcaatactctaacctttgttaaaacagagatcacaagactgatggaacagactctttgtagcaataagataccaaactataaactaggtctaaggacatacaggtaagggttaagtcacacaccccctacatttaaagaataaactatgttctaactgccacgagtgttttttgttttgttttgttttgtttctttttctgtagcagctaaacaaacactggccttgggacaagcaatattgaaacaattgcagctcccggaccaccagatgctgactaactgatgcccctcacccccaacagcattccacaggccataactgcagctatgattggacaggagactgatctcaatatccttctcctgataaacaccagctgttttggtcagctgccggagtctgtgcagacttttcttatatcctgtaaaagacctgctagcatacagtcaaattccacctcattttaatgttaaaactccactccaaaatgaaagtggattatatgttacatatatgtttgctcactatgcacatgtttgctgattctcataaagatattcataagactccccatctctcactgaataggtatgcaaagcaaatcctagaaggcaaaaagcctcctgcaaggcaaaaaaaaaaaagtttcccctcttcagtgatgtgtgttttttccacttcctcaaagtcacaccactcagatctgcgaatcatcttttgttagaatataaagtttctctttgcctcctcaattttttggttaacaccttgtatctacctggctatgatatattctcatatgttccaacagaaagagaaacagggtgatccctatggactttcagaacatgcaagcagaacacgtggtcctctccacacagctctgccactgcaccaaatatggaaactgtcaccttcttcatcatgccctacttgcacagatgtcatattggattttttttccactttgctgtccctaatatactaattcctcaccttgccactaacagcctctactctctgaattttgtacttatgtctctgttggcatcggtgaatggagccctcaaggaccacctccctacttctgaatcaagacttgaggcagctttacttttagtttttcttagaacatcagctatacagtatgattgctatagtactgccaccaggtgaaaggtaagctctacctagagctagaaaaatacaaaactttacctccaccactaccctgaattactggcacagaaaattcacagcaggagctgaacaataaaagttttaccattaccatgacgcatccactttaagttcccacttcaccatttcccagcaaatatcttctaactgtggcctccatgtgaccagtttcaagctaatcttttttttttctttttttttgagatggagtcttgctctgtcacccaggctggagtacagtggcacgatcttggctcacttcaacctccgcctcccaggttcaagcaattctcctgcctcagtctcccgagcagctgggatgacaggcacgtgccaccacgcctggctaattttttgtattttatgtagagacagggtttcaccacattggccagactggtctcaaactcctgacctcaggtgatctgcccaactcggcctcccaaagtgctgggattacaggcatgagccaccgcacccggccttcaggctaatcttctgacagtccccacatggccttgcatttccagttctacaacttcttgtcatatgtcttcatcttaattcaatacctagctatgtctcttgcataagatattttatcagtctgtctttctccatcttgtctagaccactgtaggttacatttcttctaaagtcctacaattctttctgtatttactattcactttaactttgtatagccctgaattgtaacaaaaacatttcacacgttcaaaagtttaatttgtaaatattacataaaaatttgccctatttttgctaacaaaatctttgctcaagaaagacatttctgtttctcactaaattcagtctcttctactgtgtattatggctacagttcatcaactcataaaaacagcccccgagagagcttcatgtaaagacacgcccaggcccccaactcaattctaacaaaaccagactcacagagcaagaggccttggtatggacagtgtcatgaaaactcctttaataaagatctagcctttaagaaatgcttaatagatggaaaagtatgacctctcttcagcctggctaatctgtccttcgatgaagaaatgcatgaatgaccaagatgtatttcaatcttacatgaagaagaatgaaaaccaggcccttgactccagagtagcaaaggaacctcaagcaccaccaaatcacactgatgtggtatctatgggagtggcttgtgtgtgattgggatgcaaagtagaatgggaatttagacatggaagatattattatattgtagtgtattaaaaaccatttcatgaaaagaaaattcaaggtgaaaaatacatagtgtcagaatgtgaaaaacaaaccataatcacataccgatgcctcagtttttttgtttttttgtttttcgtttctttttgttttttgaaacagagtctcactctgtcacccaggctggagtgaaatggcgcgatctcagctcactgcaacctctgcctcctgggttcaagtaattctcctgcctcagcctcctgagtagctgggactacaggcacatgtcaccacgcccggctaatttttgtatttttagtagagatggggtttcaccatgttggcaaagctggtctcaaactcctgactttgtgatccgcccgcctcagcctcccaaagtgctgggattacaggtgtgagccaccatgcccggcctcctatgcctcagttcttatctcacttgatgaatcagtaactctagacaatgcttatggcactctttctccctctctctcttatataaatgtatatatacatataaatatataaagtatatatataaatgtatatacacacatacacacacacatacacatatatacacacacgcatatacatataaatgctgttctagcaaattaatcaaacttgaggagagggtcttgggaacccctactttacagctggttggtcagaagctgaggtgacaacctgggacttgccactggcatctgaagtgggacacagtcttggactgagcccttaaccggtgggatctgatgccgtatcaggtagatagggtcagagctgatttgaaacagacgatacccagctgatgtctgctggagaattgcctgggctgtgagaaaacaacccctatatatccagtggcataaatgctgtgttgagtgactatgtgacagagaaaaaaacagtttgtcgtttttgcctcagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggtatgtatgcttctctgaattcctataagaaaaagagctcttgtatcctaggggagaagaagatgtggcagctgtttctgtctccctagacactttcacaactgtcatgccttctctaaatgaccagaatgtgacttccgctgccttcccctcttgctggttctctctcacttacctgggtgggctggactgtggatttcatcttctagtgtccatagtggttctccttgttccaacttggtgagggcatcaggtttgccggcttgataccctgtttgtgggaaatgggagaagacttaggctcactgaattgcaccacgtggctctgatgataggagaaaggtacatgttagggactgcataatttgcatgttagcaaattaaaggctttttttctaagacgaaggaagattatgcctcttcctgtgggaccagagacgggcctgaggatctgccatttgggagcacagcagacataccaaagcttccagaagctgagaaagcaaaggccactgactgggtaccctctgagtgacacagggcagctgtcctcacccactgacacaaggttgctgtagttctccaacatcacatcccggtacaggtccttctgagcagggctcaggaactgccactcctcccaggtgaagtccacagccacatcctccagggtcagtgattcctgtaataacacagtcctgcttaatatgtttctcttttattgacatggaagaaatatgaagttgttcggcccattttcaccacataagctgcacctgcacagttgtcccttggtatactcaatggaatggtttcaggatgccccacatataccgaaattgtgcatactcatgacctacagttggcctagtggaatctgcttatgttactctgtataagcgagtttcacatcctgagaatactatatttttgattcaagtttggatataagtggacccttgcagtacaaattcatgttcacaaataaactgtattcctagttttttaaatatactgtgaaagaagcaaagtcatagtaaaatattctatattttataataaccatgcagccatccattaatccaacaaatcataagtttctgtaatatgcagccattaaatcctcttgctaacatgagaatgtctgcagtgtttttcagcacctacttgcaaccctaaactatatgctacagtcatatagtacgtgcagaataatctagcatgacccccttcatgtaaactataccatgatatttagcaaaacaacaaataaactatgcagtggccataaaaaataagccatcatacatgtaagcattgacatgcatagatacatgtatatgtatacaacgcatgtatacacacacatacacacgcatgcagacatagatgtcctcacaggtaaatccctagaacaggaagacaagcatttgttagtgacatactagggaattaggaaaaaaagtatacagagggggaactttgttttcacactatgtgtactatttaacttgagtctttcacattgaaaatctatccatgaggccgggcatgatgtctcacgcctgtaaacccagcactttgggaggcaaaggtgggcggatcacccgaggtcaggagtttgagaccagcctggctaacatggctaaacatggtctctactaaaaatacaaaaattaggtgggcatggtggcacctagatgaagcatgagaatcgcttgaacccaggatgcagaggttgcagtgagcgaagatcacgccactgcactccagcctgggcaacaaagtaagactgtctcaaaaaaaaaaaaaaaaaaaactatgaatctgtggttctttctgacaccaaatacacagtgtcttttccagcaacactttctctgatgccaactgggtatcctagagttcgatgctatgctaacactaaccgctgagggttatcatcagactctgcaggtttcagggctcggtcccacaagactgccctcacatcatgtgccactctggggtccccacgttatcacacttctgtccaacttgaccacaactggaggttgccacaacctccctgctcaggttcgataatttgctagaatgactcacagaactcaggaaaatgtcacacaattacagtttattatataggatacaaatgacagccaggtaaagaggtacagaagtcaaggtccaaagggtgccaagcacaggagcctctgatcccatggaattgcagtgcccccttcccccaccccccacttccacatgtgatctccaaaccccatgggggtttttatggagcttctacgacgtgggcatgattaaatcatcaaccatggctgggtgcggtggctcacacctgtaatcccaacactttgggaggccgaggtgggcagatcatgaggtcaagagatcgagaccatcctggccaagatattgaaaccctgtctctactaaaaaaaaaaaaaaattagctgggtgtggtggtttgtacctgtggttccagctactcaggaggctgaggcaggagaattgcttgaacccagaaggtggaggatgcagtgagccgaggttgcaccactgcactccagcctggcaacagagcaagactccatctcattaaaaaataaaaaataaaaaaaagaaatcatcaaccattggtcacagaatctggaggtcgggggtgggactgaaagtcccaactctgtaatcaaggcttggtctttctggcaaccagccccatcctgaggttgtctaggagcccattctgagccacctcattaccataaactcaggtgtggttgaaaggcactggttatgaagaacaaaatacactcctatcactcaggaaattccaaaggttttaggagctctgtgccaagaaccagagacagagaccaaatatatatacgtgtaaaaccataatgagtcatttgcataattttttaagttaaggcattaaaagaggtgagaggttaataactggatttgaacacagggaagggctctgtattttctgagacaacatgacattctaaagcaaaccctgtggatctcaacaacccaagccattgccaaagagaactttcaactccctttggtcaaatctgtacttaaacaccagtttagtgacctgttcatggagctcctttgaaagcaaaccttgcattttttaggcaattaggtttactcacagataaacacagactgcaacaaggttgggtatataggccgcagtgctgtgagctctggaaaaactgtgttcattaaacccttcttggtatagtcccatagaggactcagaataatcatgtagaaacagtcacacaaaacttgcttgtgtatcttttggaaaaatgctgttaaggacaaaaagtctatcttgtcacctctagcaaaaagcatcaaactaatttcccaagatttaagtgccatgaaatactgacatcccctgaggaacggacccgctttctcctcagaatcagtgcacatcatgtaacttaccatgattctctgggtgtgatggtggccaaagattttggacacaagctgacacttaatgtagccaacagggtctggcagagtcgcacattatattccaacactggtcacatgtgaactatgtgaacaaagtatttgtgatcccactttgtcctggattaaaggtacagtctaagtctgtttctccccagagctcattttttccaatttatacttttaatgtaaatgaactgatttcttcagacttccacaaatccatcagggaatcgagttaagaataaaacaaaccaaaagttacctgggcctttgtcattttcttctgtttcaggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacattccctccgggcccagatgctgtctctgctgctgtaaactctcctgcagtcaaggccaagcaatatatctaagcatccctttgtcaggtgtccccaagtctttacatcccagggcaataaaacaacactctgaatgtggggagtcatatggcagtgggcttaaccaggagccggcatatctggccactttccaatgcttcaaaggagtgtctttctccttaagcacagtgtttataaataagagagcaggtcacgctctggtcatgagaacgtgatggtaataaggaggctttcctcctcagaggcctcctgtgattttccaaaacttattgtcccatatttttatggccagtttatgccagcaccccataagcctttttcccaacaatcgtgagacacacagagaagaaacacacaggtaaaagagaaggccatgtgaagatggaggcagagactggagtgatgctgccacaagccaaggacacctgagagtctgttagaaaaggggagacaggtgaatgaatgtgggcagctgtgccggagcccctcaagaccactcccagatgcagtgattcactaggtgaactcacaacactcagtctataattatattcatggcaaccacttattactgtgaaaacatacacagcaaaaccagcaaaggtaaaaggtacatgtggcaaagtctggaggaaaccagacataagtttcaagttcagtctctttggagtcacacaggatacacttaattccccgagccacaagtcatgacaacacacgtgaaatgctatagaccaaggaagtttattagagagagattgtgtgccatggtttttattgggggctgatcgtgaaggtgctcactgcctaacattcaccaaaactccagaatcctagaggaaagcatgtgttcaggataaatcacattgtttgaaaaaaacagcttaggcacagtgagccactcttattaggaaatagtgggactgcctccaaaaatctaagctcccaaatgccagctgctatggtttgaatgtttgtgtcctccaaaattcatgttgaaacttaatctccaatgcaatggtatcaagaggtgggcttttagtaagtgattaggtcatgagggctcctcccttgtgagtggcattaaggcccttataaaagaggctttggccaggcacagtggctcatgcatgtaatcccagcactttgggaggctgaggtgggaggatcgcttgaggccaggagtttgaggctgcagtgagttgtgattgcaccactgcactctagcctgggcaacagagcaagaccctgtctcttaaaaataaaaaaataaaaaaaaataaaggccgagcgtgttggctcacacctgtaatcccagtactttgggaggccaaggtgggcagatcacttgagctcaggacttggcaacatggtgaaaccccatctctataaaacatacaaaaattattcaagcatggtggcacatgcctgtattcccagctactcagatggctgcggcaggaggactgcttgagcctgggaggttgagaggttgagactgcagtgagttaggatggtgccactgcactgcaggctgggtgacaaagtgagactctgtatcaaaaaaaaaaaaaaaaaaaaacctaaagaaagaagaaataataataaaaataaaagaggcttcacacacagatcggccctttctgctcttctgccttctgccatgtgagggcaccgcattcttcacctccaaagaaatagcgacaaaacaccatattgaaagcagaaatcaggccctcaccagacaccaaacctgctggtgcttcgatcttagacttctcagtctccagaactataacaaataaatttctgttgtttataaattatccagtctcagctatcttgttatagcagcaccaacaaggctaagacagcatcctataatttaattcagtctgagactgtgtatctagatatagtgtcagacaccacagattaagggctcagttcaagcctgcccccaacttcagacgcaagttgcaagcagcaggttgtcacctgtacctctgatggaccagctataaatcaggattcacacggcctcctcctcaggttcgattaatttgctggatggctcacagaactcaggaaagcacttaacatttactggtttatttcaactcttttcctgtctagaaaaacgaagtgcagctcactgccagcgcttatttcattttacataaacatgctctttgaggctgcagtaaatctgattttcaatgtgaaaataaaatataaaagctgttctaggagttatttctaaacagaactaacatcagaatcatctgaatcatcagaattctcgatttggaatcatcagaattctcgatttggtaaaaatcggatccatccagtgagtcttcagccaagaactgtttgagaatgatgttaacatcacatgtaggaatgctacgttttctaggatttgacattttcagtgatcgagaactactacattttgtaaatggaaataccactactaaaaacagaatgctataagtagaatgatgtcttttgtttcccaaggcgacctactagagcgatgtgaaaataataaaagtgagatcgttcatggcaaagttatctcggggtaaatgctccagctgcaagcaccaaaggtgagtattctcagggcaaatgggaaaaggaataaaggatattacgaaggatacagatgaagaggcagatggaagggatagcacagagcaaggtttgtagcaaggggcgtgggacttccatgccctccacggaagcttattagagactcagttcaccaccctcaggcacctccacatgctcaagaatctgtaagttccccagaagttcaccagtccttttgagtttttacgctggtttcattatgtgggcatacttgattaaaacactaaccactggtgatcaactcaaccttcaacttccctgttgccaggcagagctaaaatttccaaccctcaaatgacatggttagttgccctggcaaccagcctcccccgtcctaaggccagccagaagcccccagtcaccagccatctcaatgccacacaaaaaggcactgtttactgaagaggttccaaggcttttgggagacatgtgccaggaaacaggacaaagatcgattatacatttcttataaatcgtaacaatcatagctaggcgcgatggctcatgcctataatcccagcactttggaaggccgaggcgggcagatcacctgaggtcaggagttcaagaccagcctggccaacgtggtgaaagcctgtctctactaaaaatacaaaaattagccgggcgtggtggcgggcgcctgtaatcccagccactcgggaggctgaggcaggacagtcgctagaacccaggaggcggaggttgcagtgagctgagatcgcaccactgcactccagactggacaacagagctagattccgtctgggggataggaggaaactttgatccccaaatgctcaaggagactgatgcttaagcaaactaaatattgcctgagaacgactccatacttctatatttgagtccttgtggataaactgcaacctagcttaacagacaaaattgaaaaccgaacttaatcgtatgcacctgtaacaatagctgagtggtggccagtcccagcggccatactcatagactgctgaatgttccaactgcgttcaaataaggcaaacgccgaatggtaaccaatctcactgtttctggacctcgcttccgattcctgtatgtcactttaccttttttgtctataaatttgttctgaccacgaggcacccctggagtctctgttaatctgctgtgattctgggggctgcccaattcgcgaatcgttcattgctcaaggaaactcctgtaaatttaattcggcttcaatttttcttttatcactgatttgagtaataataaaactccggtctccccgcacagccggctctgcatgaattgctctttctccattgcaatttccctgtcttaacaagtcggctctgtctaggcagccggcaagggtgggcggttatagtttcacaactcaaccccagccaggggcctgggcttgtaaaataccagattttacaagcctctgagccccacatgcctgggcctccccgaaacacttaacacacatccccgattcaccccaaaacctacaccacacaccctcgtacgctgcccagcaccccggcttcatcaccgactttaaactgcagcatttggagtgataataatggcgtcggtgataaagccggcgtgctgggcagcgtccccctagagttctccatccagtgatccagaggcctactaacagagtgaccctcagagaccccaaactctgacgccgagtctcagtcgctgaactcgacagacctttaacgcccgaccacaagaactctcccacgccggaccgcaaaggcaccccaacccaaaggctccaccgcccaggccgccagctctccccacaggctcctcagaagctccctacccctttaacctactccacggagagacccaaacactcacctgattttcttctggctacacctaaattccctgaatgcttcctttcctggcccttaaaccccggcactggcctatggcggcggacgagggcgcgagtcaattctgccgcgctaggacgatgggacatgggcttctcttc

SEQ ID NO: 403 - DNA, 18324 bp, Homo sapiens
  source 1..18324: mol_type = genomic DNA
ctcggccgccgtaggccggcttggaggctgggggagggcccagaagtggaataattcaggaaagtgcaggttctgggaagtctcggtgggttccccgcaaaatcaggtctgtgtgtgggtctgtctgtcaggatgaggggaggagggtgtctgtgggcgtccgtttagtgcggagccgtggagtttgtgggggaagcgggagcaagtgggagtcggggtattggggttggggcgtctccggagtcagccctgagggatcccagtggtcggtggtcagagtctgtccagagcaacacttggaagtccgtgatcagggtttggtgcctttgcgggtcactctgtagggctcggtgattgaggactggagtgaggagtggtttttgtcaaggaaaactgtgtctgcttcggattcggggttttattttttatttttgagacagggtctcgctctgtcacacaggcttgagtgcagtggcgcaatcgtggctcactgcagcctccatctcccggggctcaggtgattttcccacctcagctttcccgagtagctgggactacaggtgagcgccaccacgctatctatctatctatctatctatctaatctgtctaatctaatctatctatctatctatctatctatctaatttatctatctaatctatctgtttattgcagagacgggggtctcactatgttgcccaggctggtctccaactcctggcctcaaacgatcctctcaccttggcctcccaaagtgctgggattacgggcgtgagccttcgctccaggctgtaatcaggatttaatatgcgactcagtgaggaggagcccgggttcatgtgaacctaggtgtgtggtccaggtttttggattaatctaagggggtgtgaccatgttagggaggtctagatgtgacagtcgtggagaagcttgtgaaggctgaagccttggcagccagggcatcctgattggtgtgtgtgttcaggtccaacggtacattccctctcagtcccttttaagtttctctgcaaggactggtttacaaatctcatttgacttctcacatctctcctttctctcatcctggtaaataggaaagctttggggaagatcaaagattaatcaaatctaaaatggtaaggtggcctggcgcggtggctcacgcctatattcccagcatttgggaggccaaagtgggcgaattgctcgagcctagaagttggagatcagcctgaacaacatagcctgtctctccaaaaaatacaaatattaactgggtgtggtaacacacgcctgtagtctcagctactcgggaggctgaggtgggacgatcacgtgaccccgggagttctaggctgcagtgaactatgattgagcactgcactccagcctgggcaacagagtgagaccctgcctcaaaaaaaaaaaaaaaagaaaagaaaaggagaaaagaaaaaggaaaaaacaaaacgaagaaaatgataaggtttctattaaagattttcgttcttcttcctcaggtttactgtgtgaatgtgtgtatacacacacgtaaatattttctttcaggttctgacacaagtaaaacatctctcttatcccaaaatgtgttccccagtaatgacttttgataagatttttgtatatttcaatttcagttttctatgcttgattttcacaatgcagataagctgctgaaacattggtataatttgccgtatttaattttacattatgaacgttcttatagtaaacatatcatccatgtttttgtttaaaaatttttttttaagatttctgtaatagtataccatcaagaggcaaaactgcaccactgtgacttgaatcactaagtgtatggatatatttagatagaattttaagacttaaaaagttcacttatcacttttaagaatgggttacaattctatgtttacccaaacatgtttctccctgaccctcatcagcaccttagtttttaatttttttgcaattgtaaatggtgtgtttttaattttgacctttctgttctcttctaatttactcttacatagaagagcaattagtttagaaaatatttacattgtttttggtcaccttactgaacaaacttccctgttctccaggttacaaaaactttcaaacatataacatgatttaaagaactttacaattgaatacctgtttgcctaccatctggattttatcatcattttattgtgtttcttttattacatatctatctatatatcatccttctactcatcattaatccacctttttttctttttatagagatggcatctcactatgttgcccaggctgatcttgaactcctgacctcaagtgatcctctctccttggcctcctaaagtgctgggattccaggtgtgagccacttcacccagccacatttatccatcttgtaaaatattgctttgttttttggtgcatttcaaagtaagttgcagacattcatacatttgcccctgaatatttcagtaggtttatcataattaagttctactgacagcttttcctaattacaggtctattagtcccatactgtataattcagtggcttttactatgtgcggccatcaccaaagtcaactttagaacattttcatcacttaaaaagaaaccctgtacccttttgttaccactccctatgccctaccactaagtaatctctaatctactttctgtctctatagatttgcttattttgacctttctgttttcttctaatttactcttatttcatttcatgtaaacgctacaatataatatgtgatcttttgtgactggtttctttcacatagcataatttttttttttttgagacagagtcttactctgtcacccaggctagaatgcagtggcgtgatctcagctcactgcaaccaccacctcccaagttcaagtgattctcctgcctcagcctcccaagtagctgagattacaggtgcctgctaccatgcatggctaatttttgtatttttggtagagacggggttttgccacgttggccaggctggtctcaaactcctgacctcagctgatccgcccacctcagcctcccaaagtgctgagattacaggcgtgagccactgcgcccagccaacatagtataatgttttcaaggtttgtctgtgtcgtagcatgtatctgtacttcattcttttttatgccagaatagtatttcatggtatggatatggcatcttgtatttatcctttcatcagttgatggacttttgggttatttcccctttttggctattataaataatatgctataaacatttgtgtgtaagtttttattgtttttatttctcttatatataagcctagaaatggagttgttgggttatatggtatgtttagccatttgagggactaccagacttttccaaagtggctgcaccatttaacatttccgccagcgatatttgagggtgtccattgccaccatgtacctaccaacacttgttatttttagttttttattacaggcattctagtgggtgttaggtggtttctcatggttttgatttgcatttctctggagacttatgttgagccatttttcatgtacttatgatatacataactgaggtacatgtatttttactaaatatggaattgttagtatttttaatagctagatagctccatttctggatgtgtgtacttctaatcagccagttaatcctgttaatagacctaaatcctttacgtcaactttgcatgcatgtgtcgctatttcctttacaaaaatttccaaggtggatttttgggttctagtaatatctcaaatggaagtattcaatgcaaagtgttatttccaaaattgtttagtcacttaatactgataaaaaagtatgtctattttggaatgcttgcaacttttagatataaaatcatcaatctgactaaaaacttattttttgtatatgttcaattgaatctataaaactgtcactcttccttagtcatataatttatttcctcttctctaatattgattatttatacttgattctttatcaaactaactgggtagcctttccagaatagttaaaatagtgataatcatcctgttcatcttcgatattgctcttgactttagagaatgtacttttatagtttcatagaacttttttttcttcattcctagaacttctgtaggatgtatttaattttttaaaatgaggtaaaattcacaagacataaaattaatcattttaaagtcaacagtgcaatcgttcttagtacagtcacagtgttgtacaaccaccacttgcagccacttcacattctcccctccagtagaccctggcaaccaactatgtgctttccgtctctttttgtagagtgcccgattctgtcgctgtttggggcgccagttgtaactgaccatgattcctggtagactgaacaaagcggggcaaacgagggaataaaagacaaaaacaaaagagtatatttggaagaaggggtcagggggcaccttgcctctagtggataagggctctgagctttacacagctctccgtatttattaggcaaaagagatagagagaagggggggtgattgtcgagtaattgtcagtcggccttttggttcacagcaggcttgtgagattgcattccttgagcaatagcctctagatgtccccatagatagcctccaggagcccagcgccagggaatggtggccctcagcaaagctggggcaggtacagaagcgagtttgcccacattctgtactcgtgataaacagtttgctgtttgatcatgtactctccagtggaatgctgagttggtcacgatccctttggccttttcggctcccaacatcttttttttttttttttttttttttgagacagagtttcactcttgttgccctggctagagtgcaatggcttgatctcagctcactgcagcctctgcctcccgggttcaagcaattctcctgcctctgctaggattacgggcatgcgccaccatgcctggctaattttgtattttttgtagagaccgggtttctccatgttggtcgggctagtctcgaactcccgatctcaggtgatctgcccgcctcggcctcccaaagtcctgggattacaggcgtgagccaccgcaccaggccagtgtgctgtctgtatgcatttacctaatctgggtattttatataaatgaaatcatataacgtgacatttagtgtctgacattttctttttttttttgagacagggtctcactctattgcccaggctggagcgcattggcacactcttggctcactgcaaactctgcctcctgggctcaagcaattctcatacctcagccaccctaacagctgggattataggcatgcaccaccatgcctggctaatttttgaactttttgtagagatggggtttcctcatgttgccctggctggtcaagagtttatcttgagctcaaagcaatcctcctgccttggcctcccaaagtgctaggattacaggtgtgagccaccacgcctgagtgtctgacattttcacttagcataatgtttttgtggttgtggattgtgtgctgggctactcctttaatgattagccagggaatctataaacctgccttaccgttcacttcctgcttgcactgaacctgtagacatcagccagaaggaacgttttagagtcttcttaggtcttttctcagccaacatcctcccctgtgcatgcgtgtggcttttatatattcctcagtctatacgagtgcttttgaatggtataatttcctcaagacactttcctcctacctttttctcacaacctttcctctgtgactcaagtgtaatcttttgccccaggcagctgaaggttgttgttctgcttcacaaagtgtttgagaaatgcccattacttttcctccctgagtgaattccaaaacaggaaggggcctgttgcataggtccttcaggtagttagaatagacaacaaacaatttttttatttttatttttgagacagggtctcactctgtcacctaggctggagtacagtgacgagatcatggctcaccacagactcaaactcctgggctcaagtgatcctcccacctcagcctcccaaagtgctggtattacaggcatgagccactgcactcagctaaacaaaattatttgtgaataaagtctattctgttccctccagggcctgaatccaggttcccacgttgggaatgttggccacaatctttaagaccatcactgagctggggagggggtggagcaaagacagataaaaatggcacagaactttcctactatttttaagtcaccattttgttgttgttgttcttgtttgttttgtttctttgagatggagtctagctctgtcacccagactggagtgcagtggtgtgatctcagctcactgcaacctccacctgccaggttcaaatgattctcctgcctcagcctcttgagtagctgggactacagacatgtgccaccacacctggctactttttgtagttttagtagagatggggtttcaccatgttggcctggctggtcttgaacttctggcctcaagtgatcctctggcctcagcctcccaaagtgctgggattataggcaagcatgagccaccatgcccggccagtcaccttttttttgactcaatatttgttctgttgttgtaaacctttgactatttttcagagttctgaccaagtttttgttttttgattgtttttacttgattttttgatagtttttttacttgagtttttgatttttcgatagagggacggacccttggacctacctactctgccatttttactcaatgagattttcctccacagtatatatgcttttgttttttttgttgttggtacttttaaaaaagaaataaactgatgcaagtgcaccttcagtgatatcctctaatccaccccctttcctctcctccatccctagggataactattcccttgaactaatttcatataatgcatgttttattaaatgtgtacatattgaaaaataatacatagtcttattttatgttttttaattttttaaatatacttttctttgttgtttctttcatatgatgatgatttgtgaacacgtcctgtttggtagtgatgctttagaatttatggaaattttctttatggcttcctatacatacatgagttttcaggaaatatactcctccagggaaaggacttagccactggagcaaacaggcgtgattacattctccagaaagctcataagggtcaaaaatgaagtagaagctcttcagctattcctgggaaaggggctgtggaagctcatgggaaaggaagccttgctgtttgaaatacacaccctggatgtcactgaaatgttgcatccaccacctcctgcccaggaatgttagatcatttgggttctgcacctttccactagtggcgttctaagaagaaaagtgtgaaacatctcttgccacaattacgtgcttctgagattgcagagggaaggggagcatttgcagctgtgggttaaaggatgagtcagtgcagaccctgtgggtttggagcatgcaggagggccaccgggagcttgtcacaatgattccacccaggtggaaggaaagcttagggtgactccatccagttgatgctctcaccatgtgagcctcttacttgagttttagaattgggcataaaaaaagcctctggggccgccactctctgacctgctgctttcaggccaagggtgtagcgtgcagtttttccatttgtctttgtgcctgtgtcactgttggcagtgctgatttcagaaggtcagattatatgtctatgacagtggccatcttccatgatgaatgaaactccctcaaggtagtagcaaagagagctaagatgtatgatgatggtatgcagtccaaaggtattcagcagaggctaaggtcatgttcttggagacaggctgtgtgggttcagattctacttctgcttttggacaatatagtcaaatctgtaagccttaggtcaatgttggaatgggaaataatgattgatactttataaggatgtaacgcagaaggtagtaatgagaattcaaatacaacaacccctctgcttggcttaatacatttgtcttcaaactgaggcatgcctacatgtgaggtgtatgatgacttttgaccaggcatgtggacacacgtggttttaaagaaataaatatccaattcctcaccttctctgtcctttttctaaaacctgatctaagaagtttcttggtgttgcagcatcatgttggtgctggttctcctttcccatctcccctctcacagtcacctcacttacatttcacagaagaaagacagtttgtaaatgtattggccatacctgtagaatcttatgttttgttgctccaggatttgttgttgccccagggtgggttaaaacttctggggccccaaataaagggacagttagagatggccttgcattaaggtgagaacacagcagcagtgacagcacctgggcctgcagggaatgtacactcaaatcaatttactcttcagcccacaggtcctgacttcaggagcaagacacttcaagtgaggtgaggaggaggttccaggacctggataccatcctttgcagggatgtaattcaccagagaccaagatttctagccagaaattgagggcagctcaaggagagactacagacacagcatcctacttactggctatttcccagtaacaaaagaaaatgatcaagtcccaggtgactttttgtttgttttagtctttccttcatcacatgattgatttctggaagactttaaaagtcagttgaattaagtcaaaaagtataatttggtaaactaggatttgtgcatcagtaaatttagattgtaatttcaacatctaggcaaagtaggatcaggactatattgtttacatgtggtatcatagaaagatacttggtctttgtctggcatagagctcctaaaacccttggaatttcctgaatgataagggtcttttttttgtttgagacagggtctcactttgtcacccaggctggagtgcagtggtgcaatcttggctcactgcaacctcggcctcctgggctcaagcgatcatcccatctcagcctcctaactagctgggagtgtgtgccaccaggcccagctaactttttgtatttttttgtagagatggggtttcaccatgttgcacaggctggtctctaactcctgagctgaagcaatctgtctcccttggcctcccaaagttctgggactacagttgtgagccactatgcctggtcctctttttttgtagtgaaactactctcagtggacccctaggtagcttcagtatggaggctggttgccagaaataacaagccttgattagaagcttggaactttcagtactacctctaatctccagggagcagagagaggctggagattgagttcagtcaccagtggccaatgatttattcaaccatgcctgtgtaacataaaaacccctaaacagcagggtttggagagctgggttggtaaacacattgaggtgctgggaggttggtgtgtgcagagagagcatggaaatttatgcccatacaccaccatactgtgccctgtgcagcttttccattgggttattcctgggttgtaaataaaccagtaatagtaaagtgctttcctgagctctgtgagttgttctagtagattattgaacctcaaggtgggttgcagaaatccccacatttgtagccaagggacaaaagtctttgtaacctggggacctcacacttgtgactggtgtctgaagtgaggttggtcttgtgggattgaaaccttaacctatgggtcttccaggagttggtgtcagaattgaatctaatcgttggacacctattgggtgttagagaattggagaattggttgatgtgagcaaaaacccacacatttggtgtcagaaatgtgagtaaaaacagcacaatggaattcacacaaaatgactaatgttggaacctaatgtgtgaccggagcatcctgtgggttatagtagctgtcaccttctgtctaatgtctctgactgtcatcacatccagagagtccttggtcacaggatatgcactgactctcaggagaaagcagaccagttcccgagaggtgtcactattaaatgcacttaggtcccaggacagtttttagatggttcttcctagaggtggtgtgacagatgatgtcttttttcttttttttttttttttttttttgagatagagtctcactctgtcatccagattggagtgcagtagtgccatcttggcctaccacaacctctgcctcccaggctgaagtgattctcctgcctcagcctcccgagtagctgagattacaggcatgcactacgactgcccggctaatttttgtatttttagtagagacagggtttcaccatgttggccaggctggtcttgaactcctgacctcaaatgatcctcccacctcggcctcccaaagtgttgagattacaggcatgagccaccacgcctggccccgaatataaatgccataagcccagccttctcatacatgccaaagcacaggtcctcagagacctttttgggaagaggccaaaggaactcagaggacacagttcaggggtccaaggcaaggttacccaaggacccagtcttatggctggtagggtcatccaggaataaaacctgaaaggctgaggaaaatggaaagattgcacaactttctttttttattctttttctaaatttttttttcatttttcttctttttcttttcttttgagtttcacattgtcacccaggctggagtgcagtggtgtgaacatggctcactgcaacctcgatttcctgggctcaagagatccttctgcttcagcccctcaagtagctaggcatgtgccaccacatccagctgatggttgtattttttgtagagatggggttttgccatgttgcccaggctgggattgcatgactttctaaggttctctgtatgaacaggtggctgacttactgtttgagacaggattggcagtagggagttgaaagtactgttgtctggtaagggaatgggttgttgggatccagagggtttgctttacaacatccccctgtgtaagattgtgcacattctttttccatgttcaaagccagttcttacaccctcatcctttaatacgttaaaaaaagtaagtatataaatgtacatggatatatatatatatatatatatatatgtgcaatatgctgtataggtttatagtctgggagcaataggctataccgtagagcctgggcatgtagtaggctgtatcatctaggtttaagtaagtgcactctgtgatggatgaacaacagaattgcctaatgatgcatttctcagaatgtatccttgttattaaatgacacatgaataaataaatatacatgtatacatgtttgcatatatttgtatgtatgtatatatatgtatatatatttacagacgtatctgccttagcccttagatctttggatagtacctttccattattgtattttctctttcacaaactaaattggtacatgctagaccttacctatcctctgtatttattaatctggtcttttatatattgcatcattctgtccttttgttgcatttttggtagttttttcagatctacttaccagttcattgactatctcttcagttatgctgcttacacgcctgataacataaatataaatacttcaaaacccatatgtgtgtgtatggtttttgaataatattttgtattttcttttttattatttatttatttattttatttttatttatgtatttattttgagatgaagtctcgctctgtcactcaggctggagtacagtagcatgatcttggctcactgcaacctttgcctcctgggttcaagtgattctcctgcctcagtctcccgagtagctgggattacaggcatgcaccaccatgcctggctaatttttgtatttttagtaaagatagggatttcaccatgttgggcaagctggtctcaaactcctgacctcaggtgatccgcccgcctaggcctcccaaagtgctgggattacaggtgtgagccaccatgcctggcctatttatttattttgtaagccagtcacatttagcagtagggggtaataatacttaattgtctcttgttctttggacatgttttggaaagagtcttttactcctcctaacatataaaatatacttatttattatgtagtatcttgtagtgtttggggtttcttcctggttgattctggtagcgcacatgaagattcattgaagattcatgatgaataaagaagtatgctttattcatcctgatattgctaaaatatatttagtgcctggcaaataggtgctcaaaaaaaaaaagaggattagcaagaggattaaatgattggttcttatagaaacttctgatttgttaaatgatagataattacacaattacagaatattttgctagagatagattttgaatatagatagattttggagatggatttttgcctctatgacaatgtatttttttaaaaatcacagcacctagatatatagatgcagactatttggtaaaaatgagcagaacaatgttcttcacatttcttccatataaatgagagaaatacttcatattaagcaggactctcttattacaggaatcactgaccctggaggatgtggctgtggagttcacttgggaggagtggcagctcctcggccctgctcagaaggacctgtaccgagacgtgatgttggagaactatagcaacctcgtgtcagtgggtgaggacagctgccctgtgtcactcagagagtacccagtcaaaggcctttgctttctcagctttcaaaagctctggagggcctgtggtgctctgaagtggtagattctgtaccctctctggccccagataaaagagtgtaatgtgccccctttagagggaaaatccctttgctttgcagacacataaattacatagttcctaaaacagaacatggtcccatgttgatagaccacagctcaattcaatgagcctaagttgtgtatcatttcctatgaacagggtatcaagccagcaaaccagatgcactcttcaagttggaacaaggagagccatggacagtagaaaatgaaatccacagccaaatctgtccaggtgagttcagggtgagagccagcaaggagggtggctgagcaagtcacatgatagttgttcagcagtgtctgagctgtcagggcatctgaggctgtgtggacagagcctccatgtatccctctccccacacaaaagctctttctccttcgggtatttagaggaacatctgcttcgttatcgcgtcttggatttcatcactgtttattttttatttattttattttatttatttattttttgagatggagtctcactctgtcacccaggctagagcccagtggtgcaatcttggctcactgcatcctctacctcccagttcaagcgattctcctgcctctgtcttcccagtagctgggatcacaggcacccgccactacgcccagctaatttttttgtattttcagtggagacggggtttcaccaagttgaccaagatggtctcaaactcctgacctctggtgatccacctgctttggcctcccaaagtgctgggattacaggtgtgagccaccacacccggcctcatcactctttatttaatctaggtttgatttgtttttctcaaggtttcttcctttttaggattctcaaatctcatcatttcttgttcccccatcagagcatcactacctgttccttctacttctcttgctatgaaattcctccttccatgtctgtctccaaagagtggtcttggatatcagcactctctcctgaccactatacctttctgcccctttagataatgttgattttttttttccaaaggtcttcccaccctatcttggactctgtgcccccttagtaacctggtctgttgctttgcatatatttgcttccttagcttctcttttttctcccactctgaggtcctccagaggttctgtttcccatttattttgctctgttctcatatcctttaaaagtttccttcattctaatgacttaagttcttgttctctatggagattctcagattgacatctcccttaatatttcctaacttacatgtttgtacctattttttacccacttgcatgtcaactccttgagtcgatcctggccaccacagggttaccttgaaacttccctgcctcctcagctaccgtatttaaagtctttgctctttcaattgatttttgaagtagtctcattctctttccaacccaaaccagattactacacctcatgcctgctttgcttcaatttccttttggaatcattaattctgcctattatttagtttctcttaaattatattgctggacttattcccttaaagcttttctgttcttaccatagtctgatggcactgagtcccagtgaatcatagcagtcatataagatggaaatttctcatctgtcaggtgatattctagttgaatcaccatgatatggtatcatcttgcctacacagagtttgttttccttttccttttcataaattcaaagccaactatatataaagcactacatttgaagtagtttccgcagtgtgtcccttactttccttgtttcattgccttaaatattttttgatagactattacatatgggccctgacagctgtgaacatcaataacaacaacaaaattcttcttggagattacctgctaaaaggaagaggcacaaaattaatcaaaatggataaatgtcttgtggtgaaaaatgctgggaagaccaataacaaagtataatgagggatgccgggagtgggaatggctgtttggtcagatgcctttgagcagctgtatgacagacatgaatacgtccccctggtgaattaccttccaagtagacaaaatagcaggtccaaaggcccaaggcaggtgtgtgtttgaggaacttcaaggaagcctgtgtgaatacagaggagtgaacaagaggggcagtggtcggagataatacggaagtaaggacagtgtggtgggatctggagtttggggtagacaggtcatgtatgacctttcaaggacattttaatgacttgatttttttttttttttttggcacagagtctctctctgtctccaggctggagtgcagtgctgtgatctcagctcactgcaacctctgcctccctggttcaagcgattctcctgcttcagcctcccaagtcgctgggactacaggcgtaagccaccgctcctggctactttttgtatttttagtagagacagagtttcaccatgttggccaggatggtcttgatctcctgacctcatgatccacgtgcctcggcctcccaaagtgctgggattacaggcgtgagccactgcatccggccatgacttgattttttaaaaaattatgagatgaggaaacatgagggagttttgagtagaagagtgacatgatgtcatttatatttaaaaggatcactttgactactttgtagaaagtatacaggagaaggcagaggttgaagcctgaagtccacttgggaggctattgctatagtaccagaaagagtgattctcttccatctaggtagaaggggtgagtgttagtgagtttcagaatacaggagtcccctgttatccacagtttctctttctacagtttcagctacctgtggtcaactatggtctgaaaatgttaaatgggaaattctagaaataaacaattcttaattacattgctcaccattccaaggagcatgaaatcttgcaccatcttgctccatcctggaacaggaatcattttttgtccagcatatgcatgctgtgtaccctacccacctgtgtcacttagtagccatcttggttatcagatcaactgtcaaggtatcacagtgcttgtgttcaagtaacctttgttttacttaataatgcttccaaagctcaagagtgtgatgctggcctattgttataattcttctattttattatttgttattgttaatctcttgctgtgcctagtttgtaaactttattataggtatgtatgcactgtacaggaaaaaacataatggatatagggttaagtatgattcagagtttcaggcatccatggtgtggggggtgtcttggaacatatcgcccatagatgagggattactgtatatttataaaagacataaggaatttactactgaagtagacaaagggtgtgagacaaacatacaaatgaaagatgatagtaaggtttctggcatgagtccgagcaggaattaacttgccatttcctgagaaatttaccttgtttatacactgactgcttttattttttgttttctttgtttaaattataatggtttattcttgtccaagtgacaataggcatatctacttggagttttttaaacagtggaaatagtgtggtcagtagagccagcctgtacaagactgtttgtgaaatagttctattccatgctcatggaaagatttattgttctcttctttcctagaaatcaagaaagttgacaatcatctacagatgcactcacaaaagcaaagatgtctgaagagagtggaacaatgccataaacataatgcatttggaaacatcattcatcagaggaaaagtgattttcctttaaggcaaaatcatgatacatttgacttacatgggaaaatactgaaatcaaatttaagtttagtcaaccagaacaaaaggtatgaaatcaagaattctgtgggggttaatggagatgggaaatccttccttcatgccaagcatgaacaatttcataatgaaatgaacttccccgaaggtggaaattctgtgaatacaaattcacaattcattaagcatcagcgaactcaaaacatagataaaccccatgtatgcactgagtgtgggaaggctttcctcaagaagtctcgcctcatctatcatcagagagttcacactggggagaaacctcatggatgcagtatatgtgggaaagccttctccagaaagtccgggctcactgaacaccagagaaaccacacaggagagaaaccctatgaatgcactgaatgtgacaaagcattccgctggaaatcacagctcaatgcacaccagaaaattcatacaggagagaagtcatatatatgcagtgattgtggaaaaggcttcatcaagaagtctcggctcattaatcatcagagagttcatacaggagagaaaccacatggatgcagcctgtgtgggaaggccttctccaaaaggtccaggctcactgaacaccagagaactcatacaggagagaaaccctatgaatgcactgaatgtgacaaagcattccgctggaaatcacagctcaatgcacatcagaaagctcacacaggagagaagtcatatatatgccgtgattgtggaaaaggcttcattcagaagggaaatctcattgtacatcagcgaattcatactggagaaaaaccctatatatgcaatgaatgtggaaaaggcttcatccaaaagggcaacctccttattcatcgacgtactcacactggagagaaaccctatgtatgcaatgaatgtgggaaaggcttcagccagaagacatgtttaatatcccatcagagatttcacacaggaaagacaccctttgtatgtactgagtgtggaaaatcctgctcacacaagtcaggtctcattaaccaccagagaattcacacaggagagaaaccctatacatgcagtgactgtgggaaagctttcagagataaatcatgtctcaacagacatcggagaactcatacaggggagagaccgtatggatgctctgattgtgggaaagctttctcccacttgtcatgccttgtttatcataagggaatgctgcatgcaagagagaaatgtgtaggttcagtcaaattggaaaatccttgctcagagagtcatagcttatcacatacacgtgatctcatacaggataaagactctgttaacatggtgactctgcagatgccttctgtggcagctcagacctcattaactaacagtgcgttccaagcagagagcaaagtagccattgtgagccagcctgttgccagaagttcagtctcagcagatagtagaatttgcacagaataaaaaccatatgaatgcagtgaa

SEQ ID NO: 404 - DNA, 18324 bp, Homo sapiens; identical to SEQ ID NO: 403
  source 1..18324: mol_type = genomic DNA

SEQ ID NO: 405 - DNA, 22487 bp, Homo sapiens
  source 1..22487: mol_type = genomic DNA
taattttaaaatatttgtttaatgaaacaaattgactagtttcacagatccctctgcataatacaaagttctgaaagtttatggtcctggttttcaattaatcctccacactggcactggtctaaggaaactgaattgacacatatgtgtcccacattccaccattacagtattagccctttcccaccaactgccccttatgaagcttttcagtcactgcaacactcccgacaccaattatctcatctgttttaaaaattcacagtacttcatttcctccacttaaaagtacttgggcttcctttactcatttaattgacacagtcgagcaattgctgtgtatgtgcttaggttaacatcaaatttgcctgtgtatcacagcatacattttaataggatgagtttatcaggctatctcagccttatacatgttctctcagtgtatgcttttcggccacataatgaactacaaatttttgctcaacccttttccacatagatctgagttttcttcctatgggttttctgtaacataaaataagacataattgatcacggaaggcacaaccacattcactgcattcacaaggtttctgtcctgtgcaaatcctctgttatctcctgaggctgcacatctgaccactggctgtcccacaaggactacgttcctgtttgcgaggaggccgctgatgtttaatgatgtctgaggggccacagaaggcacttgtgtagtcgccccgttagcagagtttttctcctgcatgacatcactggtgtgtaatgagctgtgcctctctgcaggaggattttccaccttggctgcctcttgtttctcccttgtgtgtattctcttatgcttaaccagacacgacatatacgcaaacgctttcccacactcgttacagccatagggtctctctcctgtatgagtcctttgatggacaatgagcttttgctttgtgctaaaggctttcccacattcactacattcaaagggtttctctcctgtgtgaattctttgatgtttaatgagacctgatttctgagaacaggattttccacattcactgcacacaaagggcgtctttcctgtgtgaaatctctgatgtgctatgagacacgtcttctgaatgaagccttttccacattcattgcatatataaggtttctcacctgtatgaattcgctggtgtacaatgagatttcctttctggatgaagccttttccacattcactgcatatatagggtttctctccggtatgtgttttctgatgtatgttgagccgtgatttcttgagaaaggctttgccacattcagggcattcataaggtttttctcctgtatgagttcgctgatgttcagtaagcatgaactttctggagaaggctttctcacatagactacatctgtggggtttctctcctgtatgcattacctggtgatcagttagccaagacttcttgatgaaggctttcccacattcactgcacacatgatgcttctctaattttcgtgttttctgatgcttgggactgatgaattgggacttagtgctgatgagtttttgacttgcagggaatttaattgcagtatgaagtcgttcatggttagcatgaagaaaggagtccccatttccagtaaactcaacagagttctttatttcatagcctttgctctggttaactaaagttaaattggatttcaaactttttccacgtaagtcaaatatatcatgattttgccctaacagaaactgacttttgctgcaatgaacaatattttcaaatgcatcatgttcatgacatggtttccttctgttcaccaggctttcactctgcaagcgctccagcacatgatcaactttccatatgtctagaaagaaaagaacaaagatttctatcatttagatttggggtaaaagtttgttgtggtttttttgttttttttgtttttttttttaagatggagttttactccgttgtccaggctggagtgcaatgctgcgatctcagctcactgcaacctctgcttcccgggttcaagggattctcctgcctcagcctcccaagttgctgggattacaggtgcctgctaccatgcccggctaatttttgtagttttactacagacggggtctcaccatgttggccaggctggtctcgaactcctgacctcaggtgagccattgtgctcagccaaagtattttttgttttgttttgtttttgggagacggagtctcactctgtcgcccaggctggagtgcagtggtacaatcccggctcacagccaaagtattttttgttgttttttttttgttttttggggacggagtctcactctgtagcccaggctggagtgcagtgacatgatcccggctcactgcaacctccacctcctgagttcaagcgattctcctgcctcagcctcccgagtagctgggattacaggcatgcaccaccgcacccagctaattctgtatatttagtagagacggcgtttcaccatgttagccaggctgatctcgaactcccgacctcaggtgatctgcccgcttcagtctcccaaagttctgggattacaggtgtgagccgctgcacccggccccaaagtattcttttttttaatgccttgatgtgaggtgtctcttagtaataaccctatgacctgagtgtaaataaaactccatgtttaatgttccttgcacattggcaaaaagtaatagtataaacaaactaaaaggtgaaagcagttagcataaaacaaggttagatcactaataataaagacagatttggctgctttctaaatgtgccttgcaaaacagaccttaaaatacaagcaattcactgtgaccagcagaccagaggctggaggcccatttcgtccaaagaacagattcattcattccacatactcttactgaatgatcaccgtgtgccaggtatggtgctggtgttggggataggcacaagaatcgcttgaatccaggaggtggaggttgcggtgagccaagttcacaccattgcgctccagcctgggcacagagcaagactctgtcttaaaaaaaaaataaattaataaaaataaataataataatgaataatttttaagggaatgagtcagggaagtaatcatatgtgtggaacacaccaggcagggtttaggaaagaggatggaaatctctttgtgagcaagatggtattatatcacagagatcactgaaatgagaaatttgacaggtaacatggtttactgggacttggtgtcatcagaatacgatggggaaaaaaacgaaagcaaattattaaatacagaaaggaaccaaatggaagtaggcgggagttgagaatgtaggatgttaaaaaaatgacttttttacttagagatgcatcatgactagcagagacctttaaagaagagagctcttcaggcaggtaatacccagatggccaagattcaggatgtacaggaacaaacgaaaatccaaacttaatggttttcttggaggaaagatgattctagttccttgcagttactaggaactcaggggagagttgccatgaagtaaattacacagaactaaaatctgtgttagataacaacagggagatgtcagtttgggactctcctccagggagcggaaggagtttaaacttactagaatgaaggcaattttgaagagtgaagggcacagatgagaaaatggagaacgggacctttggagaacctaagaataaggaaaaagagaagcgaaggaagccaaggcacagcgaaagtccagtttaccctgaggaagccacatccatcacaggggaggtgttaggaggggaggtcagcattagccaaggggcacaaaggggtgggagtccgaaaacagtgaggacttcaaagtttcctctttggaaagaggcctggaaggtggaatttcgtaacaagagaggtggaacaacatgaagaagggaaatacttgaaacccgaggaagaagaaaattatgcaggcaaacaaacaatatgtagataaaataatcagatctctgaggagataaagagtttttgttttgttttgtttttttttaactctaaattcctacaaagaaaaactggtctcacactgggagacagatgagtagaggaactgtttacatatcctcaaacccccttcacagctgtgctgccttctctgactgtctagaatgtgacttccatagccttctgtcttgtgggttctctcacctgaacaggctccactgtggattccatcttcaattgtccacagttgttctccttgttccaacttgaagagtgcatccggtttgctggcttgataccctgttcatggaaaatgatagaggacttagacatatcaaattgggctggcaatgtcaagaaggaagaatgttacatttcaagaaacttgagtttcttaaaatacccaaaatttagtttcttatctgaaactatgaaagtttcgtttcatatctgtaacatcaaggtttttctcttacaagagggtagattacaccgtcttgtgtgggagcaagagaaggatctgagaatctaccacttcagagtactgcaggcattccaaagaggtaggcatctgagaaaggaaggccactgactaggcaccctctgagtgacacagggcagctgtcctcacccactgccaccaggttgctgtagttctccaacatcacatcccggtacaggtccttctgagcagcgcccaggagttgccactcctcccaagtgaagtccacagccacatcctccagtgttatggattcctgtaataacagtcctgtttaataaagtgatgtctttttgatgatgtggaagaaatgctaaagtttttctgctcatttccactctacaggctgtgtgcatataccaaatagttttttttttaatacaatgtggaagaagtaaagtcctaatataatattctgtaactgtatattcagtcatcctccattcacccaattggaagtttctataaagtgtagaagttaaatcttgctaacctaaaaacaatatatttatacattttatatatgtaaatatatatgaatatatgtacatatatttattttagatacatgcaaatgaaagacatatatacagccatcctttagtatctgtagggtattggttccaggacctcctgaggatactgaggtgtctgatataaaatggcacagtattggtcaggcacagtagatcacacctgtaatcccagcactttcggaggccaaggcaggagggtcactcgagcccaggagttcaagaccagcctgggcaacatgagaccccatctgtacaaaaaattaaaaaattagctaggcacagtggtgagtgcctgtggtcccagctacttgggaggctgaggcaggaggctcatttgagcctaggagttagagactacactgagttatgaccatgctactgcactgcagcctaagcaacagagcaagactgtctctaataaaataaaataaaatggaatagtacttgcagatttgcatgtaacccatgcacatcctcccatatacatttctgtttttttgaaatggagactcactctctttcccaggctggggtgcagtggcataatctcagctcactgcaacctccgcctcccaggagcaggcaattcttctgccccagcctcccaagtagctaggactacaggcatgtgacactacgcctggctaatttttttttttttttttttgagacggagttttgctcctctttcccaggctggagtgcaatggtacaatcttggctcactgcaacctccgcctcccaggttcaagcgattctcctgcctcagcctcccgagtagctaggattacaggtgcccgccaccacaaccagctaattttttgtatttttagtagagatggggtttcactatgttggccaggctgttctcaaactcctgaccttagacgatccacccacctcagcctcccaaagtgctggagttacaggagtgagccaccgtgcccagccccatatactttaaattatctttagattacttataatatctaatacaatgtaaatggtatgttaacagttgttatactatattgtttagggaatcatgacaataaaaaagtctgtatgtgctcagttcagatgcttaaaaaatatatattttcaatcctcagttggttgaatccatggatgtggaagccatggatatggagggccaaccatatatcacaaatccaggcctcctatttttctgatggactaattataaactgagggttcctatgacctccttgagtttgataatttctcaagaagaaggagaaaatcaagtaatggagaaacaatatccaaagatctaacactgaaaatttttcagaactgattaaacactccaaaattcaaactcaagaaatccaacaacttttcaagcaagaagtctacacgtaggcacaacagattgaaactaaattacaccagatacaaagggagactataaaaaaatccaaagaccaatgacaggttacctacaaaggagacaaaattttctgacagctgactgctccacagaaatcattatagccaataaatattggaacaataaatgtaaggtcctcagctcttggacaacacagcccaaccttgaagaccatttaggactgaaaggcatggctggcaaaggacctacagccctgtaatagtgacaattaagactacttatcaatgaattgtcaatctcttgtctcaggatgcaggatggctttaaaggatactgctggtgggaaattgagtcattgaagacccagggaacagcagaaggtacactctatactcattttattacagaggccagtgaacacacttggtagatgatacaagtacttaatcctggttggtttacccattctaaattatttatgtgagatagctatctatttggaaaaaagtaaagtgaaagtcttacctcaatccacactcaaaaatagtttactatatgacagatctatggcaggcagatttgatggctcaatgaactccaccctcccagtgttcacacctttatgtagttcccacttacagggagccaaaggtccgtgggacgtgaccaactcagcattccactggaggctatatgatcaaacagcaaactgtttatcatgaatgcaggatgtgagcaaactcaccattgctcctgccgacagaaggttttctggaggcaatcactccctggtgctgaggttatctactgcaacatttagagaatgtagtcttgcaagcctcctctggactgagcagctgacccctacttccactgcacccccccaactatctcttttgcctaataaatgcagagggctgtgtaaagctcagggcccttgtccactagaggcaaggtaccccctgaccccttcctccgaatatacttttgtctcttgtcttttattcctgtgttcaccccactgtgttcagtccccctaggtctgtgcgggttacaagtggcgcccaaacagggacagaattgggtgctctacaccctctccttgagcagggactggcctagtgacttacctctattcagaatatggcaaaggcgttggaatctcacctccttaattaagctatacatgtttaaaaaaattattcaatgagaattgttaaagcacagtaaggaagactttattcagggccattatgacaggtatatagacaaatgtaatgggattttgcagtggtagagggtgaatggacttaactccaaatatcagcataagcaagtgggaatttatagccaaggagcagagtatgggtcagtaatacaaaattaccaagagggccaggcacaatggcttatgcctgtaatcccagcactttgggaggcaggaggattgcttgagcccaggagttcaagagcagcctgggcaacatgacaagaccccatctcaattaaaaaaaaaaaaaaaaggaaaaaagaaaaaaagcagaaaagtaaaagtaaaaaataaactcatagtcaacccacccccgccacacacacacacacaaaacctttatgatcttttatcatttttcagattaaatacttgattctctcctaacccccaatggtgacaaatgcatttttttcaagtatagctataaactgatggaattttatataattaatgttcttcaatcatttgcaatcattggtctttggatgttcaaagtgtagcatcttcggccaatgaagagtcccttcaagttggctgctatgttctttgaaatatgattctatcatgtaaaatatatatatgtgtatatcataatgaatatatatatctacagatagattcatatatactcacacttttattaatacatatatagacatagatccacaaacagatacagtgacaggaagtaaatattaccaaccatttacagaagtggattaggaagaaaatatgtgaaaagaaaactttttctcttttcttcaattttactaaatatagacaaggtctcactagattgcccaggctagtctcaaactcctgggctcaaggaatcctcctgcctaagcctcccaaagtaggcataagccactgcactcagccagaaactttttttttttttttttttgagatggagtctctctgtcacccaggctggagtgcagtggcaccatttcggctcactgcaatttccgtctcctgggttcacgccattctcctgcctcagcctcccgagtagctgggactacaggcacctgccaccacacccgaccaattttttgtatttttagtagagacagggtttcacggtgtgagccaggatggtctcgatctccagacctcgtgatccacccacctcggtctcccaaagtgctggattacagccatgagccaccgcgcccagccgaaatttattttttgatatgtgtactttcttactttactgggacacaatcacagatgacctatgtggctgatcttaggtccacaccctcccagaagtcaggttttaactttagcctctagttctggaagtttctggcctatcatagatcacagatctatcatagttcgtatttttaggctgtccagtggccaaaggacccaagcaaacaaagacactaccattagcaagatattccagaagcccagagctcaccctccattagcttgaacacaaaggccaaaactccctttgttcaattatttactatacaataaggacttggcattttctacaaggtgaaagtctaaaggaaatctgtaaactccaatccaagtcctgttcagacaatatcactttcaactccctgtctccaaatctatattcaaacaccagttcagctatctgttcattgagaaccatttgaaagtcctggaatcctgccatattcccaggatgtctaggttttattccaagttaaatccagactgccacaaggctgaaattaacttgtgttggtccctgtgtttactgtttgcttagtctattccgtaacagtatataaggagtccttcaagaaacagccacaggaaacctgcatctgaatttatgagaaggctgctattctggacaccatccaccacatcaactctaggaagaaccactgaagaaatttcctgagaccaaagtgccatgaaataatggcaacccccaggaagtaatctgttttatcttcaaaaacaggacataccatgtaaattatgattttcttgtgacattggctgtcagagatattagatgcaagctgacagctaatataatccacaggatcctccagccatgcatggtgtcacaaaattcataatttagtgttaatgctatgaacattatattccttatcctactattttgcatgatattgagtttaaaaactaagcttacttctctccagatcctgctttttgaaatttatactttttatattagtgaaattgatgtttataggcttctacaaatctattatggaacaaaggaaagaataaaacaaaccaaaagtcagttacctgggcctggatcattttcttctgttcttggaagacagcattcaactgggatggtctgtctttgtatcttctggccttctcttcagaagtctcagttttcaatcaagtgtgccccaagaaatggtgaaccccaaatccacttcctccctcttcaggttatgttttttgctcctgaggagtcagaacctgtgggttgaagagcaaattcaatgtaagtggtacattttttccaggcccagatactgtcactgctgctaggcactcatcttaaagcaatgcccccaatatagttaactatatacctttgtttggagccccagcggattttatacctgtggccaataatgtctaggattcttaatgtggtggaggtatgcctttcctctgtgacgtttccgtggaaggactgtgaaggcaggtaggaaatgagacccaccatagcaccagcctcaggagatggtgaactcttaggcagattagttttagaaaagagacaatcagcaaggagaggacctggtctttgttttcctttaaatcatgtgtgctcccacacctcttcaaaagtctttgtacatacaccctgtgaagacatgtacttcagtttgaaagccaatgtactgggcaaatcataagcattgtcataaaaacagtactgacaatattttaggaggttttaaatacataaaaagctaaaatacacaataatttactggataattaggtggtgaataaagttgacgtgctctaaggtttctgtagaatggaaaagtgccaattagcagaagaatatgacaaaggttgcacactacatgtaatctctagttacaattaacactagtaagtccaggcacagtggctcacgcctgtaatcccagcactttgggatgccgaggcgggtggatcacctgacatcaggagtccgagaccggcctagccaacatggtgaaaccccatctctataaaaatacagttattccagaagctgaggcagaagaattgcttgaatccgggagatggaggttgcagtgagacaagcctgtgccattgtactccagtctggtcaaaaagagcgaaacctcgtcttaaaaaaaaaaaaaaaaaaaaaaactagtaattgttttaaagtacgtaagttccatgccaacaaaagggggaaatgtaataacaagaaattcatccaaaagaagagaatcaaaaacagagcaaaaagagcaaatacaatgcatttagatagctgttttaaaataaaatgtactaagaaaattacattacattaagtattttatgctaagtaaaaacagagcatggatcccagttaattacattaaatataaatgcctcaaaactgtcagaatggattaaaaattaaaatccaataacatctggggtttattttattttattttaatttttgagatggagtctcactctgtcgcccaggctggagtgcaatggtgtgatctcggcctcccgggttcaagcaattctctgccttagcctcccgagtagctgagtttacaggcacctgctgcagggagccgaaggctcgtggcccgtgggacgtgaccaactcagcattccactggaggctacagatcaaacagcaaactgtttatcatgaatgcaggatgtcagcaaactcatgactgctccggctgatgaaggtttgctggaggcaatcactccctggcgccgttatctactgcgacatctagagaatgcagtcttgcaagactactctggacccctggcgccgttatctactgcgacatctagagaatgcagtcttgcaagactactctggacccctggcgccgttatctactgcgacatctagagaatgcagtcttgcaagactactctggaccgagcagctgaccccttcttccacctccccttctcactgtctcttttgcctaataaatatgaagggctgtgtaaagctcagggcccttgtcccctagaggcaaagcgcccccgatcccttcttccaaatacactcttttgtctcatctttattcccgtgttcaccccactttgtttagtccacctaggtccgtgcaggttacaaatggcaaccagaacagggactccaagcacgcccaactagcagcatccaaacatgggacttcaaggacgtgaatgaagaaggtctgctggagcagaggaactgaaattgacaaggcgaaaggggaccctgggaagagtctgccggcagcagatataaggtcagtgccctaaagaggtactgggagcagtgctttaaagaagtactgggaagttttctgactcagggtaacaagggaaagaatttgtctattgaagaaaaacattatgtgcagttgcttaaagttctgttgagacagtctgcagctcaggttaattcgcagacactaacctcctgcagaagccacaaaaggttattacacataacccatcgtttccacaggcaggcactcttgatgtggaaaattgggatacagcaggagaaggattaaaacaggctcatcaaaaaggtcttaaagtcgattcttctgttttctccacttggagtttagttcgtactgtacttctgccattatctcattattattctgcaggacagcaagctgaatctaaaaatctgaaagaatttgttgacccacccacagctccaattaaaaataaaaaacaggagagggaggataaaaattggcctatactgcctccttcagttgcagaaacatctgtactgcctccttcggtggcagaaatagaaaccctaatacaaagaatttaatgctctgctgccatagctggagagcccttaggacattgtgcttttcctatttccatcaggcctgatccaaaaaatccacagcaggttattcatgaacacaccccactagagtttaagttgttgaaggaattaaaagcaagagtggtaaatgatggcatacagagcccattcaccttaggattgctagaatctgtgtttggtgctatgcgttttttaccctttgatgtgagacacttggcgcgaacttgcttgtctgctagtgcatatctgacatggaatttaaattggcaagaaatgtgtgcagaccaggctaaacagaaccatgctgctggacacggagacattacagaggatatgctgttaggtcatggcccttattcagatgtagaacgtcaaatggcactcccagatgctgcttatcagcagtgtacacaggccgctaaatgcgcctgggccacaatcctgaagagggagtccctgtacaatcctttttacatatcatgcaagggttgcaggaaccctatgcacaatttcttgcaagattacatgaggcactgaagcgtcagattcctcatactgtggctgcagaaatgctaaccttaactttagcttttgagaatgcaaacgtgtactgtaaacgtgcactggcaccagtgaggtgtacaaaaaacttgggaaattttctcagagcttgtcaggatgtaggaactgagattcatcgatctgcaaagttagcataagcaatggctaatttagcagttgacaaatctaaaaggagccaagggtcaaaccctaaagtgggaaaatgttgtaattgtggaaaaactggacatctaaaaaaggaatgccgccagatctcaggacagaaaggatattacaatgcagttcactccctagcagaaaaaacagcaggactctgtactcgccataacaaaggaaatcactgggctacccagtgctgctcaaaatttcatcagaatggcaccccattggtaaatgagatgggggcctgcacccgggcccctcaaacaatgagggcattcccaatgcagaccacaaccccacttcagggatgggttcctggaggcacattgattccctcaacccaggaacaccaggaagtgcaggattagatctacccaccagagaaagaatcacattagttaggggagacaaacctatttgggtatttggggacctttaccgacaggatacacaggactaattttaggtaaaagctgccttaacttgcaaggcatcactgtagtcctaggaatgactgactccgattatgaaggagaaattcaagtagttttaatgtcacaaaatctttgggtttttgaactgggagaatatattgctcaattattgcttattccctgtgaattacacccttccccatgaaaagagaaatgaggaaataaagggtttgggagcacaactacatgggaaatctatctttcccaacccatagcctctaatagacctacctgtgtagtacacattaaaggaaagaaattttatgggcttatggacatgggagctgatgtgtcagtcatatctataggatgggcacatcaaacattacaacgcatgttgaaaaaacaaaaagggggtataggaggccaactaccacctcaatcaaaactacatttagccttatttactttaaattttctgactcccggtatggatggtaagactccagcagaaagacattggcaagtgttagaggaaaaaagcaaagtttatctgaaagtgttatggaaatccccagaaggacaacaatggaaaggcccggtagatttactgacctggggaagagggtatgcttgtgtgtttacaggagatgggacaagccatgtgggtgccctcaaggtgcatgcgaccatggaatgggagactggaggaacccagggtggccaaccatgggcccagtccctcctgtacgagctatgagtcagctgagcctgagtgcaaagatggagagaaggccaaccagagtcatgatgacatcaacccccataacctggggacaactcaagaaaaccacacaggaagctgagaaactactggagtgtcagggacaggcaaaacccctgattccatgctcttggccatgttagccataatgtcctgtgcactacgttttccctgtgcacaggcaaaaacatattgggcatatgttcccaatcccccagcagtatggcctatactttggagctcactcctcctgagatttatcacgatcagggagagtgggctccaggacccctaactccccgtgacatagaaaagttagactctcagaacaatgtcattaattataccactccactggaaggactccctttgtttatcaccacaaagacgtcgctcagccatagctgtcttgcaattcaagctcaaacatggttgagtcactatggaaaaattatgtacttattaggtcttggttctattaatgtaactggtgtgctaaccaatcattcccagtccagtcaccctaattgtgctgattatacagaatggattccattcaatagttcctaccccactctgtggacccagtgtcttgatccactggctagtaaacaatatatgtcaactgaagacactgtggattgggaacctaaaggtcaattagatggaaaaggtgaaagtcagaaatcatggcacaaacttcactggcattggcggcaagcttttaatgcttcttctttatacaacagcagaatccaatcccagtctgctgctcagattgcttggcatggagcaggctttagcccacctcttcctcagttgcattatctggggaggaaaggaccaattcaagaaactatatggaaggcagcactcccatttatgaatggcaacatctggattggaacactgtctaataatagcaatagtaagcaacacagtcttaatgttgcatttgtaaagaatatcaccactcagtttacagtttgtgtttttaatccttatgcctttttggcagctaagaagaaccagcttcaggtaaacaatacccaattgacctgtaaatcttgccagttatatcacactgcattaatcatagcacattacgaacacataatatctctactttgataatgttgggttgcatccctgggctatggattcttgttaatctgtctgagccttgggctgccacacctgctttgcatttttgtaacacttcttctaactcagcttactcactgtgtccatagagccttaggcataatttttgctattgtttccttggtcaaactaataacttctgttgtgatatcttctgtaactctgcataattctattcaaacatctcagtaggtggagaactggacacgcacagctgaccaagcgaggctacttcagaataaaattaacactgagttacaaactgaagtggcaatgttgaaatccatggttctgtggttaggagaacaggtacaaagcttgcagttgcagcagcaattgcgtcatcattttaatcacattcatatttgcgtaactaactcagaatataaccaaagtgagtatccgtgggaccttgtgaaagcccatttgcaaggagctttcacatccaacatcacctttgatattggtgaattacaaaacaaaattattgatttaaataggcaaactcaagaatttcagccttctttagaagactggaccgaattccaggaaggcctggagagcctcaacccttggacctatctaaggcaccacattaacatcttatatgtagttcttggaataatgttgttttgtctctgtcttcggtttatagtctgtaaaatcggatggaccaccaattggagaatgagagcctcccagcccagccttacattctttcaattaatacataaacagaaagggggatatgcagggagccaaaggcctgtgggacgtgaccaactcagcattctgctggaggctatatgatcaaacagcaaactgtttatcatgaatacaggatgtgagcaaactcaggactgctcctgccaacataaggtttgctggaggcaatcactccctggcaccgaggttatctactgcgacatctagagaatgcagtcttgcaagcctactctgaactgagcagccgaccccttcttccacccccccaccctcctatctcttttgcctaataaatacggagggctgtgtaaagctcagggcccttgtccactagaggtaaggtgctccctgaccccttctcccaaatatactcttttgtctcctgtctttattcccacgttcacccccatttgtgcagtcccatgggtccatgtgggttacggcccgccaccgcgcctggctgatttttgtatttttagtagagatcggatttcagcatcttggtcaggctggccttcaactccggatctcatcacacacccgcctcagcctccccacatgcggttattatagttgatatgtctgaaccaaaatgatatgggaagcttgagaataaaaggttggagacaatatgccacagagagagtaaccaaagataatctgttataactatatctcagacaaaactgaccagaaatcctaaagaattaacagagagaaagagaaacaatgctcactgaaaagaggtgaaatttggctcttcattcatagaaatacaccatatgtatacccctaacaacagtcttgaaatgtatacagcaaaaaatagaaccaaaaacaagaaatagaaaattcagactaaagactttaacagacctttcctagtaactgacagaacagaccatcaacaaacaaaataaaatttataaatgagaaagaaatgaatcttttatctgaggaatgtgactccctttaaattatcaggtctagagaggcattaaaatgtgacagcagtctttctgataggggttcccctgaaaaaaagaaaaaagaaaaaattaaaaactaaaaaaaaaatttaatgtgacaatagtcacatctcatttccccctcaagctaaataattatctcttaaagccacttgctatgtaggctctagactaactcacactgagtagccataaaatgccattcactggacatcctaactcataaaaccccatagttaacaatgtacagccaattgttaattgatattatttctgtaaaccaatgagaattcttgccaaacaactttatgtcagctcacggtttgttcccttttgactttaaaacctgtttctaacaaaatcctaacagagcacttaaccaaggcaacctgaaagtattttcccaggcagctgtcctcattttggctcaagtaaactctttaaaattgtattttgtgcagtttcctcttttaggctgacataaacgatatcatttagaagaactcgaatatatttttaaaattagatttactgagataaattttaacagttttaaataaatgcaaagatgtactataaagatgggctggaaaacaaagcattttaaaaatgtcaagtctcccaaatctacagattcaatgaaatcacagtcacaatcccaaactgatactgaaaagtttaaatagctataaacttttttttaaagtttgaaaaaaaagttagaagacttgccatatcagttatgaggacttataaagctactttaattaggacagcacaatattagtacaataacaggcaaataggacaaaggaacagaataaaatccttataagcagaattaagcacatatagagactcaatggcaatgatagcactacagggaagtagataaaagctgtcttttcaataaatggaactaagggcgccgtggctcacgcctgtaatcctagcactttgggaagctgaggaaggtgtgggggaaagagagatcagactgttactgtgtctatatagaaagaggaagacataagaaactccattttaatctgtacaaagaaaagttcctctgtcttgagatactgttaatctgtaaccctagccccaaccctgtgctcagaaacgtgtgctgtgttggctcaaggtttaatggatttagggctgtgcaggacgtgctttgttaaaatgtgtttgcaggcagtatgcttggtaaaagtcatcaccattctccagtctcaagtacccagggacacaatgcactgcggaaggccgcagggacctctgcccaagaaagcctgggtattgtccaaggtttcctcccactgatacagcctgagatatggtctcgtgggaagggaaaaacctgaccatctcccagcccaacactcgtaaagggtctgtgctgaggaggattagtgaaagaggaagacctctttacagttaaaataagagaaagccatctgtctcctgctcctccctgggaatggaatgtcccggtataaaacccaatcatacattctatttactaagataggagaaaaccaccttataactaaaggtgagacatactggcggcaatactactctttactacactaagatgtctgtgtaaagtcaaacataaatctggcctacgtacacatcaaggcacaggacctttccttaaacttatttataacacagagtcctttactcacatgttttcctactgaccctctccccaccattaccctatagtcctgccacacccccctcaccaagatggtaaaaatagtaatcaataaatactaacaaaactcagagaccagtgccggtgtgggtcccccatatgctgaacaccagtcccctgggcccacttttcttcctctgtactttctctctgtgtctgatttcttttctcagtctctcatttccaccttgcaaaaaatacccacaggtgtggaggggcaggcccccttcaggcaggtggaccacttgagccagagttggagaccagcctggccatcatggtgaaaccccatctctactaaaaatacaaaaattagccaggcaaggtggcacctgctggtaattccagctactcgggaggccgtggcacaagaatcacttgagcccagaaggcagaggttgcagttgagccaagcacgccactacactccagcctgggcgacgagagcaagactctatctaaaaaaattaaaaaaaaaaaaaaaaatcaataaatggtactggggatggggacagaaagttaaaacccccctcacaacatacacaaaaaccattttagaatcaactgtcaatttcaatggtagaaacatatcaataaagctttaaagaacattaatataggagaatctctcaatgttattagggtatggccagatattttaaagaggccacataaagcaccctataaagcaaactatatcctgctaggggaactgtaagtggtacaaccactttagaaaacagtttgacatctatttagacggagtttatacacactctatgaagcagcaattttcctccgaggtgcacatctagatatacatctctgcctcccccatatgagagcacatatgaaccaaaagacatttacacaaattttcacacatgcattattcttaataatacaagctttaggtaatacaaatgtaattaataatagaaaaaactgctatattttacataatggaatgtgatagaaaacctattatacctttggtccagcctgcaagaatgctttttacatttttgaaagactgtaaaacaaaaagcaaattagcatatgcaagagaccatatgtagcctgcaagccctaaaatatttactgtaaattcgcctgatccttgtcattgagcaaagaaaatatactcagatgcaacaggaaagaccctcaccaataatgagcaaaagaaggctgacacaaaaaaagagtgatgtacaattccactgatatacagagtttaaaataggcaaaactgtattaactacaatgataaataatgattaattatataaagaaaagcctaaaatacttttcggtgtgagaatggaaaaagactcacagaacaccactggtgtgctgaccatattctatttcttgacctgggcaatgactgcttatacatatattgcctccatgataattaaattgtacatttaaaatatataaatgtagaaaaattaacaaagtaaaggaagagatcaaccataccaaacagtttacctccaggaaaggtgttaactccagacaacacaacgggtgaattttacaggtgggtaataaaacaagaacgtccactaacaccctattttcctactttatactggaaagttgagccaatgcattaagataagaatgaattataagcattacaaagtaagacagaaaattaatgttattttcaggcgatatcatcacgaacatggaaaaagagattcaagaaattacatatttaaaaaagaaaatgctccctcagaaactcccaggcagattttcacatacatagttggctagaattgcaccatacgcctaagctcatttccatgtcaaacctatcactagcaatggcaattggaaccagcaagattggctaagaccaacaaggccttactaagaaactgggatttgggtcgccttgccacagggatgaatacttcacgaaatggagattctgttaagaaagtgtgaatataaggcgggcaagcaacactcactatatattaagaagtgaaggccgggcgcggtggctcacgcctgtaatcccagcactttggaaagccaaggtgggcggatcacctgaggtcaggagttcgagaccaacctgcccaacgtggtaaaaccctgtctctactaaaaatacaaaaactagccgggcgtggtggcgtgggcctgtagtcccagctactcaggaggctgaggcaggagaatcgcttgaacccgggaggcggagattgcagtgagccgagatcgcgccattgcactccagtctgggagacaaaagtgaaactccgtctcaaaaaataaaaaaaataaataaaaaataaaagaagtgaatgcagaggttggcaacattttcgattttgccggccacgaggtctctgtcacaacaactcaaccgctgcctttgcagccatagacaatatataatcggagggtatgactgaacttgaccccccgatctgtaaatagccaccccaaggatcagaagagtagatatatggtttcgaactaatgctgggggctgtgtcgccttttgccccagtaaccgaggttcgaacctcaacccaggacccagggctccaaagtctcgaaagcttcagccctcacaagcctttgtaccacagacactggccccatgcctcttactcatccgaaccacggaccagacactctacagcgatggacatcctcccagactccaacatcactgagttccaaattaaatcctgaacccgaagcagacgccgcatcgatcctaatcgccacctccatcctttacaagcagagtgatccataccttgacagttaggacacggccgttgatcactacagacccttagtcactgtactcacaccaaaggcacgcggaccacagacagggggatcacagactcccaccaggtacctcccaaatgcctataccccggcgctccccagtcttcctgccaaaaactatgtggtccagggtacaccacgtcctcagatctcccaaaccttccactgagacaaaacctgaactaggacaaaaaactttcagggacaaaaccacacactgacctctattttctccagatacacaagaagggcctcaacgttacacttccgtaaactgct

SEQ ID NO: 406 - DNA, 16897 bp, Homo sapiens
  source 1..16897: mol_type = genomic DNA
tgtgtacaaatgttcataggatttttatttgtaacagtaagaaaaaccgggaacaaaactaatgtccttcagtgggtgaataaacaaatagtggtatattcgtatcatagattattagtggccaataaaaacagaacaatgatatgcagaacaacttggatggatttcaggttaatctgctttagttgaaatagccaataccaaaagggtacatgctgtatgattccatttttataacatgctactaatgacaaaactaaagatgaaaagatttctgattgccaagggttagggctgaggagaggttgtgactataaacaaggagcatgagggagtttgcattgatgcaacattctgaatctcgattacggtggtggtgacatgaatcaatatatgtgttaagatttcttaaagctacatataaaaaacaaacaaaaatgcatgcatgttaaaactggtgatttccaaataaattctgtagttaacagtattgtaacaatttcactttcctgtatttggtaatgaactatgcttatgtaagttgttatctttggaagaagctgggttaagggcaagaactctggaatattttggtaagattttgtgaatctaaacttatttcaaaataaaaacttacaaaaacatcttatttatattaatttcataacacctgatgttacttataaacttaaacatattcaagtatggtcaattacacttatgaactgaatatactgtatccagtttcattctgaagtactttagttattctgaaataacacaaacttagaaccaaagaaatgcaggagctaatcatataataaaatgaggcaggcataaaatactccggtattatatacaatattaaattttagttcgtgattagaggaagtcacaatttaaaatgtataaaatcagtgacaaggcaactaggaatatggctcaagctatcctgttcccaaatgcacatgaggcatattatctgttaaggttagaattgtgacagaaagctctcatccatcattttgccaaggcttctttccttcattaaattctctgatattttcctaaaagtcttctacattgaatgttttcataagttttttctgcattatttcctagcacacgatgaggcaaaacattttactgaaaaccctgccacaggggtttgccagaggaaagtatttctccagtgtgaactctctcaatctgttgaagttttatttttgggcaaagacgttcctataattattacatttccacgaattagtagtttattcatgatctatgatcacttctgagggggtttatcttcccaccaaaggcttttatagtctgccacattcataggatttttctcagtatacaatttttagacataatgtcctaaaatattttctcaaatgttttgtacatgttttctctgacacaaaacatgaagtaactgatcactaaataaacaaccatgtagtctgcattcatgaaattactcttctttgcagatatcttaagggcctacatctggcaagaggctttcccaaaatgactacctgtgaattctcctgtgtttaacaaggatagacaagtgcgcaaaagctttcccacaatcactacatccatagggcctctctcctgtatgttttctttgatgaacattgagccctgattttgtagtgaaggctttcccgcagtcactgcatttgtacggtttctctcctgtgtgaattctctgatgtgtaataagatcatttttgcgcaaagagaattttccacattcagtacatgcaaaggaagtctttcctgtgtgaaatcgctgatgttgtatgaggcatgtcttcttcctgaaggttttatcacattcattgcatttgtatggcttctctccagtatgagtttgctgatgtatactgagagtactcttcatggtgaagccctttccacattcattgcatatataaggtttctccccagtatgagttcgctgatgtgcaatgagcatgcttttcccagttaagcctttgccacattcactgcatacatagggtttctctcctgtatgagtgcgccgatgtacattgagatgactcttctcagtgaagccttttccacactcattgcaaatataaggtttctctcctgtatgagttcgttgatgtcccattagccggatctttgctggaaagccttttccacactcaccacatacatagggtttttctccagtatgagttcgctgatgcacaataaggcggctcttcacagtgaagccttttccacaatcattgcatatatatggcttctctgcagtatgagttcgctgatgtacaatgaggtcactcttcatggtgaaaccttttcgacattcggtgcatacatagggtttctctccagtatgtgttcgctgatgtctgatgagtgggctcttcaaagcgaagccctttccacactcattgcatttataaggtttctctccagtatgagttcgttgatgtaccatgagacagtgcttcattgaaaagccttttccacattcactacatgtatataatttctctcctgtatgagtttgctgatgtgtgataagactgttcttcaaggtgaagcctttcccacatttattgcatataaagggtttctcaccagtatgagttcgatgatgtgcagtaagacgcctcttctcaatgaagccttttccacattcactacatatataaggtttttctcctgtatgagttttctgatgtgtagtgagactgaactttgtagagaaggccttcccacatacactgcatccatggggtttctctcctgtatgagttcgttgatgataaatgagccgacacttcttgatgaaggctttcccacattggctacatgtgtaaggtttccctcccatatgagttttctgatgtatattgagctgtgatttcttgaggaaggttttgtcacattcagtgcattcataatgtttcagttctgtatgagttctctgatggtccattagtctggattttctggagaaagctttcccacacatactgcatacatgaggtttttctccagtgtgaactctctgatgatcaataaactgagacaacttgaggaaggctttcccacattcactgcatacatgggcattctctatgttgtgagttctctgttgcttaatgaactgggacttattaataggttttgcaattgcaggaaacttcatttcagtataaaattgtttatggttagcatgaaaaagggatttcccatctctattaaactcagcagagttctttaggccagagctccttttctggttttcaaaacttaaatttgattttaaaggtttttcatgtaagtcaaacgtatcacaatcttgcttcagcaggaaatgacctttgttctgattaacaatatttccaaacatattctgttcatggcactgtttcacactcttctgaatactttgattttgcaagtgatgctgcagaggatcatcaattttcctgatttctaggaaagaagagaacagtcaatcactccatcatcttgttttgaaataaactatttaaactattttttaaaactgccttggtgtgaggtgactctttagtgaaaaccctattttatttatttatttttttgtgagcaataaagctttttaatcacctgggtgcaggcggactgagtccgaaaaaggagtcagaaaagggtgataaggggagggcagttttatagcatttgggtaggtagtggaaaattacagctaaagggggttgaaaaccctattttagtataaaggaaactccatgtataaatatccctcatctcttacacattgggagagatgtgtaagattccttttatctcttacacataaaggaaattccatgtataaatatccttcatttcttacaaataaaacacaataatataaacacaccgaaaagtaaaagcaactgtacaaacaaggctagataattcacaatgtatatagatttggctgctttctaaataggtctttatacaatacacacatagtcaaatataaacaggtcactttttgcagggaaccccaaaatttggcaggataccagaccacagaaataaagagaaatatcagaccacacaggttgatcccaaatgacaaaggctgtattaatttattctacaaatgtttgctgaatgacatctatgtgtaagtcactatgctcatgtttgggatatacaaacaccttcctttttttttttttttttttttgagacagggtctctgtcaccaaggctggagtgcagtggcacaatctcagcttacttgcaactataacctctccctcccaggctcaagtgatcctcccacctcagcctcttgattagctgggaccacaggcatgtgccaccacacccagctaattttttgtatttttggtagagatgggtttttgctgtgttatctaggctggtctcacaagctcaagaagatccacctccctccgcctcccaaagtgctgggattacagacatgagccactgcactcagccaattttcacgaaggtttaattttagttaggaaaaaatgaaatcacaaggaagcaaaaaaataaagaaggtaattgcattttgtgaaatgtggttaatggaacaatggagatataagaggtggagaaaatcaagatatagttaaagaaatgacaaggttcactaataggttcaatgggacgagtgaaagagggttaatggaagtgaggactcaaagattattccaaaaattatatggtttcaggctggatacagtggctcacacctgtagtcccagcactttgggaggacaaagcgggtagatcacatgaggccaggagttcaagaccagcctggccaacatagtgaaactgtgtctctactaaaaatacaaaaattaggcatggtggcacatgcccgtagtcccggctacttgggaggctgaggcacaagaatcgcttgaacccaggaggtggaggttgcagtgggctgaaatcacaccactgcactccagctggggtgacacagcaagactctgtctcaaaaaaaaaaaaaaaaaaaaaaacgcaaaactatatggcttcagccattggataggaagaaaaaacctcatgatgaaaataggaatattactatctggaatgaagggaaaaatttagcatgccttgtgaaacacataaagtttaagaccattaccacatatccaagtacaaacatgaagaaattggttgaatatataaatctcgaaaaggccttatctggaaacagcaatgtagatgacatccaacatttacaaattattcaaagaaagagtactggatgagactttagttggaaacatgtagaaaaaaagaatgaaggcacagggccagggatcttgtcaatccaacatgtagagtttgggaattcgttaagtccactgaaatgaaccatacgctgactattatgatcaggtgcacaagtggagacccaggtgtacaaaacaaacatctaggagtggtaagaatgtaatagcctcttgaaaattgctaaaatagattttaagtgttctcacaaaaaaagtaagtacgtgaggtagtatatacattaatttgttcaatttagccattccacaatgtacacatatttcaaaacaacatgttttacatgataaatatatgtattttttatttaggaattaaaaagtaatcatgtcctggtgtggtggttcatgtctgtaatcccagcactttggtagggtgaggcaaagaggatcacttgagcccagaaatttgagaccagcctgggcaacatagtgagacctttctctataaaaaatacagaaattagctgggtgtggtggcatgtagtcccagctaggctaaagtgggaggatcacttgagcccaggagattgaggctgcagtgagccatgattgtgccactgcactccagcctgggtaacagagtagaaaaataaagaaaagaaatcataaatttaaaaaacagaagaatgtgagatcctcagcatttgatttaaagtgtcacatgctgagtgattatcacattccccaaacttgctattcttcttcattctatgtaccaccattaaactaattttcccaaagcacaatctcaagtttagatgaaaggttctatacttaagactccaactaatgacctaactggatcatactatcccgtgttgctacagaaagagggaacaatgatttgcagcaaagtgttaactcagcaggcctgggctattccatccctacacattccaaagaaagaactcgtcttaactgccttctaaaagataacctctgagcccctggaatattctgcctgctaagggtatcttttaatgcctgaggccttgggtcatatcagatagtttatgctagcaatgtgatttatggtggacacctggttttgcatgtctcaggctttgggccacatttgtattgttttgactctgggtggctacagacactgggcttagatgagcttccctagttggcaataacttcacatgtgttgacaaacactgttgcagggaaaattcagcactttgtgcaactccactagaacaggagaactgaaagcttgcacccagtttctcctggattcttctttctatactttttatctttgatgattttaatttgtattatttcactgtcacaaactgtaatcatgagtgtagcagttccctctcctccccattaacgtctaccttctacgtagcaggcaaagtaatctatcaaataaattagttatatcatgtcacttctctactcaaaactccctactgtgttctcaactcatttggaataaaatcaaggtcatgaatgcccttgacaggcagtatgtgacctctgtaccaaaacttccaactatgcccccactgttcttatttccagacagttttgcttttgctcactctactctatccattcaagcttcctagaagttcctcaaacacactccagggtcatttttcaacttctcattgtctcacacctggaacactcttcatccagggagcctacacgtgttcatcatctatctgctcaaaggcaccttaacaaagagctgttcccaccctacaagcacagtgccaactcctaacacttactgttccaccagctgctttaactttccttatagcaatttttactccaagatatgttatttatatatctgcttattactggttatatggttacttctaagagaacaaaagcattgtgaagaataaggacatggtatgttttttctttcttatttgtactgctgatagcgttggaatatagtaggctatcaaaacacaagttttgggtgtgtggtggaggcaggggggtttgtcatccagcctggagtgcagtggcatgaacttggctcattgcaatgtctgcctccagggttcaggcgattctcccacctcagcctcctgagtagctgggattataggcacataccaccacacccggctaatttttgtatttttagtagaaacggggtttcaccatgttggccaggctggtctcgaactcctgaactcaagtgatccatctgccttggcctcccaaaatgctgggattacaggcatgagccaccgcgcccagcccaaaacacaagttttaaaggaaggaatcatatgacaagaaacatgattaactgggactaggtgtcatcaaaatatgatagaaaagtaattaatgttatttctatattctagcaatgaataatctgaaaatgtaatcaagaaaacaattccattaactgcagaaacaaaaagaaaactatacttaggaatatacttagcaaaggaagtaccaaatttatattctgaaagtgataatgcattgtcgaaagaagtcaaagacctaacaggatataaaactgtccagtgttcatggatcagaatacttaatatgatgaaaatgggaatactccccaaaattgttacacagactcagtgcagtacctaccaaaatcctagccactctttttgtagaaatttacaactgattctaaacttcaaatggaaattcaaaggactcagaatagtcaaaacaaccttcaaagcaaagaacaaagatggaggactcacacttcccaatttcaaaacttactatagaaccataatcatcaagactatttgataatatatatttatacatagtatatgttccaaaattgattgtggtatggttacacaactaggtgaatagattaaaaaccactggcttatacaccttaaatgggtgaaatcatgtgatatgtgcattgtatctcaataatagtttacaaatatgatgaaaaaagcaaaagctatacagaaatgaatgcagtcaaaacatctaacatgaattaaagaaagttcagaattagcaaaactatgaaggaagtaatttgcagcaggcataaatgtctgatggtttgggctagaaataatatacgatattaaaagatcttttctaattaatcaaaacattatcttaaagtagagaactttaagagagttcagcatgtagaaaacacttaaggtaatgccagaatttaagatgtgcagtaatgaaagagaccctggatttaaacaggacagcctgcagcacgattcacaacagcaaagacatggaatcaacctaggttcccatcaatggtgaacaggataactgtggtatatatacaccatggaatactacaaagccataaaaaagaactaaagcatgtcatttgcagcaacatggatgcagctggaagccattaccctaagtgaaataactcagaaacagaaaaccaaatactgtgtattctcacttgtaggcaagagctaaacattgggaacacagggacatcaagacaggaacaatagacactggggactccaagaggaagaagggaggaaggcaagggttgaagaaccacctatttggtactatgttcactacttgggtgacaggattgagcttctagtgaatcctcggcatcaggcaatatatccatgagacaaacctgcatatgcacctcctgatgcacctcctgaatctaaaataaaaacataaaagataaaataaaattaaaaaaataaaattatataaggatagccaaaagcattattcttagagggaagatgattcttgttcctcatacacaaaatgggaagttacaggctagttgtcatgaagacaagtaaaatacatggaaataaagtatacattagataatattaaggcagaagttaatttggtagtctcttccagagaatgaagagttaattcacgggaatgaaaaaaacttttaaaagttatgagaacagtaaagaaaatggaagaaggatgggctgggcacggaggctcacgctgtaatcccagcactttgggaggccaaggctgacagattacttgagccaaggagttcaagaccagcctaggcaacatgacaaaaccccacctctataagaaatacaaaaatcagctgagcatggtgatgtgtgcctgtagtcccagccacttaagaggctgaggtgggaggatcgcttgagccgaggaggtcaaggctacagtgagcctgggtgacagatgagaccttctttccaaaaaaaaaaagtatggagaaactcaggattcagtataagaggaataagagaacttaagaaacacataaatgccaatcagagaccaggttatcatgggcacagcatccagagtggagaaaatgagggaaaataatgattcccagagtgggaataatgaaggaaaattattattttcctactagggcaggaagatgcagtagtcagaaaaaagtaatgagttcaaaggtctctctttccggagaggcctggaaaatggaatttcatagcaagagaggtaatacacaagcagagacactgtgacagtggacaagaaaaggcagatttgaaaatcctaagaagataattatgtagacaaaaacaagatgtgcataaaataaacaaagatgaaatctcaaggaaaaaaagtgggggccgggcgcagtggctcaagcctgtaatctcagcactttgggaggccaaggtgggcagatcacaaggtcaagagatcaagaccatcctggccaatatggtgaaaccccgtttctactaaaaatacaaaaattagctgggcgtggtggtacgcacctgtagtcccagctactcaggaggctgaggcaggagaatcccttgaacccgggaggcggaggttgcagtgagccaagattgcgctactgctctccagcctggtgacagagcaagactccatctcaaaaaaaaaaaaaaaaaaagaaaagaaagtggggcatattttccatactataacaaaaaagagctcttccttgggaagaaggagtgatggaggggctgttgctgtgtcctcagatgccctcactgctttgacgcctgctctgtgtgggcagaacatggtgtctgtggctgtccacctggctgctcctctcactcaccagaacagattcgagagtagatttcatcttctgttgtgcaagtttcttctcctcgttccaatttggagagtgcatctggtttgctggcttgataccctgttcatgggaaatgacagaagatttagacaaatcaaacggggctggcaatattgaaaaaggagagttacattttaaggactacataggtatcagatctgtaacaagaaggtagattatactctcttgtgtggggcaagagaatgatgtgagaatctaccacttcagagtactgcaggtaagcagctgagaaaggaaggccactgactgggcaccctctgagtgacacagggcagctgtcctcacccactgccaccaggttgctgtagttctccaacatcacgtcccggtacaggtccttctgagcagggctcaggaactgccactcctcccaggtgaagtccacagccacatcctccagtgttagggattcctgtaataacacacttctgtttaatgaagtcatattcttttggtgataggaaaagaatgtcaaggaagtcattccgctcattttcaccacataggaagctggtggggtttttttcttagtacattttgacagaataagaattccagtaaaatattctgtaactgtgcggtcatccattcattcaacaatgttgaaaagtcaaagaaatgtctgtaatacacagctatccaatcctcttgctaatgaaagaacatctataacatgtagcatctatttcccaataccaaactagtcataagtatatgccagttacaagtagacgaataattcagattcttaaattcactatgagctttcaggccaatatcaaactctgtaatgaagacatggcagatgctagtatcacaagacaatgcattctaaataactatggttaacatagttaaccatattattattttattctgaatgaaataaaagagactatataaaacatgtataaagcacaaagattattagatgattaaacaaatctgtttttttgcttgcttgtttttttttttgagatggagtcttgctctgttgcccaggctggagtgcagtggcacaatctcggctcactgcaacttctgcctcccgggttcaagcaattctcctgcctcagcctccctagtagctgggattacaggcgcacgccaccacacctggctaatttttgtatttttagtagagatgaggtttcaccacgttggccaggctggtctcacactcctgacctcaggtgatccacccgccttggccttccaaagtgctgggattacaggtgtgagccacagcgcctggccatgattaagcaaatttggaaaaaaaaatccttagaatatatatgcagacacatgtatgcacacagacaaattcatatatatgtgtatgttattagacagcgttaataacattaaatacaatgaagaaacagctaaaagaaatctacttttgcatttatgagaaggctacagttaagaacaccacctaccataacacctccgtgaagaactatcaaagatgtatttgagcctcagaattataagccatgaaacattaacatccctcaagaaactggtctgctttctcacagttgatataacttatcatgtttctcttgtatagcttgtcagagatactagaggcaagtttacagcaaatgtaacctacggggtcccacacagtcacaaattccaacatgaatcatgtagtatgaatcctatgaataatatatccctgatccttctttgcccagatttctccaggtcctgatatttccaatttatacttttctgattaattaccctgatttttacaggactttaaaaatacattggagaataaaggaaagaataaaacaaaccaaaagtcacctgggcctgcatcattgtctcctaaatttgggaaatgactgctaacttggacgttctgtatttgtctcttctgaatcagctctaaatttcggttcaaaaacttcaatctccaatcaaggatgtccccagaaatgatgacacccaagtcttggaaactccgcctccttccttcacttgatttctcttgttctcagcacctgtgggctgaagagcaaattactctgagtggtacattctttttaggcccagatgttgtcactgttcctatatgctcaccttaaatcaaggcccccaaatatctctctgttcttttatttagtgctccagaagcttttatatctgggctagtaaaatataacattctgaatatatgggaggtacagcacccttctatataaagttgacgtggtatgactactgctagtaagtgaaagagaatgtggggaaaagaatcgtcacaacgtgatgcccagcagctgggcaatcctcaggcagaccagttttaggaaagaggtcacatagacagttaagatgcacacattttttctttaaaaccatgtgtacccatctaccttttcagaggtctttttacattctaggatactgcaatctgagaacactgtcctaagcaaataataagcactatcttatttaaattattcattaccatccacatctttgactttttttcttttttttttgagactgagtttcactcactctgttgcccaggctggagtgagtaagactccagtggcgtgatctctgttcactgcaacctccatctcctgggttcaagcgattctcctgcttcagccgcctgagaagctgggattacaggtgaacgccacatgcgctgctaatttttgtacttttagtagaaacggggtttcaccatgttggccaggctggtcttgaactcctgagctcaactgatccacccatctcagcctcccaaagtgctgggactacaggcatgagccactgcacccggccgccatccacatcttgatacttgcaaagtattctaagtataaatgtataaaggatactcagcaaaaatatccttgaggaattacatattacagcaaatcctaacggatattcttcaagcaaaagaaagatgactccagtgtaagcagaggagcaaggtctgaagaggaacaaaacggtaagtaattaataaagcctaaatcagtattgactggaaaaataatactgataataatatatcaggaagttttaatatatatagtgttaaaatattccataagaacatataggccgggtgcggtggctcacgcctgtaatcccaacactttgggaggccgaggtgggcagatcacgaggtcaggagttcgagatcagcctgaccaacatggtgaaaccccgtctctactaaaaatacaaaaattagctgggcatggtagcgcgtgcctataatcccagctactcaggaggctgaggcaggagaattgcttgaacccaggaagcggagggtgcagtgagccaagattgtgccattgcactccagcctgggtgacagagtgagattctatctcaaaacaacaacaacaaaaaagaacatataaagtaggaggatggcaaatgaaaacgtattttaagatatctgcatagcagaagagtataaaatactaattaccataacattaacaaataagtttatatgttgtttgtaatcaatagtgtcagcaataaaactaatttttaaaaaattatttccatgttaaaagagaggtctatggtttccgtggcagctactcaactctactgttgtagctcaaaaatgcccacatacaaaaaaatagacaaatgattgtggccaggtcccaacaaaactttattaacagaaacaggtgctgggagatttagtccatgggctctagttgcccaactgtgaatttgtgcagaaaagccatatggtcacctaaatcaagagtcagtaatatagtatccaggacctggaccacctgttttgtaaataaagtcttataagaacacagctacatgcattccatgacatttcatctcaggctattatcacattacaatggcagagttgagaatttgggtctagaatgtcactcagtagaatgcagtataaaaaaataatcaaagatgacttttgaatataaggggcaaattatcagtatttgcctaatacgtctgtattcctttagtcaggtggctggatacaaaatttaaatagaaaaatcctatatcctcctaaagcatatacagatcgagtcagtattaagagcagaacctttcttgggaacaatttaacattctattgaaaattgccaataaaggtatacctggtaacccaaaaccccattcctaaaactttcttaaaaggtaatattggcaaaagtgtgctatctgacaggtcatttttactttcttcacttgatttttcatagggaaaacacaggtttacatcagaaaaatattagcattctacatttaaaataaaattgctgatggtagttcagtaatataagtttacggctttaaatgttttcattaatagaaaaaagagagaaaccaggcgggaggaagggagagaaaaaaatgaatataaatacaaattttacaaaagacaaaaccaaaaataatcctcagagataatcgtgaggaaaagatgtttaactcctcttttggccaacaagtaaagcgacacaagttatgccaatcacacaatgagcaagaagcagaatcagggctgaaaatccacttttgtttcacttcaaaatccacttttactctactttataccgaaccaaaattatctgtaaatcagatgcctccctattaagtaaataaataaagcaattaaagggctattagtagaattctagttaatcatatacagaattatttagaggaatggtacttatgtctgtaacttactttgaaatataccaaaatcgacaacaaataaggaatgattcacaaacagaggaatggatgaatacttagaaaaccagtagagctgatctaatacaatgttaatggtaaaagctaggtggtaggcatattggtattaacattaaacttctttcaatatttccataggttcaaaaattttcacaaaataatatgttaggcagagagaaaaatattgtaatactaagaattaagatgaccaaatataaaataaatatttaaaattaatttatcttttgttatagattataaggaaaggggagtcagaaagcaatacactgcaataaaagtaatagtctagattgaagattaaaggcaggaaaaacaaaattcatggataaatggataatcataaaatgttcctaaaaataatacctaaacattttaaaacatttcacttctatccaaatgtacgcataaacttaatgtgaatgcacttatagtaccaccggctcaaacagtaaaaacaacttctaaatgtttattacataatataaagcgaaaaagataatagtaccatttacataatttatctgaattatgaatattaagcacataacatacacgtctaaaattgaaatattctgaaaatttgacaaaggttatctttgagtaaccgagcttaccatggcagagatgttatcttacttgtgtcagaaagaacctgaaaagaaatatccaagaggatacgctggaaacttgcaggacaaagggtagaagccgcatcttaaatataaaacatactacttttaggtatgctagatgactgatctcgccaaaaacttccatttctgaggattcaagaccaaggggtgatggaaggtgccaaaggggatttaaaaaccagtcgtggagaagggtcttgggcagaaggggaatgctaatgagcatcaattctgttccagcagccagggctggggctaacccatcacctgccatggttcccaggcctccagagctgcagcccacatcggaatctgtggcgctaccaccaccgccaccgggattaattccaaaacctggatcagaaacctccgtaccttaacccccaagacagttcctcaatcatttagtcccaaacaaaacctgaaccataaaccgattcgctgacaaaacaaaccctccagttcgcaatcactgagccccgccaaaggacaacaccaaagacaccagaatgtgacttgggcactcagtagcggatctctagagatctttaaccacaaactacacgaggaccctgtgactggtcccagaggtaccccgatcacacacacacacaccctatcacggacctcttgtagttcccctgcgataggaatcggacccacgctaagctcctgaaagaattccactggcgtcgccaaacgctggcgccgacagataccagtccatcaccactgtccacgaacacgcccagccacggacagaatttcctcccccgtcaccacagcgaccacccagtgactgaacttacttcccagaacttggtgggctccggcctcatctctcggcctcctcagtgcctgacggcgactatccagggtcggaggcgttcccagcgttt

SEQ ID NO: 407 - DNA, 16897 bp, Homo sapiens; identical to SEQ ID NO: 406
  source 1..16897: mol_type = genomic DNA

SEQ ID NO: 408 - DNA, 15104 bp, Homo sapiens
  source 1..15104: mol_type = genomic DNA
tagatttcacagcatctttatttatagcacttaaaaccaggaaaacagtgcaaatatatctcataggtgaatggataaactactacatcaaatatgtatactactctcaaatataaacaactttcatctggttagatacatggtggtaaaaaaaaataataaaacaactattcatcaactcatataaaccttaggagtaatttgctgagtgacaaaaatgccaaaagcttacatactctctatcaataaaaattcatataacttatttatataaaatttataaaaaccatttacaaaaacaattttatttttatcatattcatgaaatgatgaaattatactgataggagaaaagtggttggcagagttaggtttggatggagtgtaagcataaaaaggtagcatgagggactttgtgttcattagttttatgtggttgcagtggttacacgaatctgtacatgtaatacaacttcttagagtacaaactaaaaaagaaaaaaacatgtaaaaattcgtcaaatccaaaataagattagtactttatagtatcctaccaatgttgtttttctggttttgataattatggttatataggatatttttactagaaattggttgaaggatactagcaaagcctctagactgcttttgcaatttcgagttcaaatttatttaagttgaaggtggttttataaactgatcatctctataatcttagttaagcaagtccaaatatgttgttaatatatttaacatattcagtttcttttctacttaagtttgcttaatgtacaattaagctcagagccaaagaaaggaaaagagctaatcataatatggggtggttgttctggagtattttctgacacaaataaattctctaattctcccacaccaattgggtgttctacaattcaattctgaacaactgggtgttctataattcaattctgacactaacttctccaagttagtgcagactccacaagttagtgcagtccaagttagtgcagtgcaagttagttagtgcagtctaaattagtgcagactccacaagttaaggggctcagtccaagacttcccccacatcagatgccactcacaaggacaacctgcagttctgaatggtgataaattccgagttcccactgccctactcaggtttgataatttgctacagggctcacaaaactcaagaaaacagcgtactttgttttactggttataaaggacgcaaatgaacactcaaatgaagaggtacatagagtaaagcctaaaaagggttctcctaatctcaggagcctctacccctatgaagttgggggtgcaccaccctcttgggctatttggagttctcttaatctcattgtctaatctaatctccagcacccctccccttccaggaggtgggagaaatggggcacaaagtctccatcctctagttacttgatcttcctagagaacagccccattctgaggctgtctaggggagcaaccataagtcacttcagtagtataatcaggtgtaattaaaagggcagtgctatgaataacaacaacagcaaaaacaaaacaaaaccaaaaaactcttatcactcatgaaattctaagcgttttaggagctctatgccaggaaccaggaacaaagaccaaatgtatttctcattataccacaattttacacaacagtaaaaataaacagtaatgagacagtatattatggaatcattggcaaggcaactagaaatgaggattaaggtatcctgactgaaaatgcacaccaggtgtattagctgatgtttaaggttatacttattaagaaaaagcactcaaatattcatcattttcaccacatttcatgccttcatgagctgttgatagtttgctaaaggtgttccacatttatttgatagcatgttcggaacaattttactttctatgtgatctcctgacaaatgatgaagcagagtgcgtcgctgaaatcctgccatcaatactgtcaccttaaagttattttccagtgtaaactttgacactcactgaggtcatatttctgagtaaagactttgtcatggtcatcatgtttctatcaacaataagctcacttacgttgaaatctatgatgaaacctgataataaagtctatctttccacagaagacttttcttagtctttgtattcacagaatttatctctgtatacttttcagacatatgagcagaaattattgctcaaaacatctccacattaatatagtttattcaacgtattttcattgacagaaaatatgaggtaaaagaccactaaaggcactaccttatttactgtattcatcaaattgatctctagggcaaattatttcacctcctgaggacagacacacatctgtcaacaggcagcaccatgtttatgttccaattggctagaaacacactgatgtttaatgaagtctgagttgccacaaaaggcatttccatagtcacggcactagtagggttttcttctgcatgagttcacttataaggaaggagctgtgactctccattacaggagttttcaacttgactgattctacccatttctcttgtgtgcattttcttatgtttgacaaggtttgataagtgggagaaggctttctcacaatcactgcatccatacggcctctctcctgtatgcgttctttgatgtacattgagtactgactttgtggtgaaggcttttccacattcattgcactcataaggtttctctcctgtgtgaattctctgatgggtaatgaggccatatttgtgtgaataggattttccgcactcggtacatacaaagggagtctttcctgtatgacatctctcatgttgtatgaggcatattttctggctgaaggctttaccacattcattgcattcatagggtttttctcctgtatgagttcgctgatgtataataagagtgcgctttgtggtgaagcctttaccacattcattgcatatgtaagatttctctcctgtatgagttcgctgatgtataacgagagtgcgtttgacagtgaagccttttccacattcgctgcatatgtaagatttttctcctgtgtgggagcgctgatgtacaatgagattgctcttcacggtaaagccttttccacattcactgcacatatagggtttctctccagtatgagttcgctgatgtacaacaagatagcgcttcatggtgaagccttttccacattcactgcatatatagggtttctcccctgtatgagttcgctgatgtacaatgagattgctcttcacagtgaaaccttttccacattctttgcacacataaggtttctctccactatgagttcgctgatgagcaattagatagcgcttcattgtaaagccctttccacactcactgcacatataggatttctcttctgtatgggtttgttgatgtgtaatgagactactcttcacagtagagccttttctatattcattgggtatacagattttgtctgttgtattagttttcagatgcttagtgaacaggacacttctggataatttctcacattgaccacttccaggattctcttgtatacaaatgttctcatggtaaatgagctgagacttcctaaggaaggtttgctcacattcaatgcatgcatggggtttctcaattttctgagtcctctgatgcttgaagacttggaatttagtatggatacattttgcattttcagaaaatctagttttagtatgcgtacgttcatgcttaccatgtagaagtgttttctcacctccaataaactcaacagggttatttattccatgtcttctcttctggttgattaaacttaaacttgatttcaaattttttctgtacaagtcaaatgtatcatgattttgcactataggaaaatgtgtcttgctgagatgtacaatatttctaagtgtattctgtccattgcattgctgcacgctcttcagaagtctttggtttggagagtgctcttgcagatgactgtcaactttcccgattcctaagaaagaacagagtaacaaattcttccatgagaattgtatgagataaaaatgcttatgaggccgggcacggtggctcatgcctgcaatcccagcacttggggaggctgaggcgggcagatcacgaggtcaggagttcaagaccagcctgaccaatgtggtgaaaccccgtctctactaaaattacaaaattagccgggcgtggtggcacatgcctgtaatcccagctattcaggaggctgaggcaggagaatcacttgatcccaggaggacgaggttgcagcaagccgagattgggccattgcactccagcctgggtgatagagcgagactcagtctaaaaaaaaaaaaaaaaaatcttagcttatgagatgatttgctgggggctggctctttattgtcaactctacgatcccagtataaaaggaaattatgaagatataagctgaaatatatccaagaaatcagatccaagaaaagacaaaaagtctttaaagctataacagcattaaaaaagttatcagatggggagatgaatatatagtggagctgcttaggtaccctcagatacttcatatatgtgacacctttccttaatgactacaataagactcctatagccactgtccttgctggttctcacttacctggacaatttttattctgaattttagcatctgttgtccatggttcttgtccatgtgccaacttggagagtacatctggtttgctagtttgataccctgttcatgaggaaagacaaacacaaacatcctgaattggagtccagtatgtcaagatggaaaaataatacattcgatgaagaaaacaatttcaaagtaagcattctgtcttagaagagattataccactttggggtcagagaggggactgaaaatgtaactcttccaaacaccacagtgactgtaaagctttgattaggtgagcataggacggtgtctgggcattgtaggcacctctaggtgacacagggaaactattcttacccagtgatactaggtggttatagttctccaccatcacatcccggtacaggttcttctgagcagtgtccaggagctgccactcctcccagctgaattccacagccacatcctccagggtcagtgattcctgtaattacaaagtcctattcaatatgatataaactcctattgttaatatagaagtataagataattttttaaaaattttcacaatacagcctgcatctatattcctttctcaaatatactttggtaggagcaaaatcctctatctatacattttagcgcctatttctaaatattaaacgtaggcaaatgacatcaggacaaataaaacatccctacattaccaatgacttcacaaccaatataaggatctgtcatgaatagacttcacatcttgaattcataaaatagtgcttttaaataaatgtaagagaaaagatgaaactatatctgtataaagcacaaaaggcccctaaagttgattagatttttatttattttttaatttttaaagagagatggtcttgctctgtagccccaaatggagtgcagtgtcacagtaatagctcaatgcaaccttgaactcctaagctcaagcgaccttcccacctcagcctctcaagtaactaggactacaggtggatgctactaccaatttttgtagtgacagggtcttgttatgttgaccaggctggtcttgaagtcctggcctcaagagatcctcctgcctcggccttccaaagtgctgggattacaggtgtgtgccactgcgcccagcaaaaaaaaacttctaacagaaaaacatatatacatatgtgtattaatggacagattaacagcatattagatacattgaagattattggtgaattggaatatataagtggaaatggcagaaaatgcagtacagagaaaaaagataaatcataacaaagaagttaataaatatgaaatacagagttgcaagacctagtgtatgcccacttatggtttctaaaagggaaaatagtgtaatagagaagcaatatctattaataaatatccaaaacctaaaatatttcagaactaaatacctcaaatctcaaattcagaaatcccaacaagttcagagcaggaagtcacaactggtgtgacacatcagactgaaactaccatacatcaaatgcaaagggaaaactatagaatcatcaagagacaaaagacagattacctacaaagaaataacaaaatatactgatggctgacatttcaataatagaatccagaaacgtatggaatacaatcttcaaagtcctaattcttgcaacaaaaaaggccaattttggaaggccatttgggattaaaacacatggctagcagatgacttgctgtcttacaaccatgatatcaaggacctgtttgtcaactaaactgtcattctcctgcttcacaataacttttcagagaactgcagagtgtgaagtagaggtaactaagatccaaggaaatactgataagagaatctatgctatattactgtgtgggatgctgcatagtcaagaaagtagactcatgagagtgcgcaagtgctcaagcctggtcagtttatctcattccaaaatctttatgtgagatgtctatcgactgggtaagtgtaaagttaaatttctacctcactccacagtccaaaagaatttattactggatggaaatcttgcaggccaactctaaggtgtcctctgataatctcattctctagctgcagtgacttctgacatcaactacctgggttaggccaaacttcccaggttaaaagcacaatcctccacaagactgccctcacttcagacacaagctgcaagcttaaggctacacagaccaccctcaactccagcgagctggctacaaatgtgtggagctaccatgactccctcaggtttaataacttgatagaacaactcagagaacccaagaaagtgctgtgtttacaattagcactttactattgcaaaatgacacaaatcagaatcagctaaaggaaaatatgcacagggtgaggtctgggaaggttccaaacacaaagctgctgactgtcctctcctcatggaatccttggtggcattacatcttcctgactacattgtgtaacaatattcaagagtacttgccagccagcgaggcgcacctaaactttgatgtccagagattttattgagacttcatgatgtaggcacagtttattgaagcattgcccatgtagctgagttcagtctccagttccctccccttcctgactggtattacatggctcaaagccacaactctctaatcacttagtgcgctttttggcatgggcagcccctatccagagtcatgtcattgccataaattatctagggatctactatgagtcaccactatacatatagatataaactatcaaatatgagtggcccaccatgaatgacagagacactcataacttgggtaattacaagggtttagaggttacctcccaggaacgaaaacaaaggctagccaaattctttattacactctaggtgttcctgcccctgtgcagtaccatcctcctgagtatgaagtggcctaaaagcttgtttctaaagaaaagaatacagcaaaagtgacaagatgccactttaagattacactctatatgacttccatcttgctagcagaatctgtcattttctagctttgattaaacaatttggcacataggggaggtgcatgtgacaaaaaactaaaagtgggctttgacaaacagacaggtagaaactgaggacctcaactaaactacctcatttctcattctggaaatgaatcctcccaacaaccacataagtgagcttagaactgcatctttccccatttcagccttcagatcagattccaacccagctaacaccttgacgacaacccccatgagagactgtgaatcaaagtagccaggtaagccatgcccttattcctgagccacagaaagtgtgagatttttttttttaagtgttgtttcaagtcactaccttttggagtaatttcttaggtattaatagacaatgaatataagatgtaaacttaagaagaacttatgaggccaggagtggggcacacatctgtaattacagtacttccagaggagagtttgagcccaggagtttgagaccaacctgagcaacatagtgagactctgtctctattctctacaaagaacaaaaaattagctgggtgtggtagtggatgcctgtggtctcagctattcaggaggctaaggcaggcagatggtggttgaggctgcagtgagccataattgtgctactgcactccatcctggggaagagggcgagtccctgtctcaaataaagaaaaaaaaaaaaggaataaatgaaaacatgttcatgatataagtaaaaagctttaaaaaaaatgacttctgcatgggaaaaaatattttgaacaagctaaaagagaagtaagactctagaaaaatatttgcaacatataaaagaatcaatatccagtcaagataaacaattataaatcagtaagaccacaaaaaaattaaatgaacaaagactaaagacactttatgacagaataaataatccaaagaaacaacaaagagatgagaaggatctgaacctcactggtgaatgggaaaatgcaaaataaggcaaaataatactggatcatctagatcatggaaaatacacaatttgataacatagtaagtgttggcaagatttgcagcactgaatgtttttgtgcagtgttttccaacactaacaaccaattctccaattatctaaacataaactagatgtccaacaattcaattcaattctgacactatctttgtcagaatccacagatttaagggttcaatcctacaagactgcctcctcttgagttcctctgcccggccgccccactgtctgggaagtgagaagcgcctctgcctagccgcccaccatctgggaagtgaggagcacctctgcccggccgccccacaccaccgccgccatctgggaagtgaggagtgcctctgcctggcccccgcaacgtctgggaagtgaggagcgcctttgcgcggctgctgtgcgaccctccaagtgtgaagtgacagccttgtgtgtgatctttctgccctccccaagtttgcattttcgacattaaagtttacttttcaattaaaatttttaaattggagaatatataatttaaaaaaaaaaaaaaaagactgcctcctcttaagatgccagtcacaagtcctgggctaccagtatttctgactaactggctataaattagaggctcccacaaacccctcctcaggtttgataatttactagaacagctcatagaactcaggaaacactttacctatggtacctagttaataatagaggatataactgaggaacagccagactgaagaaatgcatagggcaagatatggaagagggtgtgccaagcttccattcctctctgcgtgtggcatcctcccagcaccctggtatgttcacaaacctgaagcttgttcaagagtacaaaaaattagccgggtgtggtggtgggtgcctgtagtcccagctactcaggaggctgaggcaggagaatggcatgaatccggaggcggagcttgcagtgagccaagatcatgccagtgcccgccagcctgggcatcagagtgagacgccatctcaaaaaaaaaaaaagaaaaaaaaaaaaagaaaaaaactcacagcctgggcgacagagcgagactctgtctcaaaacaataataataataaataaaatttttttttttttgagatggagtatcgctctgtcacccaggctggagtgcagtggcacgatctcagttcactgcaacctccacctcccgggttcaagggattctcctgcctcagcctcctgagtagctgggactataggcacgtgccaccacgcccagctaatttttgtatttttagtagagacgggctttcaccatgtaggccaggatggtctcgatctcttgacctcatgatccgctcgggattacaggcgcgagcccccatgcccagcctgttcaagagtttttatagaacttactctccagtccattcctcctttcagttccaatcctctaattgcttggtctttctggggaccagtctcatcctgacactatctagaggtctcatgagtagtcacctcatgagcagaaattcaggtgtatcacagggtttccttatgaataacaaaagacacacctatttctcaggaagaaattccaagggttttaagcatactgtgccatgaactgggaacaatgaccaaatatacttatccgtgtcactttctatataccagactgtgaaaaataaatatacatttggtctctgccctccaaatctttggaattgctgaagtgtcttttatatgctattgagatgactggtgcctggggctcttccatggcctcaggaagggagctggttgccaggggaaccaaccttgtgacagacagttggaactttcagtctcacctctccaaccaacccctgacctctgtggaagggagaggtgatggaaattgagcttaccaccaatagttaatgaattaataaattatgcctatgtaatgaacccaccaaaacaataaaaggatgaggttgagagcttccaggctgctgaacatagggtagtcctgggagggtagaatacccagaaagggcatggaagccctgaggcccttccccattacctgacctatgcatcttttccaactggccattcctgagttgtaccctttcataataagccagtaatctagtaagtaaactgtcttcctgcattttttgagccttctagcagatgaatagatctgagaagggggttgtggggacatccaattggtagccaagtccaaaagaacttgtgagtaacctggggacccagcacttttcaggggggcagtattgtgggactgagccctcaacctgtggagtctgtcctaagtctagacaattagtgtcagaattgagtaaattttagaatacctaataggtatggagaattgaattgatgtgtgggaaaaaccccacatatctggtgtcagatgtggggaaaagaaagagagatcagactgttactgtgtctatgtagaaagaagtagacgtaagagacttcattttgttctgtactaagagaaattcttctgccttgagatgctgttaatctgtaaccgtagccctaaccctgtgctcgcagaaatatgtgctgtgttgactcaaggtttaatggatttagggctatgcagaatgtcctttgttaaaaaagcacttgaaggcagtatgcttgttaaaagtcatcaccattctctaatctcaagtacccagggacacaacacactgcagaaggccacaggggcctctgcctaggaaagccaggtattgtccaaggtttcttcccaagtgatagcctgagatatggcctcgtgggaagggaaagacctgaccgtcccccagcatgacaccgggggatacccgtaaagggtctgtgctgaggaggattagaaaaagaggaaggcctttttgcagttgagataagaggaaggcatctgtctcctgccaactacttgggaggctgaggcaagagaatggcgtgaacctgggaggcagagcttgcagtgagccaagactgcgccactgcactccagcctgggcaacagagcaagactctgtctcaaaataaataaataaataaattagtaattttaaaaaagttggttggcaggcaccagcatgcaaagaatgccaatattccaaaaatggtctggagtatgtacattaaaatgacaaccatagttccttcttgagtggtgggtgattcatgtatcattgtaatggtcaaaagttgaactaccaacaaagcatggattctttcatattgagtctacttttttttccttctttttgagacagggtcttactttgtcacccaggttggagtgcggtggtgcaaacatggctcactgtagcctcgtcctcctgagctctagcaattcttctcccaccttagcctcccgagtagctgggattacaggtgtgcaccaccacacccagctaatttttgtattttttgtagagacggggtttcaccatgttgcccaggctggtcttgaactcctgagctcaagcgatccagaatctacttcttaaggcagaatgaacccccacctctactcccaaaagcaatgtaagttaatttctccctagaacacaattatcccagtatatacttccttaagttcaactgacttcttcaggccaccataaatctatcaaaaaatcaaagggaaaatatcacctgggtcttgatcattttcttctgtgctcagaaaatagtggataacatggactatacgtctttgtctcttctgcatttgccatgaagtttttgaagttttcctagtcagaaatattagtgtccacttaaagttgtccccagaaattatgatatccaaggccagcaacctccttcttcttccttcattgcttcacttgagttattttgcttctgggagccaggacctgaggactgataaacaaaatggctttcagtgtacattaaccctgggtccagacattgtcactgctgctctgcacttaccttaaataaaagaccctaatatttctaacagttcctttatttgctgcctcagaggttttcatggttctaaatgtgtgaaatctatgcctttcttttgtgaagtagaagtggcatgactattatagagaaggtgggaaagcagaaccagcacagcacaatgcctcagaggcaggtgtctggggaaaagaaagagagatcagactgttactgtgtctatgcagaaagaagtagacataagaggctccattttgttctgtactaagagaaattcttctgccttgagatgctgttaatctgtaaccctagctccaaccctatgctagcagagacatgtgctgtgttgactcaaggtttaatggatttagggctgtgcaggatgtgctttgttaaaaacgtgcttgaaggcagtatgcttggtaaaagtcatcaccattctctaatctcaactacccagagacacaatacactgcggaaggccgcggggacctctgcctaggaaaaccaggtattgtccaaggtttctccccatatgatagcctgagatatggcctcgtgggaagggaaagacctgaccgtcccctaccccgacacctgtaaagggtctctgctgaggaggatcagtaaaagaggaaggcctctttgcggttgagataagagaaaggcatctgtctcctcctcgtccctgggaatggaatgtctccgtgtaaaaccccattgtctgttctatttactgagataggagaaaaccgccttagggctggaggtgagacatgctggtggcaatactgctctttattgtaccgaaatgtttgtgtgcgtgcacatcaaggcacagcacgtttccttaaacttatttatgacacagagacctttgttcacatgttttcctgctgaccctctccccactattaccttattgtcctgccacatccccctctccgaggtggtagagatagtgatcaataaatactgagggaactcagagaccagtgccagcgtgggtcctccgtatgctgagtgctggtctcctgggcccacttttctttctctatactttgtctcttatttcttttctcagtctctcatcccacctgacaagaaacacccacaggttgtggaggggtggcccccttcaaggtgaattctcagacagatcaattttaggaaagagaacacatggaaggctccaagaatgtctttaaaaaccacgtgtgcccatgtactggttcgaaagtctctgtaagctctttgggtatacatacctcgtgtcaagaccaatgtactaagcaaatcacaagaactgtctcatttcacattatgcgctaaaggagtaactttacccaagagagctttgtcctttgcccacagttcctatgaggcaaactctaagcctttggaatacgctgcttgataaaactgtctttggttatcagggcaatttaagccatgccaaattgtctatcctaataatgtgatttactgtgggagaccttggaccacgtggtattagtttgatatctggaggagctggagattgaagtcagcctcataggcagtcaattgtgtgtgtgtgtgttaactgatatccaataaaactctggacaccaaggcctaggtgagtggcaacaatggttacaatggctggcaataataatataagggtgtatatataagaatatgataatttaaaaacgtatgaagcaaaacagaatgagagaggattagacaattcaacaataataattgaagactacattaccctacttgcaataataaagaaaacaaatagaaactcagcaaggataccgaaaacttgaacaacattatcaaccaactagacttaacgaacatttaacactgcactcaacagcagtaaaataaacatttttttcaagagcacatgttatattcttcaggaaagataatatcccatgtgatagcctgagatagggcctcatgggaagggaaagacctgaccgtcccccagcccaacacccgtaaagggtgactcacaagggccccagacccagacagagtcggactcgtcgctgatttcctcagactcttcatccctacagccaaaggacccgtcattaacgccccgcttcctcagcgactgcgttcaaatacagccccaatcaggacgctccacgcaccatcggtacacagacccacaggccgcgagtccatgcccagaactcgactcacccgagcccgaacctctccagacaccactggcagcgacaaaacgccgcatccacgtccgaaaacgcttcctattcagacgcgctcctgcgcggactccgggaagctgagcggtaaagaccgtgaagcgaggcgaggaccacggagcctgcccgggatcgcgagttcagactgcgggcgccgctctat

SEQ ID NO: 409 - DNA, 15397 bp, Homo sapiens
  source 1..15397: mol_type = genomic DNA
tcatgtggacgttgtcatagttttaatgaaggttgacaaatgaaaggttacccccaatccacagactctctctcagatgagtaattttctatacattggtacatcaaagaattcagagcctgaattcatgttgaagcctttctgacattgatagcattcatcctagtgaataacactggattttgaaatatgatttttcatactcagtacacatgtagaaaatctatactgtgaaatctctgatgttgtacaaggcagattttcttcccaaaggcatgaacatgtccactgcattgtcagggtttgtttccattatgagttcgctgatgtacaatgagatttctctttgaggagaaggcttttctacattcactgcatacaaagggtttctctcctgtatgagttcgttgatgaacaattagacggctcttcatagtgaagcctttaccacattcattacatccataaggtttttctccagtatgaacttgcttatgtaaagcaagctctgtttccttggcaaagcctcttccacattcactacatatacaagatttctcttctgtatgaatttgctgatgtacaatgagatagcgtttcatggtgaagccttttccacattcactgcacataaagggtttctctccagtatgagttcgctggtgtacaacaagattgctcttaaaggcaaaaccttttccacattcattgcatatgtacggtttctctccagtatgagttcgctgatgtaacatcagtccgctattcacaatgaaacctttcccacattcactgcacctgtaaggtttctctccagtatgagttcgctgatgtacaatcagccgactcttcaaggggaagcctttcccacattcactgcatgtgtagggcttctctcctgtatgagttcgctgatgtatgatgagcatgcttttcacagtaaaaccttttccacattcactacatagatatgacttctctactgtatgatttctctgatgtacaataagattactcttcctgggaaagccttttccacattcactgcatatgtagggtttctctcctgtatgagttcgttgatgttcgatcatacggctcttcatggtgaagcctttcccacattcattgcatatatatggtttctctcctgtatgatttcgttgatgtatgatgacatagtgttttgtggtgaagcctttcccacattcactacagatgtagggcttctctcctgtatgagttcgctgatgtataataagcatgctcttcccagtgaagccttttccacattcactacatatataggatttctctccagtatgatttcgctgatgtacaatgagattacgcttgcctgggaagccttttccacattcattgcatatgtagggtttctctccagtatgagttcgctgatgttcaatcagacggctcttcatagtgaagacttttccacattcactgcatataaaagatttctctcttttatgaattctttgatgttcatttagcctggactttctggagaacacttttgcacacaaagtacatccataaggtttttctcctgtatgaactctctcatgatcagtgagctgagacttcttgacaaacgctttcccacattcactgcatacgtggtttttttctatttcatgagttctctgatgcttactgacttgggatttagtgctattggcttttgtacttacagagaatttagctgcagaataaagttcttcatagttaccatgaagaaatgatttcccatctccactaaatttagtagagttgttaatttcacagcttttgttctggttgactaaacttaaatttgatttcaaagtttttatatataactcaaatgtatcatgattttccctgaaaagacaaaggcttttggtttgagaggcagtatttccaaatgcattatgttcatggtattgttccacactcttcagcatcctttgattttccaagtgatcctgcagatgatcatcaacttcgttgttttctaggaaagaagagaacaatgaatccttttataatcttgttggggataaaactgtcttcttagaaaaaaaaatccttggtgttttattttgtttattattattattttttgagacagagtctcgctctgttacccaggctggagtgcagtggtatgatctcagctcactgcaacctccgcctcctgggttcaaccaattctcctgcctcagcctcccaagtagctgggattacaggcatgtgccatcatgcctagctaatttttgtatttttagtagagacagggtttcaatatgttggccaggctggtcttgaactcctgacctccagtgatacccctacgtcggcctctcaaaatgctgggattacaggcatgagctaccacacctggccaggtgtttttaaatatcgctatttaatgacaatactacaataatagtataaaagcaacttcatgtatacactttggtaaaaacataataatataaacaaaccaaaaagtaaaagcagtctgtgtgcaaataaggtgaggcagttgacaatctatatcgatttgacagctttctaaacaggaccttgcaaaacatgcggacacagtaaaatacaagcaagtcattattacaagcaaacaacagggcttggaggaacaccattccacaaaattttgggagacaccagaccacaaaggtggaaaaggcaactgattcacaattctgagggttgtatttattcactccactagttatttgtcaaatgactcctatggacaaggcactctgctggcatttgggatacacaaaatatgccttcttttcactcatgctgaattctaattaggaaaaacaatacgaaggaacaaaaaaagaagggagttggtgatgttaagtgtggtttgatggagcagtgtagatgatgagagttggagaaaagcaggatatttttgtataacgaaaagacaaggttaaatgatgaattcaatggggagagtgaggaaagtgagggctcaaagattactaactatatggcttgagccactgggtagatgacagcatctgataatgagatggcaaatattactgcagtccagcacatgtaaagtatatactgtgaaacacactttgaaatggttatcaaatatgtaacacagacatcaagaatctggttggaggtataaatggagaaggcagcatggaaataatcagtacatacatattatttgagaaaaaaggactgaatgacttttttttttttgagacagggtctcactgtcacccaggctggcatgcagtggcacaatcttgcatcactgcaacctccacctcccaggctcaagcaattctcccacctcagcctcctgagtagccgggactacaggcacatgcaaccatgcctgattgatttttgtattgtttgtagagatggagtcttgccatattgcccaagctggtcttgaactcttgggctcaagtgatctgcccacctctgcttcccaaagtgctgggactataggtgtgagccaaggcactgagccaggataccatgttgagaagacatgtagaatgaaagatgaaggtacagaaccaaggttgtagacattccaacatgtggttttgggattatttaagccctgttagaggaaccaaactgtgaatacaaagatcagggtaatatgcttactgagatatatagaataaatacattcacgtacatgttgcctggcaagtaagaattggaaatctccatctgttgaaattaagtcaactgagatagactcttgtgtggtaattgttactaaatttgcccctcttcaatctgtagactaccatctaactttccaaaaacatccatcacgtttaatgaacaactcctatagtcaacactccaccctttggtttagctgtgttgcgttatcatatgtttcattaattatgaaacaggaaaacaatgatagggaattttgcaactggccagtgtaccatgtagttgccttcagaagaaaatgtgctgctgcatgggatatgaaaactgtcattttcttcaatcacattctgcatgcagtagaaaagtcgtatcaaggccaggcacggtggctcacacctgtaatcccagcactttaggaggtcaaggtgggcagatcacttgagctctggagttccagaccagcctgggcaacatggtgaaacacaaaatacaaaaattagccaggcatgcatggtgatatgcgcctgtagtttcagctacttgggatgttgaggtgggaggatcgcttgagcccaggaggttgaggctgcagtgagccaaaatcgtgccactgcactccagcctgagcaacaaagtgagactctaccttaaaaaaaaaaaaaaaaaaaggtcatatccaatttttcccatttcaatgtccctgatacactgtttcctcatctgccaccaataacatctacttcagtaagctacatttatgtctcagcatcagttaagttgtactaaaggataaacttcttctagacaaaggttgtggcatcttcaccttcagtttttcttaagatatttagctgtttcttattattgctacactgctgtcatccaagtgaaaggtcaagactagcaacatattttatgaaaagacaaaaatataaaattaaccaaccctcaaccatgctacctcaattactcatatatacaatcaaaagtcatcttgataaaaaaaagtttacattaccatgaatattaccatgtttctgctccacgatttctccaacaagcagcttctatcactgacctgtatttggccaacttgaagccaatcttttgatagtcaggcccatggccttgcacaattcctatttcatgccttcattcttttttttgagatggagttgtgctcttgttgcccaggctggagtgcaatggcacaatcttggctcaccacaacctctgcctcctgggttcaagcaattctcctgcctcagccttcctgagtagctgggattacaggcatgtgccaccatgcccggctaattttgtatttttagtagagaaggggattctccatgttggtgaggctggtctcaaactcccgacctcaggtgttccccccacctaggcctcccaaagtgctgggattacaggcatgagccaccgcacctgacccatgccttcattcttaattcatgtcaccatcttcctaattcaaaatctagatatgccttgtgcacatcatactcttgctgcaattctgactatcctgccatatgctctatgttctctgtattccttaattaacccctttattgttaatttttatggtaatcttctgtgtagtgaggatctagctctaacctcatccaaacagagatctagcatttgttcttagctattaggaaatgatctctaggcccctggaatgtcctggcccataggagtgtctttgtttgcctggtggctttagccactggacagtttaacaatatgatttgtgataggggctttggcccatgccatatcacttccagcctttggaaaaactggacactctaggtattagcctgacttccaggagaggctgaagactaaaagtcagccatgtgggctgtatgtgactgaaacctaatcaaaactctggccaccaaaggctcaagtgaacttccctagttgtcaatactctgtactgtcacacactgtgtggctgggaagagatgtaacatccacagtgagaggaggaccagagaagtactgtacttggaccccctcctggactacaaatgacctggcaattctactcctaggtgaaggctcaagaaaaatgaaaacatacgttcctaaaaaagttgtacatgaacgttcatagcagcatgattcataaaagccaaaaagtagaaataacccaaatgtcaatgcaatagatgaattgataaataaaatgtggtatatccatacaatggaatattattcaacaataaaaagaaattaagcactgatacatgctaaagaatggaagaatttcaaaaacattatgctaaatgaaagaagccggacacaaaagaccatatatttcatgattctatttatataaaatgtccagaacaggcaaatctatagggataaaaagtagaggccaggcacggtggctcacacctgtaatcccagcactttgggaggccgaggcaggtgggtcacgaggtcaggagtacgagaccaaactggccaacatggtgaaaccctgtctctacaaaaacacaaattagctgggcatgatggtgcgcgcctgtaatcccagctacttgggagcctgaggcaggagaatcgcttgaacccgggaggtggaggttgcagtgagccgagatcacaccattgcactccagcctgggtgacagagtgagactccatctcaaaaaaaaaaaaaaaaaagaaaagaaaagaaaaagaaagtagattagtgattgcctagggctgggggcttggaaacaatttttttttttaagtgatactttgaaaatcttccaaaattgactatggtgatggttacataactgttcatacactacaaagcactgaaaaataaactttaaattggaaaattgtatggtatgtaaattatctaagctgttgaaaaaacaaatctataatgggaaaaacacattagggaaatgaatacaatgctaccgtctaagatgaactaaaggaaaagtagaaatcaaatgtacaaaggaagtactctgagacagacataagttatgacctggtttggtctagaactgatgtaggacataaaacagtcctttctaggtaaacagtaaacaaaaatagtagagacttttaagaagagaactccataggtagaggacattcaatacaacaccagcacagacaggacagatgtatggtactaaaggagaatgcaaccttaaaataagatgggaagggtttcttgtggagggaaaacgattcccattcctaatgtaggcactgcttctgtgtcctcagacacccacagagccttctttcactgactataatattacttacgcatcttgctgcttctcacatacctggacagattcgactgtgcctttcatcttccattgtccatggttcttctcctcgttccaacttggagagtgcatctggtttgctgacttgataacctgtttacgggaaataatagaagacagacacactggattgggctggggtatgtaatgtgagagaatgttacatttaagtaactagacagttttcacatctgaaagtagaggcttctctctcaggaaagggcagattacagtcagaccttaatatctgaaaatttcacatccagggattcaaccaaccatggattgaaaatattttttaaaaaacaataaaaaatacaataataaaaaaaaatacaaagtgcagtggctcttgcctataatccgagcactatgggaggctgacatgaaaccaacatttgaagccaggagtgggagaccagcctgggcaacatagactccatctctacaaaaaaaaaaaaaaattagccaagcatggtggtttgcacctgtaggcatagttcctcaggaggctgaggcaggaggaacacttgaacccagttcaaggctgcagcgagccatgaaggcaccactacattccagcctgagtgaaagaccgagacactgtctctaaagaaaaaataaataaataaattaattaaaacatatagtataacaactatgtacatagcatttacattgtattaagtatcaggcataatttggagatgatttaaagtattcaggaggaggtgtgtgtaggttatatgcaaatacaatgccattttatatgagacttgagcatctgtggatttcatatccatggaaagttgtgaaaccaatccctcttggacactgaggggtgacggtatatccttttatcagaagccagaggatgtgccaaaaatctaatattcagagcactgcagtaacttccaagggtaagcaactgagaaagcaaaggccacagactgggcaccctccaggtgacacagagcagctgtcctcacccattgatagcaggttgctgtagatctccaacatcacatcccggtacaaatccttctgaaaagggcccaggagctgccactcctcccaggtgaactccacagtaacatcctccagtgtcagcaattcctgtaagaaaacagagccttgcttaataggaagtgtttctcttttactgacatgaaaagaaagtgaagggaagttgtcccgctcacattaaacatatagactgcatccatctataagtctattgtattttttaatattgccagagaatctccaagtattctataattgcacagtgccccatttgctcaacaaaaattaaggttttatatcaaatcctctcagtaaaagcgggttttatgtataaattttaattttggtatctattgaccagtcaagaaagtatatgctactgacatctagatatctgatataaattgtttcattcactgttaagccttcccagctaatactagcataagacatagagagacttcagatgctagaaccacaggatactacattcatgtttaattgttaaatggattaaaaaatagaaatgtacagaaaacatgagaaactattaaagagtaaccaaattgggaaaacttattcttggaaacatacattaaatatatatgtatgcacacatacatataaatatatgtttatgtatatatacgtatacagtcacaggtatatgtgtctattaacagaaaggttatattaaatacactgaagagataattagtgagttggaattcacagtaaaaaaaataacagggccaggtgtggtggctcacacctgtaatcccagcactttgggaggctgaggcaggcggatagcttgagctcaggagttcaagaccagcctgggaaacatggtgaaatcctatctctaccaaaaagacaaaaattaaccaggtgcggtggcacacacctgtgatcccagctacttgggagggtgaggtgggaggattgctggagcccaggaagttgaggctgcagtgagctgtgatcatgccactgtactccagcctgggtgacagagtgagaccctatctcaaaaaattaaaataactgaaaaatgaagcagagacacaaagtgacagaaagtatgaaggagactttactaaatatggaagacagagtgaggcctaacatatgcctatacatagtttttgaaatattatattcaaataagagaagcaatttccaaatatctgactgagaaattttcagaactgattaaatatcctataactcaaatttaataaatcaacaaagccaagcagaaaatctgcatctagacacatcagactgaaactattgaacatcagatgcacatataacattatgcaaacaactgttaatagaaggaaaagatgcattaccatcaaaagaaaaataaaatgtcctaacaactgacttccacagaaacaaaagaagcaagaaaagtgcagaataatgtcttcaatgtcctgattctgtggcaattggcaaattgtatggtatggcctagccctgaatgccactggaaaataaattgagaccctcttgtcaactaaactgccactctcctgtctcaacatgacttataatcacatggtagtaggaacttgaggcaggaaagagctaggtgcaaatttgtggggaaaagcaagagagatcagattgttactgtgtctgtacagaaagaagtagacataggagactccattttgttctgtactaagaaaaattcttctgccttgagattctgttaatctatgaccttacccccaaccccgtgctctcggaaacatgtgctgtgtcaaactcagggttaaatggattaagggcggtgcaagatgtgctttgttaaacagatgcttaaaggcagcatgctccttaagagtcatcaccactccctaatctcaagtacccagggacacaaacactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggcatgcctcttgcagttgagacaagaggaaggcatctgtctcctgcccgtccctgggcaatggaatgtctcggtataaaacccgattgtatgctccatctactgagataggggaaaaccgccttagggctggaggtgggacattcgggcagcaatactgctttgtaaagcactgagatgtttatgtgtatgcgtatctaaaagcacagcacttaatcctttaccttgtctatgatgcaaagacctttgttcacgtgtttgtctgctgaccctctccccactattgtcttgtgaccctgccacatccccctctcggagaaacacccatgaatgatcaataaatactaagggaactcagaggctggcgggatcctccatatgctgaacgctggttccccgggtccccttatttctttctctatactttgtctctgtgtctttttcttttccaagtctctcgttccaccttacgagaaacacccacaagtgtggaggggcaacccaccccttcacaaattgatgggataatctatccccatataatcacagagattaatacacagagaaaagaacagacttgctgaagtctgcaaattcttaatgctgctgatctcatcacattcgggaattatttcacacgagaaataaatctgtttgaaaaaaaatgtaggtttctacctaatttcatactcaaaaataagtttttcctgtttaaagtccttaccagaaagcaaaagaacctgtggaagcagaagcaaatacgaaatatattcatgttaaaagccataaaggaaaaaaaagggacaaattttatgagaaaaaaaatttaatttctacattgaaaaacagatcataaacaaagctgaaagaaaaatgacaggctaaaaaaaactttgcaataaacaaaagatcaatatatagtagatataagcaactcattagccagtaagaaaaaagtttttttaatgtaaaaatcataaagtcaggcatttcacaagagaaaaaaatccagttggccaagaaatacacaagaaggctttcaacctcacctgtgatgaggaaaatgcaaaataagacaaaagaatattggatcattgaaaattgtataatttgataatgtcatatttttaagtattggcaaagatttaaggcacaaaggactccatgtatcagtttctatgtggcaggcactcatctaaatactttacatagtttaacaatgttttcatgtatgactttagacaaatggaattttatacagtcaatattcttcaattaattgcagtgattattcctttatattctaaaactacaccacctaaggtaggggtgtccaatcttttggcttccctgggccacactggaagaagaaatgcgttgggccatgcataaaatacactaacactaacgatagctggaaaaaaatgcaaaaaattctcattataagaaaatttacaaatttgtgttgggccacattcaaagccatcctgagctgcatgcagcccacaggccacaggttgtacaagcttgatctaaggtgaccaacaggtggaatgtgattccactgaagcaaaagaagtcataataaatgtgtttatatatgcagacacatacataaaacacatggatttataaatacacatatatacagagatgcacacatttcagtgacagcaagtatgtgctaccaaacatttgttgaagcagtataagaggattaggaagaaagttatgaagagggaatctacttttactttttttaccttttttttttttttttttttcgagacggagtttcgctcttgttgcccaggctggagtgcaatggcatgatctcggctcaccacaacctccacctcccggattcaagcgattctcctgtctcagtctcctgagtagctgggattacaggcatgcgccaccacacccagttaattttgtgtttttagtagagatacggtttctccatgttggtcaggctggtcttgaactcccgacctcaggtgacccgcctggttggcctccaaaagtgctgggattacaggcgtgagccactgtgcccggcccggaaatttacttttttaaccagtgtgtacttcatcatcagaatttatttccctgtgaggccaggtgcagtggctcacgcctgtaatcccagcactttgggaggccgaggcgggtggatcacctgaggtcaggagttcgagaccagcctggccaagatggcaaaaccccatctctactaaaaatacaaaaactagccaggcatgcaagtgcacacctgtaatcccagctactcaggaagctgaggcagaagaatcccttgaacccaggacgtggaggttgcagtaagccaagatcacgcactgcactccggcttgggcaacagagtgagattccatctcaaaaaacaaaaaccaaaaaaaaaaaaaaaaaaagaattttttccctttggattccatgagtaatttatgtaattacaaaaaataaaagcaatataagtatgcaagaattggaggtgaaaatgcagaaggatattgtatattctgagatgaggtgaagttatcaaacatggcacccaacgactcaagaccttatcagacaactccctaatgccaaatctgcagttaatgccagttcagccacatgttcaggaaaatggaagctatgcacaccttccattttcctaggtcacttagattttattcctaaataagctcacacagacacgcaagacttgagtgtgtggccttgctttcgtcccctaaaaaaactgtttccactgagtttgcctggtctatttccataggagtctctgaggaaccgtgtaataaacagcagtaagaaatcttctgcctttattagaaagctagttcaaaacactgttcaccatatcacctctgggaagaatagcaaatttttcttgagatctaagtgccatgaaataataatctcctgaggaacctgtctgctttctccccacagtcactgtataacttagtgtgactttcttgtactggctgtcagagacatcagatgcaaactgagagctaaggtaatggaaaggatcttctagtcaggcattattttccaacatcagtcattttgtaggaatcacataaacactatattcctgatcttactttgccatgatgttggagttagatttaaagtttatttctctctagattctgaaatgatttcttacgggtctctacaaatccactatggaataaaggagagaataaaatagagaaaaagtcacctgggcattgatcattttcttctgttgtgggaaatggccagcacctgggatactctgtctttgtctcctctggatctgccttaaatttctatttagaaacttcagtcaccagtgaagggtgtccacagaaatcatatctaggtcctggaatcttcctctttcttcatttacttcttgtctcttcccagggtagccaggacctgtggactgaagagcaaaacaactttcaggggtacattcaccttaacacgtggccctgaatatttgtctctttatttggttctctcaaaccaaggaaacacaagaccctcaatgtaggccaaatgcctttcttcggtgaagtgtggaagtaacatgaagatgaaaggggaggtcacaaaggagaatccacatagcatcatgcctaagcagtaggtaattctcatatcagttttttaaatcaggccatatggatggtgagaaactacattttttcctttatacaatgttactctcacacctctttaaaagtctttatatatatttaaaagtgtttatatacggccaggcatgatggcttacacctgtaatcccagcactttgggaggccgagatgggcagatcacctgaggtcaggagttcgagaccagccttgtcaacatggtgaaacactgtctctactaaaaatagaaaaaattagccaggcatggtggcaggcacctgtaatcccagctactcggagactgaggcaggagaatggcttgaacgcaggaggcgaagtttgcagtgagcccagccattgcactcaagcctgggcgacaaaagcaagactccatctcaaaaaaaaaaaaaaaatgtttatatacacacttcaatatgaagaacaagaaacacatagaaaaaaagagggagacagagaaaaggaatacgagttataaatacaaatttagaaaacaattcaaaaatataaatactgggaaaatagccgcctttatatactaacatacaaaacctgaaacacccataaaaatatgcagtacatttgcaagaggaaggataaaaataggctcttgttaatttgtgcgcagtaatttaaaaacataatgttaaatagaaagcctattcatccgccccccttcacccccaaaaaactttcattttctgcaggttcaagagcatgggttgttgtggaaagccagaggattagaaaactcattgtggaggaggtactcggacctgaaacttttaggaaatgttaacgttcatcaagtctgttccagccaaagtttgagctcaacacacacacacacacacacacacacacacacacacacacacacacacacacacaaaaccagccagggctcttgtgaaaagacttcggctttcacttgtctctagacaaaagaccaccaccccgccagataaaataggaaaacctggaatagacacacacgtacactggattcccttaatgattcatcaatcactaagcctcagattaatccagaatgtgaaacagaagtcacattcgttgacaaaagccaccccatcgattctcaatcactgagccccactggggagtgacccgcgaggaccacaatccctgacctcagtactcttggtcgttgatctattcaggcctttaatcactgaccaccagagcctccatgagggaccccaaagatatcctatcacagacacccaccagggactcctaccagctcccctccaaaaggaaacacccgcccccgcctcccccaacccccgcgctacctccaccatatagcgccaccaacaacgcagacgccctcagaaagctccctcccaccacgtttccacgccctgacccacacactgacctgactctccttggaatcgccgcgacctcttaaaagctgaacttacttccctaaacttcttccacttctgggcccctcgcccaactccctccccctctaaacctccagagacggtcagccgcgttt

SEQ ID NO: 410 - DNA, 31300 bp, Homo sapiens
  source 1..31300: mol_type = genomic DNA
aatgtataaagaggtttaattgactcacaattttgcaggctttataggaaacatggcgctgacgtctgttcaccctctcgggaaacctgaggaaggttaaaatgatggtgggaggtgaagggcatgtcacatggccagaagaacaaacaagagggaggtgccattcactttcgtgcgtgcgtgtgcgtgatggagtctcactctgtcacccaggctagagtgcagtggcgcgatctcggctcactgcaacctccgcctccagggttcaagcaattctcctgactcagcctctcgagtagctggtactaccagtacccgccacgaagcccagctaatttttgtatttttggcagaaacagggtttcaccatgttggccaggctgctcttgaactcctgacctcaagtgatccgcccacctcagcctcccaaagtgctgggattacaggcatgagccagacctcatgagaactatcacaaggacagcaacaaggggatggtactaaaactttcttgagaaagccacccccatcatccaatcacctcccactaggctccacctccaatactggagattactacaattccacatgagacttcaaagggaaaggacaaatatacaagctatatgagtaagtataaattatttggggatcccagaggttaggacaacatctaacggcctttccacattgagtttagttgtaaggttctctccagcatgttttatctgatgtttagtgaggcctgagcgactaatgtaagatttgccacactcattacatttataaggtttttcactagaatgaattcgttggtgtttagtgaggcaagaccgccgcccaaacgccttgccacattccatacatttgtatggcttctctccagtatggtttctctgatggtaaaccaagtttgacctttcgataaaagctttaccacattcattacatttataaggtttctctccagtatgcatcatctgatgattaagcagaattgaacgtactctaaaggctttgccacactcattacatttgtaaggtttctctccagtatgaatactccaatgacgtgcgaggcctgagcgataacggaagaccttgccacattcattacatttgtaaggtttctctccagtatgaattctccgatgccttgccagggttgtagtggagttaaagactttcccacattcaatacatttgtatggcatctctccagtatgtcttctctgatggtacaccagacttgttttatgactaaaagttctaccacattcactacatttgtgtggtttctccccagtaggatttctgtgatatcttgcaagttttgaactttggataaaagcctcaccaaattcattacagtggtaagggttctctccagtatgaattaccagatgtttagtgaggcttgaacgctgagtataggctttgccacaatcattacatttataaggtttctctccggtatgaattttccgatgacgtgctaggcatgagtagtaactgaagaccttgccgcattcgttacactggaaaggtttctctccggtatgacttcgcctatgaattgaaaggtttccactgtcaatgaagaccttgccacacacattacatttgtaaggtttctctccggtatgcattctttgatgacgtgctaggcatgaatagtaagtgaagaccatgccacatttattacaatggagaggtttctctccagtatgacatctcatatgaaccgaaaggtatccaccgtaattaaagaccttgccacacacattacatttgtaaggtttctctccggtatgaattctctgatgtacagttagtaatgagccccaattaaaggctttgccacattcattacatttgtaaggtttctctccagtatgaactctctgatgcactgcaagatgtgaatgttgactgaagaccttgccacattcattacatttgtagggtttctctccagtatgaattctccggtgccctgcaagacgtgaacgttgaaagaagaccttgccacattcattacatttgtaaggtgtctctccagtatgaattatctggtgccttacaagttgtgaattctgataaaagaccttgccacatacatcacatgtatatggtttctttcctgcatggattatatgatgtgcagtgaggcttgagttccgtttaaaggttttgccacattcattacatttgtagggtttgtctccagtatgaactgtctgatgagttgcaagagaggaactttgactaaagcacttcccacatcgattacatttgtaaggtttctctccagtatgaattctctgatgaactgcaaggtgggaacttttactaaaggacttgccacattcattacatatgtagggtttgtctccagtgtgacttctccggtgatttacaagatctgaattttgtctgaagatcctgccacatacatcacattggtatggtttccctcttgtatggactatctgatgtactgttagtagtgagccccgatgaaaggctttaccagactcattgcatctgtaaggtttctctgtagtatgtatcatctgatgattaataagacttgaagacactctgaaggctttgccacactcattacctatgtaaggtttttccctaatatgtgttttctcgtcttgtgtaggtaacgaaagttgcaaaaaatcattcccatatttcctagaaatgttggtttggacaccaggaaaaattctttgaagtggtgaagctaaaaaacaattattaactgtcctctcaatttgattacatccataaattttctctgcagtttgaaatttctgcaattcacccagaccggactgaaaccttaatataagctgattttccatatgcttgttttctacgtccccttgactatgtcgaactctttgaccagtaagattgtttttatgggtcatcggcccttctttataatttatttcaccatctttccattgaaagtcaacttcctgtagatttttccggatttccctgaagtaaaaattttcagtgtcatagctttcatgtccttccaacatcactgcttggaatttttctcctgtgttactgttctgtattggtggtaattccttgatcacacatttaggagagatacctgcaaaatataatgaacatggggttttaaaataactattattggtaaatattattttatactgaaaacacactacgctaaacataatgtttatactagcaagttgtgaaacttttctaccatgatcttctatttgtagaaatgcaaaatgaatagaattctatagtaaagaaaaagtgattacatgtaatttaaatcaattttaggaaagcctagtttcaaacatccttcgaccaaaagactcatgttatgcaaacatatatgagcaccaaaacaagtattttgcaatcgctgaccccaaatgacacaccaattggcagtaaacatatggctccctcataataggagagaaaaaaagttacatatatttatttcatacaaatgaatgccaagcaacagcaagatatactgtaatggtaaatattaactaataaataatcataatataaattaattaataaaacattctaatagcctgtgataaaaccagcaggtaaataatgaacaaccacaaaatacaaatctatagtatgaaattctaaacaattctccatcaataataagcaagaatttatattctagaggcagtatataactagaaaatatgttgagatcactggcttttaaagataaaagaaaggtaaatatgtctatggccataccaccgtgaatgcatctgatcttgtctgatctcagaaactaagcagtgtcagaactggttagtacttggatgagagaaaggtaaatatataaaataataaagaataaaaattggggacaggtcagccgggcacggtggctcaagcctgtaatcccagcactttgggaggccgaggtgggtggatcacgaggtcaggagttcaagactagcttggccaacatggtgaaatctcgtctgtactaaaagtaaaaaaaatcagccgggtgtggtggcacgtgcctgtaatcccagctactccggagcctgagacaggagaatcattggaacccaggaggcggaggttgcagtgagccaagatttcgccactgcactccagcctgggcgacagagcagtctcaaaaaaaaaaaaaaaaatggagacaggtatggtggctcagacctataatcccagcattttgagaggccaaggtgggcagatcacttgaggccaagagtttgagactagccaggccaacatggtgaaacctcatctctactaaaaatataaaacattagccaagcgtggtgatgcatgcctgtaatcccaactactcaggaggctgaagcacgagaatcacataaacctgtaagggggaggttgcagtcagccaagatcacgacactgcacttcagcctgggcaacagagcgagactgcctcaaaaaaagaataaaacttgggaaaggaaatcagaaatctcagttatgatttcatgcctacaactatgtaacaaacaacagagcaagtccctatgtattcattgtctttttttgcttttggctgagatggagtctcactctgtcacccaggctggagtacagtggcatgatcccacctcactgcaacctccaactcacaggctcaagcgatcctcccacctcagcctcctgagagctgggaccacagatgcatgccatcatgcccggttaatttttttgtagttttggtagagatgaggttttgccatgttgcccaggctggtctggaactcctaagctcaaacaatctgcccacctctgcctcccaaagtgctgggattataggcatgagccaccgtgcccagtcctattcactgtctttattatccagttccttggccacaaaatatatatgatacagagattgtacttggaaaatgcatgaactgagataaaagacaacaccgtttggaccaaactgcaaaatgaaaacttacagatacaatgtagactgctctgatataaagacttatgtctgccaaaattcctatgttaaggccccatcctcaatgtgatagtatttggaagtgtggtctttggaaggcaattaggtcaggatggtgcatagaacttcaggaatgcaattagcagaaacgtgaaaaagcctctgctttttgcatgacaatctctctgccacatgagaacacagagtcagccatggcacaccagaaaaaagtccacaccaagaaccaaagtggctggctctgacatgttgaactttgcaccacccagatctgtgaaaagtccatttctgctgtttaaaccaccctatctatggtatctgatatagctagtcatgctgactaaggtaaagccaatatgctatctcattataaacatgaaacaatgttgatacacgttattaaacaaatttgtgagtctgtactataaaacatgcaatattctaagctagctaacagcattaacttgtttaaaaagtctttaggtaaattatcactatttaacaaacaagcacactaaatatgcccacaggatttatgtatctatacccaatttacaaagaaagtaagacacaagaacctgggtttgcaagatcaaacatgttttttaaaaacaacttcccaaacaagcagtgcagataacaggtcaacccaaatatcaagagtgtagaaatacttcaagagccattttgtgtagagcacctgattctgtcgctgttcagggtgccactatgtaacccacatggacctaggaggactgaacaaagggggcgaatgcgggaataaaagacaagagacaaaagagtatatttggaagaaggggtcaggggcaccttgcctgtagtggacaagggccctgagctttacacagccgtccgtatttattaggcaagagagatagtgagaaggatggtggaagaaggggtcagctgcgcagtccagagtaggcttgcaagactgcattcctcaaacaacaggctctagatatggcagtagataaccctggcaccaggaagtgattgcctccagcaaaccttctgtcagcaggagcagtcatgagtttgcccacatcctgcattcatgataaacagtttgctgtttgatcatatagcctccagtggaatgctgagttggtcacgtcccacaggctttggctccctgcaatgctgtgttgccaaaagcattattcagccatccgtcatgaataacgaacggtatctgagtcatcatcccctgcacatattgatttacgcagtgttatcagacagtggtcaagtgaatgagtaggggtcaccccttacagagtgagagtagcatgggaggtgagggagttctgcaataatgggagtataaaattaatatgctagtcagtaactgggtagtccatctggacaaagtaatatgttaggaaaggcccaggaggacaaagggcaagaggggagatcaaggagtaatgagcatggagcagcagggtttgtgcttgaagagctgtgggaatagaattgcacaagaaacagctaaaatcctggctttggaagaaaagagaaactaatgtagaggtagtattgtactgactaatacttaaacatgagaattatactatgggtgcaggacaacaagggaagacaattaaaaaggaggcggtgtgatgatatgggaagaaaacagatttatgtctctataatatttgctatgaaatttatcaaactgaatgtcccataagttctatttccaggtatatgctcaacaaccctacatatcaagagatatgtgaaagactgttcttacaattcaatccttaagaaaaaacctgaaaatggccacgaagaggagatggatgaattcattttgtacacacacaaagacaccacaaaactttactgatagtacaagaacgttaaggagacggggtgcagaatgaggacccgtagcacaacaggcaaagatttgagaaaacaaagaaagcaggagactcttgtcaaggtttaaatatatgttaatggagacacagtatatacgatgaaagtatcctgggatatcaaaaacacaacatggaagcagatctgtaaaaagtcatttctgtatgtaattgaagttaagctgttattagtttaaaataggatgttataaatctaaagtgttttctgtaattgcaacggtaaccacagagaatgtatagaagacacacacaatggaaataaaactatttcaggaaaaaaaaatcaactatataaaaacgaaggcagtaagacaaacagaacaaaaaaatctaaaagagatatagaaagcacttaacacaatggcaatataagtccttttctatcagtaattacattaaatgtaagtgtttatactccacagtcaaaagacagagactggctgaataaatttttaaaactggcttcagctgcacactatccagaaaatactcattttaattcaaaggacacacataggctgaactgaagggatgaaaaaagatatgccctcaaaatgttaaccgaaagacatcagaggtggctaaactgatgtcagccaaaatagactttatgtcaaaactggtacaagagacaaagaagggcattatataatgattaaaaggttaattcactaggaggatataacaatatgtgcctatatagagatcctcaatatgtgaagcaaaattaacgtaactaaagggagaagtagttccacagtaataataagagacttcaatggcctatttttacttataaataggacaatcagacagaagaaaaacaaggaactagagaacctaaactatatatcaagttgaacctaacctatatatgcataacacatcacccaaaaacagtgcaatacaaatttttcagaactgcacatgaaacatttttcaaaagaaatatcggaaaagaaaaaaaattttaaactttttaaagactaaaatcgtaaagcataacttatcccatcataataaaataaaactagagatcaacagcagaagaaaattagattatcaacaaatatgtggaaacaacatactcttaggccggtgtggtggctcacgcctgtaatcccagcaatttgggtggctgaggcaggtggatcacctgaggtcaggagttcgagaccagcctggccaacatagtgaaaccctcagccaagcatggtggcagatgcctgtaatcccagctactcgggaggctgaggcaggagaatcgcttgaacccaggaagtggaggttgcagtgagccgagattgcaccactgcactccagcctggacaacaagagcgtaactccgtctcaaaaaacaaaaacaaacaaacaaggaccatactcttaaacagccaatatgtcaaattagaaatcacaagggaaattttaaaaatctcaaaacaaaggaaaatgaaaatagaacataccaaaacttgtgaatgcaggaaaaacagtgctaagatagaaaatctgcagatataaatgctaacattaaaacagaagatatccaatggaacagaataggaaacccagaaatacagccacacacctacaaccaactgatccttgatagtcaaaaaaaaattgggaaaagacattctattcaataaagggtgctagaaaaactggctagccatatatagaagaatgaaactggactcctatctcttgtcatatacaaaaattaattcaagatgaataacgacttacattaagtcttcaagctacaaaaattctagaagaaaatctaggaaaaacttttctggacaaaatacaagttgttgtttttttttcttttttttttttagagacagggtcttgctctgtcgcccaggctgaagtacagcagtgtgatctcagctcaatgcaacctctgcctactggcttcaagcaattctcttgtctcagcctcccaagtagctgagattacatgcatgtgccaccacacccggctaatttttttgtatttttagtagaaacagggattcaccatgttggtcaggctggtctcgaactcctgacctcagacctcaaaatgatccgcctgcctcagcctcccaaagtgctgggattacaggcatgagccattgctcctggcccaataccagttttttaagagaatttattcttcattgcttgagcatcacgaaaaaaatatataggttttataaatagtagagaagtccctgaagtgtaagaaatgggctaagtttaaaataaagttagatttttaaataatgattcagtataacatgatggacatgaatgtagataggagaatagttattataatacagcatttgttccaagaaagaaaaaaacagtgcaatttgaacaaaacccagcaagctatatttaggaaactgaaacttactacagaaaagcaatgtatgttatataacaaagaacgatcaatctattaaatggtatttccacaattaagatagtaacttaaaaaattatgctcaagatattaaaaatttccaacttaaaaactgtaatcaatttaaccgacaaatatatactttcatagtaggaattaagtcaggtgaaacagaagtaaaaggaataactgatactatcaatacaacattatggagtttctgtaagttttagggaaactgctgctgagctataccatctgtactaaagaaggaaatcttgtaaaatacataaaacaatatgcattccccaacacaacactaccacaatagaaacataaaacaaagaaaactgagtatcctcaaaaatatggaactgattaaataaataaaaacaaagttcatttataatacatgaaaatgcatcagatgaaagcaatggttgcttaaaacgaattttgtggacttaaaaaagataagcctcattcaacttcattagcttcctcaagatcaaagtcgtactcactataaacaaaaatactggggaagaaaagtgtggcatgagcagtggttcaggcaacagccctgcagagatgaagctgtgaacctggacaatgttcttcccgggagaaatttttttttttgagacaaagtctcgctcttgttccccaggctagagtgcatggcgcaatctcagctcactacaacctccgcctcccagatttgagagattctcctgcctcagccccccgagtagctgggattacaggtgcctgccaccacgcccggctaacttttgtatttttagtagagacggggtttcaccaagttggccaggctggtctagaactcctaacctcaggtgatccacccgcctcagcctcccaaagtgctgggattacaggcgttgagccaccgtgcccggcatgggagaaattcctacaccattcactgctagctcaaaaaagaggaccattagtatatgagatcaacattgccacagtacccttgaaagatacttttgtgacatttctcagaaaccaggctcttgtgatggtctctatctgaatatcatgacaaatgctgatcattctactctggctttaatagttacctctgtatgtagcaagatgatgttaaaactcattactcaaagtgctctccttcaaaaattttctcttacccagtaaactcactccatacaatagtccacaagatattcataaccccaagatgggttatcacagcaggaaaaaagcataaaatgtccgaccctagaaatgcatttatccaaagcaagtctcagaggcaaaaaatcacacaaacataaaagagaatgcaagatcagaaagagccaaggcataaacaagacagagaaaaacacaggaattggattgtgagggatcttgaaatgagacagtgctctgtccacagatcccaaactaagagtgtgaagacagagatacgctccctgtgtaggactaagaataaagagaggacctttgtgtcaactgtctttacaattcttatatgtaacaatctcaggagacccaactcattcccgtgtcacaaacccaagaagagtgtccaaagaagaactaagaaaatggctgagggacctgaacaggcagagagggctgaagatagtccagttctaggaccccagcttcaaaggaagggcaaccaatgtttcctcatctcctgaccagcactttcaagtataggaaatggggtggaaccagaaaagttccaggcaccaggactatggagccctcagctccaatctatatggatcagagaactgaggatcagatggaatcaagaacaggaggagagaccacacgggaaagagacttctttgaaaaggcccttcccatgccacagagtcaaagcatcagagttcacacaatacagatgacactgtggtccatcataacagtcttgtactttgctctgtttgagctgcagcaacccctggagagtgaaaggtaaagttatacgtgtctggaaagcaaagtgataagcaggaaagaagaaaacttctggagctcacagaaaatcaaatttgtttccccacagaactctcccacttgcagagtcttacgcacacaatttcatggtaccgcttccattgtgcccatctgagctcttaccggtgatcacgcctttcatgcattccccacagtttgggttcctcgctattttcacttggctcaccacagtccagggctctttcccttgctccaacatggagataatattcaggtcaggaagacagagtcctgcttataaaaaaagaaagaagatgtcccacggtttttccagaacccagcctaatgtctaggtagaagagaaaacactgcagttgaatctacaaaatatttcacaaactcatccattgattgcctccttctgaatgcttagtgaacactgtaagatgaagatatctagctctctcccaagaaatactgaatcaaaaacacagggataggccaagcatactggctcaagcctgtaatctcagcactttgggaggccaagacgggaagatgacttgagcacaggagttcaagatcagcctaggcaacagagtgaaaccctgtctctacctgggcatggtgttgcacacccacagtcccagctacttggaaggctaaggtgggaggatggctttatcccaagaagctaaggttgcagtgtgccaagatcacaagatcacaccactgcactccagcctgggtgacagactgagactgtgtcaaaaaaaaaaaaaaaaagcacaaggatagaaaacaggaagaacagggaattggatatattaactccgccataaggttttacacgtacctcagctctggagtcaccactaatgtacaaagaaggaagcagaatatccatagaaatgggacagttaaaggccagatgcagcattatgaagctttttatttgtgaatcaacaaggcttcagtctctgtcaaataatgtagggcctcacaagaaacacaataaggaaagtacaaaaatgcacaagggaagatcctaacttctggaggaaaactatcctcacccaggaagccgaggttcctgtagttctccaacatcacgtccctgtacaaagctttctgaacagggtccaggcatttccactcctcctgagagaattctacagccacatccctgaatgtcaaagatccctgaaatgaaaaacacatttcaatatgagcagtgggtgagctcttatctttacataaaatgagaagaggagagaactgtcacatcaatttgattgaagtgtgttttgacatatccattaaaagtatctgtgagataattacgtctccctgattttgggttttataaaattcaataggagattaggatattatctaaatcggtgcacatttctcacttttgtggacaaaataagaaataaacacatggttatccctatgaaagttttagatattacatttgttacaccaagtgaggtgtccagatgagctagaatacaagtggtgtcttcagagatgacaatgttcttagtggctttaaagaaaggtcagaaactaaaaacagcgatgacaagagcaacagcaagaactaaagttttggaacactccccatgtaccgggcattacttcaaaggatttacgtgttctaactcaaatgatgacataatcacctatgacagaaatatttcttcccatcttactagaagacaactgtgtcacagacaggctaagaaagtcacctaggtcaacaacctgcaaacagcagagcaagcacctgaacccagatgtctaaaaattagagttgaatcaacagaatccgacagttatattacagagtatgtcctagtctttctgtgtggctataacgaaataagagagactaactaacttatgaacaacagaaatgtatttctcatgattctgctggctggggaatccaagatcaaggtgtcagcaggactgatgtcgctgagggctaatccctgcttcgaagatggtcttgttgctgcataggggacgaatgctacagtatactgacagagggttgcctgagaaaacttgaagcaagttcaagattaacttggaaccgcataaaggatcattatataggctaggcgtggtggctcacacctccatcttagcaccttgggaggccaagatgggtggatcatgaggtcaagagatcgagatcatcctggccaatatggtgaaaccccatctctactaaaaatacaaaaattagctgggcgtggtggtgtgcacctgtagtcccagctactggggaggctgacacagaattacttgaacctgggaggtggaggttgcagtgggccgagatcatgccactgcactccagcctggagacagagtgagaccccatctcaaaaacaaagaaaaaaaagatcatcatataagcacacagaagcacacacataatacattactattcataaaactaatccattcacatgataatatagaaggcaattttaaaaattaagcaaatcactgggacaaagaaatatgtaaaaaagtttttataatcccagcactttgggaggccgaggtgggcggatcacaaggtcaggagatcgagaccatcctggctaacacggtgaaaccctgtctctactaaaaatacaaaaaattagccgggtgtggtggccggcgcctgtaatcccagctactcgggaggctgaggcaggagaatggcatgaacccgggaagcagggcttgcagtgagccgagatcgcaccactgcactccagcctgggtgacagagcaagactccatctcggaaaaaaaaaaaaaaaaagtttttaaagaaaaaacattttaaggccatagaaacatttaagatataattttcaatagtgttcccaagcctgtatcttatgtagagaaaagaaaaaaattaaaataaaaccaagtaaataatttcaactgtgaaaagataataggctgatttatgaaatgatgatgttgtaaataaaaaccaaagcatacaaacatttaaattaactgaaataagacgctatctctcaatgacatattttttggatgactttttaaatcattattcttagacatgtatgttttagcatgcttgggacaatgaaaatgtataaattgtatttcatttactttgtacttagtacttcatttacttatttacttagtacttcatttacttatttattttgtacttattcaatactaggctggagaaaatggtacaaaattttaaaagtatataaacttttattacaattactattaaatgcctatatttaaatatctaagtgcaattttatccagttaaatttagctacttatgcattaacaaaagccaaatggagtttattcgtttattccaccaataaataaaacagtgattcaagattaggtggtttataagtgtaatacattaaaatttaacagattaagatagaaacaatatgtattgcagcagtatatgcttgcataaattattagaaaatttaaaaatcatgttgcaaaggaaatctgtaaaaaaaaaaaaaaaaaaaaaacccaaaaactgttaaggaaaaatatttcacccaacaagtgaaacactggattcatttcctctaaattaagtaagagaaaagggggtttttcatttcctctaaattaagagaaaagggggttggccagacctcctgtcattcaccactgcactggatgtctgagcagcagcaaagagaaaaggtgggagggaaaaaggcaaggagggggtagagccaaagagttagatctactaaaattaagagataacatgattgtggccgggcacggtggctcatacctgtaattccagcactttgggaggccaaggcgggaggatcacctgaggttgggagttcaagaccagcctgaccaacatggagaaatcccgtctctactaaaaatacaaaattagccgagcatggtggcacatgcctgtaatcccagctactagggaggctgagccaggaggatcgcttgaacctgggaggcggaggttgcggtgagctgagatcgcactattgtactccagcctgggcaacaagagcgaaactccatctcagggaaaaaaaaaaaaaaaaaaagagataacatgattgcaacccagaaaaagaatgtttaagtatacaagctaacaatgctaacaatgtactgaaataatcttcctactttagtaacactaatttaaaaacaacacacacacttctaaattttcattagcatatataccatggcacttaagtacaatacattttcagaattatgtgaacaaattataaaactacactgagtgatgtcggcaagataaaggaacaggaatccccaaactctccagtcaccacagtgaaatgattttaacaacaattcatggactaattgcctcggggataaatccagaaaacagttaggaggtttctacacctcaggctgacataaagcaaacagtatagaagctctgaaggaaaatttgaagcatccacttgacagagatccagcccctgccatgcactggggtaacagaaaagaaacccacaactcccaagatcatctaggggatggaaaggagcagaatatctgtccaacttcctgacttttcagatgaccaactgatgggctggtttctctcttcctgaatataagcactgacaagaacaaggtgaaaggttaggggccactgagaaaaaggatgatttacataaaccagtgtgtgcagtaacacagacaaacgctaagtgcatatctagtactacagcttactgtagcaccaaagtctgcaatatcaaagacagacaacaggggagcttctgggtagaaactagcaaacattttcaatgaagagatgacaagcaaaggcccagagaggacaaaatccccagccagaaaaggtgtggaaggtctccacaatctagctgagttgactccagagtgtcctccctgaacaaagcaaccacccaaaactggggaggtagatgatttttaaaatagggaagtgccaaaagaagataataaaacttacaaagaaataggaaaatacagtccataaaaagaaaccaattaagtctctacaaacctacactaaagaaatggtgatttaaatcttggctttgaagaactaaaaggaaatggggatcaccctcagtatatgcagaggattggttccaagattccctaaggggaccaaaatctatggatactgaagtcccttatataaaaaggcatagtatttgcatataacctacctatatcttcccatatgatttaaatcatctctacattacttataatagctaatacaatgtaaatgctacataagtagttgttatactgcattgtttaggaaataatgacaagaaaaaaaggaccatacgtgttcaacacagatgaaaccatccatttttttctggctatttgtagttcatagttggctccatctatggctgcacgagccatgaatacagagggctgactatatgtgaattaccaaagaatttgaaatagcagccacaagaatgctcaatgagttaaaagatagcacacacagacaagctcacgaaatcaggaaaactatatgaactatgcatgcaaagaagaatatcaacagaaatagaagctataaagaaaaatcaaaaagaaattctaaggctgggcaccgtggctcacgcctgtaattccaacactctgggagcccaagatggggtaattgcttaagcccaggagttctgagaccagccagggcaacatggcaaaatcccatctctacaaagagtacaaaaattaggcaggtgtgatggtgcatgcctgtagtcccagctactcaggaggctgaagtgggaggttcatttgaacccgggaggcagaggatacagtgatccaagatcgtgccactgcactccagcctgggaaagagtgaaaccctgcctgaaaacaaaacaaaagaaagaaaaaaagtcgagttaaaaatacaataactgagttgaaaaattcgctagatgaattcaacagctgacttaatgaggcagaagaaggaatcagtgaactcaaaggggattttgacacggaggaaaacaaaaactataaaaaataaagaaaaataaagagagtctaaagggctcatggggaaaccatcaagcatcaagaacgtatgtatcctgaaagcccaataaataatgtgaatatacctaacattactaaactgtaagcaaacaaacaagctttactgaaagacataataaagatatgatcactgactgacaaactcaattcttataggaagatgtgatggtgacaagacctgcgactgtaaaaattcatggccattcaaacacaaacaaaatatgtgggaatttaataaaatgtgactgttgtataaaaaaagaaccaacaaaattttggaaagaaaatggagaggtttgccaatcttcatatgaacctattatgacatttataatctgaaactttaaaagcaatcaaatataatctacaaaaagatatacacaaaaattcaaattaaagattcaatcaaaaaaattcatgcaaagaaaatgtaagcaagaaacatgagattttaaagaaacttcatattttataatcacaccgtgagccaggccttccagaagataaaacaaacatttacttatttttgcttttgtggtataccatcctaaaagaagcaatcattctttgaactgccattgaagtaaccctcagacacttgtggtgaagacagcatgcacagaggaagccacagtgacattctttgcaaaaatgaaaaattgtaaaagatccatatgtcttcatttagaaattgctccaaagaggatgcaaaatacgctattagtgtttattaacataaaaacatgtacatttcaggctgggcacggtggctgacacctgtaatcccagcactttgggaggctgaggcaggcggatcactaggtcaggagatcgagaccatcctggttaacacggtgaaaccccatctcaactaaaaatacaaaaaattaactgggcacagtggtaggtgcctgtagtcccagctactcaggaggctgaggcaggagaatggtgtgaacccgggaggcggagtttgcagtgagctgagattgcgtcactgcactccagcctgggcgacagagcaagactccgtctcaaaaaaaaaaaaaaaatgtacatttcaaaaacttgcaaaatacagcagaacattcacttaagaattgttttctaaaatctcataatgacgtgtaaatgcatcttgacacctctcactgactcttgccacagaacttacaatagtagctcctcaatgaaacatgaggcatggtggagaatgtgacagggaaaaggaacctgggttcctctgggtgggtaattgaaagagtgattgcctcttctaggatggtgcatttcctattttggtgaatctggcaagattccccactaccccaagttcaagggtgccccctcccaccaatgacacatgacatgtcccactctttaaaaaaaaaaaaaaaaatactactatgttcttttttctctttgaggatctaaaaaaaataaaaattctttgtatttccattttccaattccttggactgtgaggacatttcattattttgtggaaatcaaaataaaataattttcattttatgctcaattttcttttactgcattctaggagctatttcatgttctgtagttaaaagtttttaaatatatatgccttgatgttctttttttaggttatgaagggtgttcttgatgccctgttttttacttgtttgcttacaaattttattgtgtatatttaaggtacacaatatagcaaggtatagatagtaaaaaactcacgacagtttaacaaattagtatatccgtatctcatagttaccttttttttttttttgcttttgtggcaaaaacagctaaaatctcatttagcataaatttcacatataataacacgttattccctaccatccttatgttgcatcaccttcttaatgtctaaattccatctctgcttggacttttaccacaaaacaaatatatatatcatgtgatgtttaaaataaatgtaatatttaataataattggtggaatgacagaatttggctccatcttctctgacatcaaaaaagtttggctcttacatctgagcaaaattataaccgttttacaaaaaacaactgccggtaagagtcccagcaggaacaccacattctctgtgggatggatatgctgagaatggctaaattaatctgacattcaggttgatttcatattttaaaatcaatgatggaataaaacaacctctatcactgatgtctgtacctagttttccattccattcccggtcattaagattgtggagttagaaagagtgactgattcattatagcttcaaatgtggtataaaatcaggcagaaaagatctccccttagaggcatcttttcaagaatttatgaggtatttttgcatattaacatgtgacttccacatacagcttctctactcctggtctactgagagctgacagtgcattcagatgttgcccctaaacaatctctgctgcccaaaagctgacaccacagaactcacaccctgtctccatccatgtctgggtgtgagcccttcccaggaccatgcccagtggagcctcttcccaagctcatgtcactgagtcactgtgagatctggaatctaagtgcagaagagagggactgaaggaaggcatgggtgagtgcgagcaaatgtgtcaggcaggatacttcagactcagagaagatttgcagctccaatgccctgcatttcaaaaagggaggagacagaacaatccaccaagattatcactttacctgaggaagagccatccctggctccttttctttcttctttctctcctgggcctctctctcagtcaatataattaattctttaaaagtcaaatctgaaagtcaaaaatatgttgtttaatccttggaaacaacacattcctttctgtgccacaaccatgcccacagggaaggcctcagcatgtggagagacagcccagtgcaccagggggatgcaagcataataaactcctacacaaagaccaagtaagtttttcacccttttcttcagaacttgttcccctcccagagaagcccccacacaccctgcaacagtggggagctgggctggactatgcttcccttcaggacacagacccatccctgatcaaaccccatacagagcacagccccctcacctccctgtggatcacaggctgagctcagctctcagaaacagaagacacaaaggctggacgctcaatgctggatacaaattagaatcaatttgggtactttaaacaatatggaggttgagtccatcctacctactggaagtggaatctatggtaaaagggcacaaaacgtgtatttgcaaactgcctcagcacgctaatgtgaagccagggttgaacacatcttaaagggggcaagactagcacagccccatcctcccagctctgctgtccccttggggcttcactgttaccagtttgtagacagtagaacacaatggaccagaaacacagagacacataatatgcaccaggggtggggtgagggtgtggctggagtgttaaatggtgagaggagggtgaggcacagaagtcccaatggagaaggtgatatcagaacaaagacctcaagaaggaaggatgtttgcacctgcagctgaggggccagacagcccaggtagaggccctgaggcaggagcaacctcagcccagggaacaggaaagaggcctgtgtggctggagcagagggagcaggaaggacacagggaggagatgaggtcagagaggttctggggagcagattaggtagagatgaggtattcaaacatctttctcccacagctcacagtaatttcagaaactatgcatttcctcaccctttttaagtaaacataacttttctttatcacatgaattaaagcacttctttttaatgtcatgttttctctgtttcaaatatatgctgacatgtaaagctaaagccaggaagtacagggtcaccatcatctgagatgtgcaggagtgcaggggaatgtacttggtgagttcaggcaatcacttttggtggagatacctgttagatggctaagcagagagaggagaggacaaaaggacacagaattctagagttcaggggacaggtctgcaggggacatggagacgtgtaggtgggtaggtgggtgatatggatcagctctgtgtccctggcccaaatctcacactgaattgtaatccccactgttactggtggggcctggtgggaggtggatggatcatgggggtggatttgtgatgaatggtttcacaccaccccttggtgctgttcttatcatagtgagttctcacgacatctggttgtttagaagtgtgtagcgcctcccccctcactctctcttgctcctgctcccgccatgtgagacgcctgttcctccttcacctgccatgactggaatcttcttgcagcctccccagaagcagatgtcgccatgcttcctgtgcagcctgcagaactgtgagccaattaaacctgttttctttataaattacccagtctccagtatttcattatagcaattcaagaatggactaatacagtggggtttaaattcataagatgagatgatgaggaaagacagtgggtgtggacagaaacaagaagaggttcaaggactaagccatgagtcattcccacattgggaaacattcagagtcaggacacagcagcagaggaaagtgtgaaatggtcagggaggtgacaagaaaatcaaatagctcctgacaggcaaagaaagagtaaagcaggaaatgaaatacattggatttagaaatggggaggtcactggtgactctgaaaaataaagttatcagtggaatggtggatatgaaagtttcatccaatgcattcaagacacaattggaggcaacaagtgaagacagagactctgaacaagattgtattgtattatggtcttaaatgaagcacagaagaggggtactcactacaggcagaaacacagttaatggtatgttttgttttaattagggcacagtggaaggaaactagaggctttagggtctgtgtgtgtgcatgcatttaatgggcaatacaccaccatcagtaaacactgtttaaagtaattctgtagaagtaaaaatgaatgacacagttaaacaaattttatggaagcccaaagtattttcgttgttttctttttaacttatattttaagttcaggggtacatgtgcaggacgtgcaggctggttacataggtaaatgggtcatggggatgtgttgtacacattatttcatcatccgggtattaagcctagtattcataagttatttttcctgatcatctccctcctcccaccttccactctcaggtagatcccagtgtgtgttgtttccctctatgtgtccaagtattctcatcatttacctcccacttgtaagtgagaacatgcagtatttggttttctgttcccgtgttagtttgctaaggataatggcctccagctccatccatgtcctgggaaaggacatgatctcattgttttttatgggaaggctgttgttttggactagcctcccgaactaccagaccaagccagaatgaagtctcttgtgctgagtgccacattatcaaactgaaccttgaaatgggccaggtttaggggaaaaaaaactccaaaaaataaacagagaggcccggcgcggtggctcacacttgtaatcccagcactttgggaggctgaggtgggcaaatcacctgaggtcaggagattgagaccagcctggccaacgtggtgaaaccccgtctctactaaaaatacaaaaattagctgggcacggtggtccatgcctgtaatgaccccacccccgaatactggcaccactatctactaaaacagatatcttcaatgatgcacacatgccccaatgagaccccaacatcttccaaggaaactctccatattgacatttagataatgcatccaaaatgcatctataaccatcttaacgtgcagcccaaaatactccaaaaaaaaaaaaaaaaacaaaggtagcccccctaaatgatctctgtgattttccagataatacttcggtaagttgcatgattcctgcactcccaaaagaccccgcagaagtcaccatgaaaagtgcttatggcagtacagttctgggttccacgctctcaagaccaacgaaccaaccctccagctgcccaacctccctgtggactccacttaggccttgcttctcacttcagttgacgatagaacaatatgagtttggattgtatgggtccatttataaaagaatttacttcaataaacatctgaaaaatattttgaagacttgcaacaatttgaaaaaactcacagatgaaccatgtaccctaattaagaaaaaggtatgccagaaatgcataaaatatatgtaactattagtctattttatcacttagtaccataaaacacacacaaatctattctaagttaaaatgtaccaaatttatataaacacctctagactgtatatggttccatctacagtcaaaataaatgtaaaaaaatgtaaagacgcagtattcaatcataactgcattaatgaactgtactacatactgaacttctataataatttcatagccacctcccattgctattgtggtgagctcaggtacctgcttaatgtgccccgtgatgttaatcatctccatgtgaactgttaatctctctagtaaattgcagaccgcagtaaaaattgatctctgtggttctggcacatttttcattgtttggtgcaatacgataaactctgaataacaacacaggacccatctgaagtgccactagtgatgctggaagtgctcccaagaagtagagaaaagccatgacattataagaacatgttgacttgcttaatacgtaccatagattgaggtgtgcgattcagttgcccgccatttcaagataaattaatctggtgtaaggaccactgttaaaagagaaaattcatgaagccgtcactgcagctacaccagtaggcacgaaaacaatgtactttttgctaaataccttttttatctcatattgaaaatgcagctttatacaggggcaaaatcactataatgaaggcatacctgtagactctaatatgatttgagaaaaagggaagttattttatgacaactttaggaaggtaaaggatctaaagctggagagtttgatgccagcaaaatatggactgataatttaagaagtttggcttaaaaaatgtcaagataacagaagcagccactccaaccaagaggcagtagatggggtcccaaatgctatgaagaaaatcattaatgagccaggcatgattgctcacccctgtaatcccagcactgtggaaggccaaggtgggcaggtcactagagcccagaagttccagaccagactgggcaacatggcaaaaccccgagtctactaaaaaatacaaaaaaaaacagccggacatggtgacacacgcttgtagtttcagctactcgggaggctgaggtgagaggatgccttcagcccgggaggcggacattacagtgagccgaggtcacatcactgcactccagcctgagcaaccgagcaaaaaataaagaaactgtggcattccaaaatgatccatgcacaaccactcataatcccacttccaagtgcttctgccagacctaagaaattcctttccaagagttccacataccccttgctcttataaccacacttgggacaggtgcacacaccataccatggctcatctgaaggcccacccttgctttctggagccttctatggactcccctccattttcccccatttttctacctctcctccatgcatgcatgaacaaactaggctaaaaggtacaggatctctgggcacatgcaacacagcaggagtgtacacaaactgcaaactgaaggaccctgggccttcagtatgaagaccacaaagttgggcctgctgagaaaacttgccagcaagtgctgacaatattaagtctagtttaaaggcagctgggcattggctagattaagttcagtgaggatgtctcagaagaggggccctaaatctttctatacactaaagacaaaatatctgaaaaaagaaataaagaaaacagtcctatttgtaatagcatcaaaaggaataaaatacttaggaacagatttaaccagtgaagtaaaagatctgtacactgaaagctcttaagacactgataaaagatattgaagaggccaggaaagtggctcatgcctgtaatcccagtgctttgggaggctgaggtgggaggattgcttgaggtcaggagtttgagaccagcctgggcaacatagtgagactctttctctacaaagaaaagaaattagccaggtatggtggtgcatacctgtagtcttagcccttcacccaggtatggtcgtgcatacctatagtcttagctacctgggagcctgaggcaggagggttgcctgagcccaggagttcaaacctgcagtgaggtatgatcgccccactgcatgccagcactccagcttgagtaacaatgtgaggctggtctcttaaaaaaagaaagaaagaaagaaagaaggaaggaaggaaggaaggaaggaaagaaagaaagaaagaaagaaagaaagaaagaaagaaagaaagaaagaaagagaaagaaagaaagaaaaaagaaaggactgtagagagccaaaagccaaagggtcatgaccaactctgcattccactgaaggctatatgattaaacagcaaactgtttatcatgaatgcaggatgtgggcaaactcacatctgccctgccgccagaaggtatgctgagtgcaattactccctggcaccatgctccttgaggttatctactgaaacatctggaggctactgttcagagaatgcagtcgtgcaagcctgcaccaagtcaagcagctgactgacaaccacccgcttctccctatctcctttactcaataaatatgaagggctctaaaagctcaggactcttgctcactagaagcaaggagcccctgaccccttcttccaaatatactcttttgtctttgtctttattcctgtgtccgtccccctttgttcagtccacaggcattggggctgcaacaaaggataaaaaaaacattgaagaacacacaaagaaatggaaagctatcccatgttcatagattgtaagaatattttaaaatgattaaaatgtccatactaccaaaagtgatctgcaaattcagcacaatccctatcaacactccaatgctatttttcacagataaaaaaagaaaaaaccctaaaacttttatacaaccacaaaaaactccaaagagccaaagcagtgttgaaaaagaacatgctagaggcatcatactttctgatttcaaactatattataaaggtacagcaatcctaacagtataatactggcataaaaacacacagagaacaatcaaacacaagagagcccagaaataaacatgcacatatacaactagcctttgacaagggcaccaagaatatacaatgaggaaaggacagtctcatcaataaatcctgtcgggaaaactgtatattcacattcaaaagaatatgaaactggacccttatctcacactatatgcaaagataaactcaaaatagattaaagatttaaatatatgatctaaaaccgtaaaaccccagaaaatagaaaaaaagctccttgacattgatcttggcaatgatttttttggatatgacaccaaaagcccaggcaacaaatggtgggactacatcaaactaaaaagtgggactatgtccaactaaaaagtttggccaggcgcagtggctcatgcctgtaatcccagcactttgggacgccaagacaggcagagcacttgaggtcaggagttcgagaccagcctggccaacatggtgagaccctgtctctactaaaaaattagctgggagtggtggtgcaacctgtaataccagctactacgggggctgaggcaggagaatcatttgaactcggaaggcacacattgcagtgaactgagattgagccaccacactctagcctgggcaacagagtgagactccattttgggggtggggtgggggaggggcaaagctcctgcacaccaaaggaaacaatgaactaaatgaaaaagcaatttgtaagatggaagtatgtatctgcaaaccatatatttaataagtggttaatatccaaaatatataaaaactcctacaattctacagcaaaataccccaaataatctcaataaaaatgggcaaaggacctgaacattttccaaataagacatacaaatgaccaacaggtatataataagatgctcaagatcactaatcatcagaggaatgctaatcaaaaccaccataagctatcacctcatacctcttacgaaggctattttaaataggcaagagataacaggtgttagcatgatatggagaaaaatgagcccttgtacactgttgctgggagtgtacatcagtacagccattatgaaaaacactatggacattcttcaaaatattaaaaatagaacaacaatgcaatccagcaatcccatttctgggtatatatccaaaggaaataaatgaaaccagtatctttaagagacatctaggccaggcatagcagttcatggctgtaatcccagcactctgagaagctgaggcgacaagatcacttgacaccagtagttagagatcatgctggacaacatagcagagaccatgtatctgctgaaaaaacacagacaaaaacaaaaaaatggctgggtgtggcggctcacgcctgtaatcctaacactttgggaggccaaggcgggcagatcacgaggtcaggagttcgagaccagcctggccaacatggtgaaaccctgtctctactaaaaacacaaaaagctgggcgtggtggcgggtgcctgtaatatcagctactcgggaggctgaggcaggagaatcatttgaacctaggaagtggaggttgtagtgagctgagattgcaccattgcactccagcctggacaacagggtgaggctctgtctcaaaaaaaaagaaaaccttacaaaatatctgtcccccatgatcactacagtattattcataacagccaagatatggaaacaacccaagtgcccatccatgaataaatatgtgtgtatatagacatatacagagtgttcatgtgtacatatatataatggaatattatccaaccctaaaaagaagaaaatcctgctatttgcaacaacatggatgaacctggaagacattatgctaggtgaaataagacagacactaaaagacaattactgtatgacctcacaagtggaatctaaaaaagtccaattgatagtaacagggtagaacagttgttgccacaggctgctggggggtgaaaatggaaaatgttggttaaagggtacaaattttctgttataaaatgaagaagttctgaggaagctaatgtacaccatggtgactatactatattggacactttaacagtttggaaagtttttgaaaaatctaataaattatggggtaaaagttcaaaaaatgatggcacttaatattcagaaatgaatgagatcagctgattattggatgccaccaaatcttatttctggagttagcaactataggaaagaagcaattgaataaaatgtatctcaagcttccaaaataacaattaattaactgtaaagcaactacaaagaaaaaagtaaattcattacaaaaaaacaagactttcaatgcttctgcgaagacataccttgtaggcctagtgtggtggctcacatctgtaattccagtgcgttgagaggctgaggtggaaagactgcttgaggccaggaagtagaagctgcagtgagccgagatcatgccactgctctccagcctaggcggcagagagagaccatgtccccccccaaaacaaaacagaacaaagccaaaaaaaacaccaaagacatatcttgtagtgacagtcagtcatttcttgccccatttctcccctcctttatgctctactccatcattgggaagaagagagttaccacaaataactggatcaagtcactgccctctggctaaataggaattccaaatatcttttgatacaaatacatacaaaatgcacaaggcttatagaaaaaactttggtgattttcatcctcatgagtacaacttaaacatatttcaaatcagagtataaagccacaaatcaatatattacaaccaccatccatatccaatcaactgtcacgcatctggatggggtcctctcccgctttcttcacggctatgtgtttccctctctcattctgagcgtcttttttttctccttttctgttttgcacccctttctttattccctcttttatgtctgttctgcccaatgctctgcaacttacttcacctctcgtagctctttctccccaatctttccgattgtccccaatctccacgtatttctgcctcttttcccccatctaagctccctctctgctctccttgttaaattccctcttccctgttacatctcctttgttcccactctctagcacccccaatttcctaggcttactccctgctgtggttctccctctactctgcttgtcacccactgccctctctccctctctttcagtcccagcaccacgtagctctgtcagccgcggctccaactctttcaccttctccccactgtctgtctgtctgcagtgcctcctcctttgccgccccactctattttgctgcccttcatctctctgaaggtcccctttttttctaaatttctctgtgtgcttttctccccctgctactttttccatccgttctctttcactcttgctctctttgcaagtccctaaagtatcatccattttgccgtgtatttatgggtctccctcattcttttctcctcagtttttccttttgctccgtcgttccccgtcttttcctctcctgatccctctcacccacacattcgggaggaaaggggaggaataggatgcccacctcccggaagagcacattttccagtggagtaaaatttgggaaggaagaacactgggtgtcacaagacagactcaggtaacctgtcccaacggggagtcaagaaaagcagtggctgtgaaggggaagcctggggagcggaaggacccggcgtgaggacgacacgaggtggcgcggagaacgatgtctcacgacagggagggtctgcagaatcccaggacgtgggaggagaagcggctccttcaggagccggacagtgggcgctcccctccaggggcagacgacggaggagctcggggatcgcgaagggcgctagtccacatcccgaatgaggactcgacttggcgcggggcccaagcagagggttttaagcgggaacactacctgaatggggttgtctacatggtcctaaggaagaaaggcagagagcaaggaacggcctcagagagattttaaaccgaaagggaagcaattctcctacttacttgggacgaaggggctgttgcgggtattttaaggtccgtagcgatccccaggtcacgggtatggagaaccgaggactgcgaagtgcacgtttaatcaaggtagacgaagagaagcaaacgtttaatccaggtagactgaaacacactcatagcgacgtggcctttccccagcgcgatctgcttccgggtgt

SEQ ID NO: 411 - DNA, 30803 bp, Homo sapiens
  source 1..30803: mol_type = genomic DNA
ttgagatggagtcccactctgtcgcccaggctggagtgcagtggcgcgatctcggctcactgcaacctccacctcccgggttcaagcgattctcctgcctcagcctcctgagtagctgggactacaggtgcccgccaccatgcctggctaatttttttttatttttagtagagacagggtttcaccatcttggccaggctaatctcaaactcctgacctcgtgatccacctgcctcggcctctcgaagtgctaggattacatacatgagccaccacgcctggccagctctgtcaaacattaatttgatcccaagcagagggacttttgatctcaatctgcatgagtctgtctctaggaaggaggctgatcattatgctgggggggtgatgagcaccctcccatcttcctctgtccagatctcaggggagagccagcagataggaccattcagcagccaatgtccaaataaggttttgttactcgaagcgctgccaacctactgtgggtcattttattcaggtccatcccaaataacctgtggacacaagagttgatattattccagtgtactactgtggcattcaattaataagccttaagtatctattgtgcactaccgtggtaagataattccatgatcctccagaaattccacccaacgctgctggaaagtaggcttactacatgctacatgcaagtccccaagctgtgttaactgcataatttttttttttttgagacacagtctcattctgtcacccaggctggagtgcagtggtgcaatctcagctcactgcaacctccacctcccaggttcaagcgattctcctgcctcagcctccccagtagctgggactacaggcgcccaccaccacgcccggctaattttttgtatttttagtagagacaaggtttcacccgtgttagccaggatggtcctagtctcctaacctcgtgatccgcccacctcggcctcccaaagtgctgggattacaggtgtgagccaccacacctggccaattcataatttatcatagccttatgaagatgcaactatgttctccattttttttttctttccccaagatggagtcttgctctgttgcccaggctagagtgcagtggcatgatctcagctcactgcaacctccgcctcctggcttcaagcgattctcctgccttagcctcccaagtagctgggattacagtcacgtgccaccatgcctggctaatttttgcatagagccacccgctcccagccgtaagtttttgtatttttagtagagatgtggttttgctatgttggccaggctggtcttgaactcctggcctcaagtgatttgcctgccttggccttttttttcttgagacaagttcctgctgggtcacccagtggcgtaatcatggttcactgcagccttgaactcctgagctcaaaggatcctcccacctcagccccctgagtagctttgattagaggtgtgtgccaccatacctggtgtgtgcgtgtgtgtgtgtgtgtgtgtgtgtgtgtgtaaagaaagcaattttcctaactcagcctgtcaaagtactgggattacaggcgccatcccctgcacccagcctaaactttgattgcatcactgcactccagcctgggccacagcaagatcctgtccaaaaaaaaagcaattggagtttgaacccaggcagagtaattctagattctcactcgaatcacagtgacctccaatgcaattggtgagccacgatggtccccttcaacagacaaggaaattttttttttttgagatggagtctcactctgtcacccaggctggagtgcagtggtgtgatcttgggtcactgcaagctccacctcccgggttcacgccattctcctgcctcagcctcctgagtagctgggactacaggcgcccgccaccacgcccggctaattttttgtgtttttattagagacggggtttcgccattttagccaggatggtctcgatctcctgacctcgtgatccacccgcctcggcctcccaaagtgctgggattataggtgtgagccaccgcgcccggcctcagacaaggaaattatccaaggtcacacagccagtagatgacatagctaatatgtggcctcatctgtatgccccctaattgcatacaccagtgcataacgtatttgtccatccagcttatctaccctcatgctcccagcccaatgtccagcctcctccagaaagaactggtcatcatccctcaccagaggactcggagtttgcagccaggatggctcagccgcttgcaaagcagtcggacacctgtgtcccctagggcgttgttggtcaggtaaaggtcggtcaaggtctggttgatccccagggtgaagtaaagattctcacaagccttggctgtgaggccacagctatccagcctggtgaagataaggagttggttaaggtaacaccaggggctacttatgttattcggaggcagtgtctcaccctgtctcccaggctggagtacagtggtgagatttctgttcactgcaacctccgcctcccaggttcaagcgattctcctgcctcagcctcctgagtagctgggattacaggtgtgcaccaccaccaattagcatggctaatttttgtatccttttatttttgttttgtttgagatggagtctccctctgttgcccatgctggagtgctgtggcatgatctcggctcactgcaacctctgcctcccgggttcaagtgattctcctgcctcagcctccccagcagctgggactacaggcgagagccaccacacccaactaattgttgtattagtagagagagggtttcaccttgttggccagaatggtctcaatctcttgacctcgtgatccgcccgcctcagcctcccaaagtgctgggattacaggcatgagccactgtgcccggccgtaatttttatatctttagtggagaggggatttcaccatgttggccagactggtctcaaactcctgacctcaagtgatccaccaaccttggcctcccaaagtgctgggattataggcgtgagccactacgcccagcctctgaaacattttaaaaaattatctgggttaggccgggcgtggtggctcacgcctgtaattccagcactttgggaggccgaggcaggcagatcacctgaggtcgggagttcaagaccagcctgaccaacatgagaaaccccgtctctactaaaaatacaaaattagccggggtggtggcgcatgcctgtaatcccagctactcgggaggctgaggcaggaattgcttgaacccgggaggtggaggttgcagtgagccaagatcgtgccactgcactccagggtgacagggagaccctgttttaaaaaaaaaaaaaatcccaaataaactagatgatgcctcatcccattctaagtccttcagattagggctacagctggcctggcagaaaggtgagggagaaagtcacaattaacatttgattggaatttacagagcaccagattgaattattatttttttttctcgagatggagtctttctctggcacctaggctggagtgcaatggtgtgatctccgctcactgcaacctccacctcctgggttcaagtgattctcctgcctcagcctcctgtgtagctgggattacagacacccaccaccacgccaggctaatttttgtattcttaatagagatggccatgttggccaggctggtctcaaactcctgacctcatgatctgtccgccttggactcccaaagtgctgggattacaggcatgagccactgtgcccggcctgaattattatttttgagacagagtcttgctctatcacccaggctggagggcagtggcatgatctcagctcactgtaatctcgcctcccaggttcaagtcattctcctgcctcaacctcccgagtagctgggattacaggcatgcgccaccacactgggttaatttttgtatttttgtagaatggtgtttcaccgttttggccaggctggtctcgaactcctgacctcaggtgatccacccgcctcggcctcccaaagtgctgggattgcaggcattaagctaccgtgcccagcctcttttgtaatttttaaattttaattttttttttttttgagacagagtttcactcttgttgcccaggctggagtgcaatggcatgatctcggctcactgaaacctctacttcccaggtacaagcgattctcctgtctcagcctcccaagtagctcggattacaggcatgtgccaccaggcccggctattttttttgtatttagtagagacagggtttcaccgtgttaggctggtcttgaactcctgacctcaggtgatccacccacctcggcttcccaaagtgctgggattacaggcatgcgccatcgcgcctggccttaagtttttaaaattttaagtcgggtagcacccccaaatcagaataagttcagagagacttcctgtcttttctttccacctctcttcttgctacctgaatcttttgtagtgaagcaggatagttcataaatagaaaaatgaaggatgagaaggcgcttccactgtccaaacgtgaccactgccaccccgtcactccccgatgctcaccacagtttctggagtctgcaggcgggatgttgcagcccctcagccagcaaccacaggccccagtctcccaggtcgttgaaactcaagtccagctcccggaggttgtggttggcctggagcaccacagaaagaccctcacaggcggcagagcccagccggcagatgcccaacctgcaaagacaggatgctagggcggagtgggaggcattcctcctgcaaaatctgctgggagggccctgtgccaagccctgtgctggttgcagacagagggacagactcaatctctacccttgagagacaaaaagaaaaagacgacagaagtaggaagatgagaggaagggaggaataagagaacagaaggaagcaactaagaatcaggccaggtgccctggctcatgcctgtcatcccagcatcttgggaggcttgaggctggagggttttttgaggtcaggagtttgtgaccagtctggacaaccaataacttgtctgtacaaaaaaaaattttttttctttttgcgatggcgtttccctcttgttgtccaggctggagtgcaatggtgcaatctcggctcactgcaacctccacctcacaagctcaagcgattctcctgcctcagtctcccaagtagatgggattacaggcatgtggcaacatgcccggctaatttttgtatttttagtacaagcggggtttcaccatgttggtcaggctggtttcgaactcctgaccttaggtgatccacccgcctcagcctcctatctacaaattttttttttttttttttttgagacagagtcttgcaatgtcgcccaggctggagtgcagtggcgtgatcttggctcactgcaacctccgcctcctgggttcaagtgattcttctgcctcagcctcctgagtagctgtgactacaggtgcacaccaccacgcccagctaatttttgtatttttagtagagacggggtttcaccagttggccaggatggtctccatctcttgacctcgtgatccacccgcctcagcctcccaaagtgctgggtttacaggcatgagccaccgcgcccagccgcgtgtgtgattttttgttttttgttttttgctggtgccttgataaaaaaaatacacaaagtgtgttttttgagcacttctacccacgtcttatactagtcactaggagatacagttggcatagctcctatgcttgtggaatgccaccacacacacatatacacaaattacaaatttttcttttttttttttgagatggaatctcgctctgtcatccaggctggagtgcagtggcaaaatctcagctcactgcaacctccggctcccgggttcaagcaattcttctgcctcagcctcctgagtacctggatatcaggcgtccgccaccatgcctggctaatttttatatttttagtagagacggggtttcaccatgttggccaggctagtcttgaactcctgacctcaggtcattctcccaccttggcctcccaaagtgctaagattacaggtgtgagccaccgcatcctgccttcagatttcaataaatgatgctgagggggaagtatgaggtcacataggatcataaatctaggaacccagattttagctagggattagaaagggtgtccagctgggtgtagtgggtcacacctgtaatcccagcactttggaaggccaaggccagaggatctcctaaggccaggagtttgacaccagcctaggcaacaaatcgagaccttgtccctacaaaaaataaataaaaattggccaggcgcagtggctcacgcctgtaatcccagcactttgggaggccgaggcaggtggatcatgaggtcaggagagagagaccatcctggctaacacggtgaaaccccatctctactaaaaaaatgtttttaaaaattagccgggcatggtggcgggcacctttagtcccagctactcgggaggctgaggcaggagaatggtgtgaacccgggaggtggagctcgcagtaagctgagatcgcgccaccgcactccagcctgggcgacagggcaagactcgtctcaaaaaaaaagtaaaaattagccatctgtggtggcatgcgcttgcagtcccagctactcaggaggctgagttgggaggatggcttcagcccaggatgtcgggctatgatcacaccactccactccagcactggtgacagagcaagaccctgtctcaaaatacaaagtaaagagtgttcagaagaaaaattgaacttctccaggcaaagaggggacagagagcagaaggcatgccagggaataagaattgcttgtgcaaagggccgtgcgtcagaaaaccccccccttttttttttttgagacggagtttcgctcttgttgcccagactggagtgcaatggctccatctcagctcacagcaacttccacctcccgggttcaacggattctcctgcctcagcctcgcgagtagctggcattataggcatgcaccaccatgcctggctacttttgtatttttagtacagatggggtgtttctacatgttggtcaggctggtctcgaattccccacctcaggtgatcctcccacctcggcctcccaaaagtgctggaattaaggtgtcagccaccatgcccggccagaaaaatccttttaaaaaggctgatgtaggctgggtgcagtggctcaagcctgtaatcccagcactttgggaggccaaggcaggcagatcatgaggtcagtagatcgagaccatcctgctaacatgatgaaaccctgtctctactaaaaatacaaaaaattagctgggcttggtggcgggcgcctgtaatctcagctacttgggagtctcaaaaaaaaaaaaaaaaggctgatgtagtagctagagtttaggagcagagacaacctggcctccgtggtcccaggtgagagggctgcgttcatggattgggactcctagcgtggtgagcaaaacgggactcaccgcagggtctggagcttgcacgtgggatgcctgaggccctcacacagcagcagcaccccgaggtcccccagctcattcaggctcaggtccagctctctcaggctctggttcacactgagagttgaggccagctcgtcacaggcagcagcagtgaggcggcagatcttcagcctgcacaaagtccaattcaacaagcattatggaggctttcctttctttttctttttttttttttttttttttgagacagagtcccactctgttgcccaggctggaatgcagtggtgcaatctcggctcagctgcatcctccacctcccatgttcaagcgattctcctgcctcagcctcctgaatcgctgggactacaagcgtgtggcatcacgcctagttagtttttgtatttttagtagagacagggtttctcgccatgttggctagggtggtctcgaactcctgaccatgggtgatatgcctgcctcagcctcccaaaggactggaattacaggcgtgagccactgcgcctaggcccccaatcttaacagtaatgcattttcagacaatctaatttaaaaatgggcaaaagggcccggcctggtggctcacgcctgtaatcccagcactttgggaggccgaggctggcagatcacctgaggtcgggagtttgagaccagcctgaccaacatggagaaaccccctctctactaataatacaaaattagactgggcacagtggctcatgcctgtaatctcagcactttgggaggctgagatgggtggatcacctgaggttgggagatggagaccatcctggctaacatggtgaaaccccgtctctactaaatacaaaaaattagctgggcgtggtggcgcatgcctgtaatcccagctacttgggaggctgaggcaggagaatcacttgaacccaggaggcggaggttgccgtgagctgagatcacgccattgcactccagcctgggcaacaagagtggaactccatctcaaataaataaataataaataaaaataaatgagcaaaaggcttgaatacacatttcttcaaggaaggtgtacaaatggccaaaaagcacctgaaaagatgctcaatctcaataatcattggggaaatacaaatgaaaaccacgataagatagcatctcatacccattaggatgcctactattaaaaataaatagaatgcggccgggcatggtggctcacgcctgtaatcccagcactttcgggggctgaggcgggcgggtcacgaggtcaggagatcgagaccatcctggctaacacggtgaaaccccgtctctactaaaaatacaaaaaattagccaagcgtggtggcaggcgcctgtagtcccagctactagggaggtcgaggcaggagaatggtgtgaacccgggaggcggagcttgcagtgagcagagatcacaccactgcactccagcctgggcgacagagcaagactctgtctcaaaaaaaaaaaagaaaactggggaagatggtacattttatgttgcatgtattttaccacaattaaatttactttttattttattagggacagggtctcaccctgtcacccagtctggggtacagtggcttgatcacagctcactgcagccttggcctccgaggctcctgaatagctgggactccagacacataccacccaccccagctaattatgtttattttttgtagagatgaagtctcactggttcccaggctgctcttgagctcctgcactcaagccattctcctgccttggccttccagagggttgtgattacagctgtgagccaccgcgccctgcccttctgaatatttttgatccatggttgatgaaattcacgaatgcagaacccgtggacacagagggctgactgtggctcagtggcatgaagtagtttcacgctactgggaaatcatcactgctatccatctctggaactttttttttttttgagacggagtttcgtttttgttgtccaggctggagtgcaatgacacagtgttggctcaccacaacctccgcctcccaagttcaagtgattctcctgcctcagcctcccgagtagttgggattataggcatgtgccaccacgcctggctaattttgtattttagtagagacggggcttctccatgttggtcaggctggtctcgaactccagacctcaggtgatctgcccacctcggcctcccaaagtgctgggattacaggcgtgaactaccgcacccggcccatctctggaactttttcatcttccgaaatggaacctctgctcccgttaaacggtaactccccatttcttcctgttctaggccttggcagccactattctactttgttttttgagatggagtctcactctgtcaccgtggctggagtgcagtgacgtgatctcagctcactgcaacttccgcctctcaggttcaagtgatcctcctgcctcagccccctgagtagctgtgattacaggcgtgtgccaccacatccagctaatttttgtatctttagtagagagggggtttcaccgtgttggccaggctggtctcgaactcctgacctcagatgatctgccctctttggcctcccaaagtgccgggattacaggcgtgagccactgcgcccgacctgtggatgcatttttataccatcattcaatatgaagagatttgccattttattatagttgaccccaggaagaactcaccacaaagtccgtagtctgcagactgggtgcctcagtccctggcatagtaacctcaggcccaaatcctccagtgcatttcctgtcaggtccaactcaaccagatgtgggttggtgccgagcacagaagccatctcctgacaagccccggactccagctgacacttcctcaaccttgggaggaaggagaggttgaaggggacgccatcttgcttttctatgtcgtgatcactcatgctccagcctgttattttattatttaggaacaggttgttgctctgtcacccagggtgaagttcagtggagtgatatcaactcgctgaagcctcgacctccaggctcccgtgatcctcctgcctcagcctcctgagtaactgggaatacatgtgtgcaccaccacacctgcctaattttttttgtttgtttgttttttgttttttttgggtttttttgtttttttttttttttgaggtagaacctcattctgtcacccaggctggagtacagtggcgtgatcttgcctcaccgcaacctccacctcctgggttcaagtgattttcatacctcagtctcgagtagctgggactacaggctgggctacaggtgtgtgccaccacgcccagctaagttttgcatttttagtagagacggggtgtttctccgtgttggccaggctggtctcgaactcctgacctcaggtgatccgcctgccttggcctcccaaagtgctgggattatagacgtgaaccaccgctcctggcccatacctggctaattaaaaaaaaaaaatttttgtaggtcgagtgcagtggctcacacctgtaattccagcactttgggaggccaaggtgggtggatcatttgaggtcaggagttcaagaccagcctggccaacgtgaggaaaccccatctctactaaaaatacaaaaaagttagctgggtgtggtggtgggtgcctgtaatcccagctacttgggagcctgaggcaggagaatcacttgaacgcaggaagtgggggttgcagtgagccgagattgtgccactgcaccccaacttgggcaacatagcaagaccccgtctcgggagaaaaaaagaagaggtgggggatggccccagggactcttcatcatgtagaattgagtgtggagtcagaggagggcagaagcaggtcttccaaagtgcctagagtccagggccagggtcttaggtcatggggttaagggccagccctgatttaaaggtggagatttggggattaccagcattttgtgatatttcatgccccaggagacaatgagcttaagaagttgctcccggggatagagactcactgaatcatctgcagcctgcactggggatgccgcaggccctcgcaaagcagcatcatgcctgggaatccaacgccgttgccactgagatccatccttgtcaaattcttattggctatgagagctgcagagaggtcctcgcaggctgagctggagatgcggcacctcttcagcctggggtggaaaagaggagaaaggagctggtcatttcttttgctccagttttgtggattattttcttttgcttttttttttttttctgagacagagtcgctctgtcacccaggctggagagcagtggcatgattttggcttaccacaacctctgcctcctgggttgaagcaatcctcctgccttggcctcctgagtagctgggcttacagacgtgtgccaccatgcctggctcattttggtatttttagtagagatggggtttcaccatgttggccaggctggtcttgaactcctgggtcaagtgatcctccccatctgggcctcccaaagtgctggaattacaggcgtgagccatcatacctggccaatatatttatttcaaaatatcatgttatatatgataaattttacctgtcaagaaaagcaacaagaacaatataaaatgttttgatgctttgtagtcaaatacattcacaaaggttgcccttaaagaaattcaaggccatgtgcggtggctcaagcctgtaatctcagcactttgggaggccgaggtgggtggatcacctgaggtcaggagtttatgaccagcctggccaacacagtgaaaccccatttctactataaacacaaaaattagctgggtgtggtgatgcacccctgtaatcccagctaatcaggaggctgaggcaggagaattgcttgaactcaggaggcggaggttgcagtgagtcgagatcatgtcactgcactccagcccaggctacagagcaatactatctcaaaaaataacatatgaaaaaaatttggctaggcacagtggctcacacctgtaatctcaacagttagggaggctgaggaaggaggatcacttgaggccagaagtttgagaccagtatgggcagcatggtgaaaccccatctctccaaaacatacaaaaattagcctggtgtggctgggcacggtggctcagtctgtaatcccagcactttgggaggccgaggtgggtggatcacgaggttagagattgagaccatcctggctaatatggtgaaaccccgtctctactaaaaatacaaaaaattagctgggcatggtggcacctgcctgtagtcccagctactcaggaggccgaggcaggagaatcgcttgaacccaggaggcagaggttgcagtgagccgagatcacgctactgcactccagcctggtgacaaagcaagactccgtctcaaaaaaaaaaaaaaaaaaaaaaaaagaaattagccgggtgtggttgcacatgcttgttttcccagctactcgtgatgctggagcaagaggatcgcttgagtccaggagtttggggctgcagtgagccatgattgtgccactgcactccagcctgggtgacagagcatatcagtgtctcaaaaatttaaaaaaaaaaaaagtaaaaaaaagaaaaaaatttggagacccacacagcaggatgaccatgtgaagacagaaggcagtgatctgcaggcccaggacagaggcctcagaagaacttaacctgcccactccttgtcttggacttccagcagccccccacctgccttgagaaaatagatttatgtggtgaagccacccagtctttggcacttttttcccccctgagatggagtctcaccgtatcacccaggctggagtgcagtggcacaatcccggctcactgcaacctccgcctcccaggttcaagcgattctcctgcctcagcctcccaagcagctgggattacaggcgcccgccaccacaccctcctgatttttgtattttttgtagagatggcattttgccatgttggccaggctggtctcaaactcctgacctcaagtgatctgcccgccttcacctgtcaacatactgggattacagacgtgagccacggcacctggctttgtgacacttttttatggcagccgtagccaacgaatacaccatcccgtgatagaacctttgtgactgatccccatgagaggccacggtggggaccacctgaaacgcccagaccagcctgcactcacctcaggttctgaagtttgcagttggggtgtctgagtccttgacagagcagcttcaccccccggctgcccagggcatttcggtacagagacagctctatcaggtttggattggtgcacagggccgctgccagatgttcactgtaggcgtccagcagaacggtcctctctggtctgcttgaaggaaagacaggccactctctggtgttactggtgcttgacaactatggcctttgcatgtcatttcaccgtttatgaagcatgctatccttttttgagacggagtttcgctcttgttgcccaggctggagtgcaatggcgcaatctcagctcaccacaacctccgcctcctgggttcaagcgattctcctgcctcagcctccagagtagctgggattacaggcatgagccaccacgcccagttaattttgtatttttagtagagatggggtttcaccgtgttggccaggctgatctcgtactcctgacctcaggtgatctgcccgcctcaacctcctgaagtgctgggattacaggcgtgagccaccacatccggccaaagcatgctatcttttcatttttttttttagagggccttgccctgttgtctaggctggagtgcatggtgagatcatggctcactgtaggcttgacctcccaggcttaagcaatcctcccacctcagcctactgagaagctggggctacaggtgtgcaccatcatgaccagctaatttattttatatttttagagatggggatctcatcatgttgtccaggctgcacctggctctatctgacgctcctaatcattgatagttggtttacttgtttccctctttattatctgtctccgttctcattaggatgcgtgctctcttgggaccattggcttattcacacagtcttctgtctacagaagattgttgggtccaccgataaaagggatatagaggctgggtgtggtggctcacacctataatcccagcactttgggaggctgaggccgagagtttgagaccagcctggccaacatggtgacaccccatctctactaaaaaaatacaaaaattagctgggtgtggtggcacactcctgtggtcccagctgctcaggaggctgagacacgcaaggtggaggttgcagtgagctgagattgtgcccctgcactccagccttggtgacagagccacactctctcaagaaaaagggacttagtaatatttgttgattgaataaattctcccagacatcgacctcaatttagtcccaatgggtgttgtttagtctttgtggcactattgacactttggggccagagggactgtcctgtgtactgtaggatgtttgcagcattcccggcctttatccactagatgtcagtagtattatttgcttcccagttgtgaccaccaaaaacgtgtctccaaacatcgccaaatgtcagagcaaaatcacccccagctgagaggcactggttaagagcatgaacctcaaggccaaggtgggtggatcacttgaggtcaggagttcaagaccagcctggctaacacagcgaaaccccatctccactaaaaatacaaaaattatcctggcatggtgatgggcacctgtaatcccagctactcaggaggctgaggcaggagaatcgcttgaacccgggaggcagaggctgcagtgagccaagattgcgccactgcacaccagcctaggagaccaagagagacttagtttaaaaaaaaaaaaaaaaaaaaatcgtgggccgggtgcagtggctcatgcctgtaatcccagcactttgggaggccaaggcgggcagatcacgaggtcaagagatcgagaccaccctggccaacatggtgaaaccctgtctctactaaaaatacaaaaattaggtgggcgtggtggcgtgcacctgtagtcccagctacttgggaggctgaagcaggagaatctcttgaacccgggaggcggaggttgcagtgagctgaggtcacgccagtgtactccagcctaggcaacagagcaaaaaaaaaaaaaaaaaaaaaaaacacacgaacctaagcagccccaggggataccccagggatacttacagctgcaccaacagcgtgtgcgctcctgcggagcacctcgcgcggtcttccccgtccgcgctgtaggtggcgccatacaagtgcagcacctgggcgctcctgcagcgcttcagacagaacgaggagaccatgtgctccatcttggaggcaatgttgctgaccacgatcacctggaagtggctcagggcctgctggataaactcctcctcctggatctcgtacaagcagctgaagaactccaaggagccctgctgcagggtggagccgtcgctctgagctttgctttggatccactgcaacaggtccatcttgatgtgcggcgagaccttccagcagagactcttctccaggtggctcctggtctcctcgttcaggagtccaaacaggaagcggctggtgagtgccaggaagctcctttcagaaaacgcgtactcggtcaacagcctggtcacgtcctggtctgggcctgccccgccctccccctcgtccaggatatagtacatagctgcaaagaattcctggaaactcaagtggatgaagctgtagtacctctcacagttgatgtccttctggaagatgttcatgttgaggaaggcagagacgtcttccccgtctaggccgtgcttccggaggtcctgctcctcaaataggattttctgattccagagcccatctgccgccaaggagcacaaccctctctggttgggtgggggctggaggcgcggggcccccggcttgggttgcatcagactcagcaggtagagcatgtacactgcagtggtggtcctggacgtctgtctcaacagccccccaccctccagctgctgctggaggcaggtacacaccacccagcacaccagggggacgaagcacatggtgaagagaggctcgttgtccctcacgtaattgaagacttggcccgcctgctctgcattgtggaaatacttgtagaagtattccttcctttctgcctcagagaagcccaggatctccacatgcctggggtgctccagcagacggtggagcttctccaaagccgtgggccgtgtggtgatgagcaaagatagctcagggagcagcttcttccgaattaagctgttaagaagcagctccgtgggccgtttctcctcccagcagaggcaccagggtccctgaggatcgtggaaagaaggcttgagctcatcgaagccgtcgatgatgaaaaggaggcgctcgggaactcggatgagctcctggagaggcgcgctgggctcaggccagcagctgaagatgaggtcttgcatgctgcattccgtggcactctggttcatctccctgcagttgatgtagaagagataatcaaatctgccttggaagagcttcccgtccgcccagtccagcatcaccttgtgtgccagcatggacttgcctatccctgccgcgccttgcatgaccacggtgcgcggtggctcggggcgctcctcgtctggctcaaagagggtctctatcttgatggggctagcctggtgtcccacggtcctcgcgtgtccccggcctgtgtccagaagctgctgctggacctgcatggggtttgagtgctccttcaccagcaggagccgggtgtaccggtggctgaggttgacacattcccctaggcgcgcattgcggtcttccatgagccggaatttcctgcggacatagtccctgtaggtttcctggggatctaggggagaggaatgaaggttttgtggaagactcatcagcagcctctaatgagttcacgaggtaaagcgctcctcatgtggctcaaagaaggtgtgtgcctgtagttccagctactcaggaggctgagatgggagaatcacttgaacccctgaggtggaggttgcagtgagctgagatcgcaccactgcactctagcctgggcaacagagccagactccatctcaaaaaaaaattttttttaattaaaataatttatttgttttgagactaggttataagactggctaattttttttttttttagatggagtctcgctctgttgcccagcttggagtgcaatggtgtgctccctgcaacatccacctcctgggttcaagtgattctccagtctcagcctcccgagtagctgggattacaggcacatgccaccaggcctggctaatttttgtatttttagtagagacggggtttcactatgttggccaggatggtctcgatctcttgacctcatgatctgcccacctcggccttccaaagtgctaggattagaggcatgagccactgtgtccagccccacaaagtgactttcagcaaaggatttatagaacgggtacattaccagatagtgcagacatgaatctgccttttttcaaagggggcacaagccaggtgcggtggctcacgcctgtaatcccagcactttgggaggtccaggtgggaggatcgcctgaactcaggagtttgagaccagccggagcaacatagtgagaccctgtctctataaaaacaaaagaaagagaaaacaaagggggcacagaaaacttgggagcagtgcttctcaaactttttttttttttcagtacagacagggtcttgctgtgttatccaggctggtctacaactactagcctcaaacaatcctcctgcctgagccccgcaaaatgctgagattacaggcatgaaccaccatgcctggctgtgcttctccaactttaagacgcatacatatcatgcagcaatcttgttagaaatgcagtccctgggctaagtgcagtggctcacacctgtaagagatcgccccactgcactccagcctgggcgacagcgtgagactctgcctcaaaaaaaaaaaaaaaaaatctagaacaatgttcttaattggggtgactgtgtcccctagttccccaggggacatttggcaacgggacaagtgggttggttgttacaactgggaaagtactactgccacatagtggatagaggccagaggtgctgctcaacatcccaggaaccacaggacgaccccatagcaaagaacgctctggccccgaaatgccaacagtgccaatgtggagaaaccctggtctggatacaaatgcatcccttggtattggatgccagcagaggcccatgatagctgcctgagagaagcttaaaaaaaagaatctgagtttgatactaaaattttcaaaacaaatatgtgtacttttaattatagtgacatacacataaaatttaccattttaaccactttaaagcgtacaactctgtgacactaagttcacgatgttgtgcaatcatcaatatctctttttttttttttttttgagacagagtgttgctctgtcccccaggctggagtgcagtggcatgatctaggctcactgcaaactccgcctcccaggctcaagtgattctcctgcctcagtctcctgagtaactcgatttacaggtgctcgccaccacacccagctgatttttgtatttttagtagagacggagtttcaccatgttggccaggctggtttcgaactcctgacctcaagtgatctgcccgcctcggcctctcaaagtgctggaattacagacgtgagccactgtgcctggccgccaatgtctatttccagaatgctttcagcattctaaacagaaactccatatccattaaatattaactcataatttctcctctccctggcaactgctattcttttttttttttcttttctttttttttttttttttttttgagacagagtcttgctctgtcacctgggctggagtgcggcggcacgattcggcttactgcaagctccgcctcccaggctcacaccattctcctgcctcagcctcccaagtagctcagactacaggtgcctgccaccacgcctggctaatttttttgtatttttagtagagacaaggtttcaccgtgttagccaggatggtctcgatctcctgacctcatgatctgcccgcctgagcctcctaaagtgctgggattacaggcgtgagccaccatgccgggcgtggcaactgctgttctactttccgcctctgaatttgactactctaggtgccttagataagtggaatcatacaatatttgtacccctctcccgcctttttttttgagacagggtctttctcactccccccaggctggagtgcagtggcgtgaccttggctcactgcaacttcaacctcctgggctcaactaatcctcccacctcagcctcctgagtagctggatctacaggcacaagtttccatgcccagctaatgttcgattttttgtttttttttgtagagatggggtcttgcttgttgcccaggctggtctcagagcctggcctcccaaagtgcagggattacaggcgtgagccaccttgctcagctggtgaacccactcttattctactttagtagagctggagactagattcatttcatgctccccttgaaaaaaatagccagaaacatttgtggcattgttaacagtgttgctgtctacccagcagactgtaccccggtttcttccctgccagcaaacctgattctgtttggttggtggatgctgattcatgactcgagtgagtggtgaatcctgccccttcacaagcctcagaggatgaattatggttttgctaaatcagtcatgagtaacctcgttcccctctgtcagtggttgctctgagaatgggcagattccccagtactgaccagtgggttacgtggatgtgactggtaacagggaggaagaaggcctttacccttcctttctttgctttttttttaagagatggagtctcactctgttgcccaggctggagtgcagtggtgcaatcttggctcactgcaacctctacctcccaggttcaagtgattcttctgcctcagcctctgagtagctgggactacaggtatgctccaccacaccctgctaattttgtatttttagtagagacggggttttgccatgttgtccgggctggtcttgaactcctgacctcaggtgatctgcccgctttggcctcccaaagtgctgggattacaggcgtgagccactgtacctggcctcttagccttccttgttgcccctgcgtgtatgagatggtttggtagccatctttcagccaggagatgacacgtgtcaggacaaaatgctgacgtggaaaggttgatgagttgaaacacaggaggaaactgcccctttgatggtgtcattaatccaccccacgaattcctcaatcacgcgtttgtggttggcctacactccgtggggtcagctgctctgtgtagatgaatacatgtaggtacatggcttgaggctcaccttttcttggagtgacaagagagacttccagaaggcatgttgactggttcccaagtgaggacgggccaccaggtggggtatctggaagagaaattgtggaagatgagctagcacgcatctggctagtagcaccgcgtcatattagctgcgattacgtcgaaatgcctgcataactccctggtcacccgcaccccagaatgttcagtagtgactgcataggccgtgtgtgggaaatagctcatcccttgttccttgtagcgcaccctcctccctgggtccccctcatggtcattggcacctccatccatccaatcagtctttttttttttttttttttttgagacggagtcttgctctgttgcccaggctggaatgcagtggcatgatctcggctcaccacaacctccacctcctgaattcaagcgattctcctgcctcagcctcacgagtagctggcattacaggtgtgcgccacaatgcctggctaatttttgtatttttagtagagacggggtttcactatgttggccaggctggtcttgaactcctgaccttgtgatccacctgccttggcctcccaaagtgctgggtttacagatgtgagccactgcacctggcaccaaccaatctttttgactgggaagttctgagtcagtctggactcctcccttgtcagctctgggccacatctcatccattatcttttcttttttcttttcgagacggagtctggctctgttgcccaggctggagtgcagtggcacaatcttggctcactgcaacctctgcctcccgggttcaagtgattctcctgcctcagcctcctgagtagctgggactacaggcatgtgtcaccacgcccggataatttattttgtatttttagtagagacagggtttcaccatgtgggtcaggctggtcttgaactcctgacctcgtgatccacccaactcggcctcccaaagtgctgggattacaggcgtgagccactgcgcctggcgactctgtctcttaaaaatattttaatttttttttttttttttggtagagattaggtctcagtatgttacccaggctggtctggaactcctagcttcaagcagtctttcgaccttggcctcttgaagtgttggaaatagtggtatgggccatcgtgcccagcccaaaaaaggccttcgtttggatatatcataagattctacacatcgagtccttccttggcatctttggtcctcagaaggccccccaaagtcctaagtgtgagttcctttgctctcactccatgagaaagtcttcccacctggctagttctcccatcagctgagccagcggcaccccatctggtcctcactctgataagttttcacctccctgctggttgctagtccatgaaatgattcatgaaagcaaagaacatccttttgaaggagccaggaggcaccccaccctcttgttactacacagcccgccccccccaacagtctctgtagcttcatgtgaccctcttggcatatggggacaccttccctgtgagtctgtgtgactaataaactgttgtctttcctctgttcagtgctggctctggtagattcagtcatctggcaccattttatttatttatttttatttatttgagacagtctcgctctgtcgcccaggctggagtgcagtggcgcgatctcggctcactacaatcttcacctcccaggtttaagtgattctcctgcctcagtctcccgagtagctgggactacaggcacccatgaccacgcaggtggtggtaaaaatacaaaaaaataatttttgtatttttagtagagatgcggtttgaccatgttggccaggctggtcttgaactcctgacctcaggtgatctgcctgcctcggcctcccaaagtgctgggattacaggcgtgagctactgcacccggccactcaaaaatttttaattggagaaggttatcattgagaggaaaggggaaaatagggaattgtttaatgggtatcgagtttgttttgcaagatgaagagttctgcagattgaatgcacatcagtgtaaatgtacaacactcagcagcacacttaaaaatggttaagagggccagggcgcggtggctcacgcctgtaatcccagcactttgggaggccaaggcgggtggatcacaaggtcaggagatcgagaccatcctgggtaacacggtgaaaccccgtctctactaaaaatacaaaaaaaaattagctgggcatggtggcaggcacctgtagtcccagcaatttgggaggccgaggcaggtgggattacctgatgtcaggagttcaagactagccttaccaacgtggtgaaaccttgtctctattaaaaatacaaaaatgagccaggcatggtggcgcgtgcctgtaatcccagctactcgggaggctgaggcaggagaatcgcttgaaccagggagtcagaggttgaagtgtgctgacatcgcatcattgcactccagcctggtgacggagcgagactccatctcaagaaagaaaaagtggttaagaggaggctgggcgcggtggctcatgcctgtaatccctgcactttgggaggccaaggtgggtggattacctgaggtcaggagttcaagaccagtctgaccaacatggagaaaccccatctctactaaaaatacaaaaattagctgggcgtggtggcagatgcctgtaatcccagctacttgggaggctgaggcaggataattgcttgaacccatgaggcagaggttgcagtgagccgagatcgcgccactgcactccagcctaggcaacaagagtgaaattccatctcaaagaaaaaaagaaaaagagggcaaatttcatgttttgtgtattttagcactatttatttatttatttatttatgagacagagtctcactgtgtcgtccaggctggtgtgatgttggctcactgcaacctctgcctccagggttcaagtgattctcctgcctcagcctccggagtagctgggattacaggcatgtacaaccacgaccagctaatttttgtatttttagtagagacagggtttcaccatgttggccaggctgttgtcaaattcctagtctcaagtgattcacgtgcctcagcctccaacatgctgggattacaggcatgagccactgcagctggttggcaatttttttttttttttgagagagggtcttgctctgttgctcaggctggagtagtgtggcatgatcttggctcactgcagccttcacctcctgggcttaagtgatcctcccatctcagcctcccaggtagctgggtctgcaggcatgcaccactgtgcctggtcaattttgtagagaaggggttttgccatgttgcctagaccagtctcaaacttctgggctcaagtgatctgcctgcctcagcctcccaaagtgctgggattataggtgtggccacattttttttttttaaaggtaatccaggccagcgcggtggctcacgcctgtaatcccaacattttgggaggctgaggtgggtggatcatgaggtcaggagattgagaccatcctggctaatatggtgaaaccccatctctactataaatacgaaattagccgggcgtggtggcgggtgcctgtagtcccaggtactcgggaggctgaggcaggagaatcgcttgaacccgggaggcggaggttgcagtgagccgagaacgcaccactgcactccggcctgggtgacagagtgagactccgtctcaaaaaaataaataaataaaaataaaaaaggtaattcttgaaaattgcagctgaaaaaggcctcagagatgttctccctcagtgtttcctaggcatgccgcgagaaccagccacatcaaaatgcagattcctgttgcctaagacctgctgattcagaatcacgggttgagggtcttggattccccattggccacaagtgtctcgagagactcttacgcacagtaacatgagaactgccgatcttgcctgatgcccttgttttacagatggagatggaggcccaggggcatatcgattctccagcatcacacagacagaaagagcaaagctagacatctgtctccttgggaacgctgagctgcctctcagtagactaaacggatgcagtccggggaagaacgctcggcaaatggttatgcattgtcaatgctgggagagatttaggcggaagagggagaaaagtgggactttacttttgattctatatttgtacattatttccatttcttaaaataactatgtaacacttccatttagatataattatacaatatgacaagtaagtaaattgatacttttttctttcttttctttttttgagatggagtctcgcttttgtcatccaggctggagtgcagtggcgtgatctcggctcactgcaacctccgcctcccgggttcaagtgattctcctgcctcagcctcccaagtagctgggattacaggcgtgtgccactacgcctggctaatatatatatatatatatatatatatatatatatatatatatatatatgtgtgtgtgtgtgtgtgtgtgtgtgtatatacatatgtgtatatatatgtatacatatgtgtatatatgtgtgtatgtatacgtatatatatgtatgtatacgtatatatatgcgtatatatgtatgtatacgtatatacgcatatatatgtatgtatacgtatatacgcgtatatatgtatgtatacgtatatatatacacatgtatacatatatgtatgtatacatatatatacacacacacacacgtatatatatatgtatgtatgtatattaagacggagttttgctcttcttgtccaggctggagtgcagtggcgggatcttggctcaccacaacctccgtctcctgggtggtggagaaaagggaaagagaaaaagagaggagagggagagaaaagaaaagaaaggaaggagggaaggaaagggaaaagaagggaaaagaaggaaggaaggagggaagaaaggctacaaacaagtgtctttggttttttcagtcattaaagactttgttttttacagagatgtttcccagcacactactactggcacacctcattaacgacgagtcattaagctttgcagaagtgactgtgtatatccagttattggcagggcttgcttactcattcagcaaatgttcaccaaagtttgctcggttcctagccccagccagacactggaatcgcagagaatcacacaggggagtcaagactctttctgcctttgaaggcgtccatgtcacagtagagaaaacaggtgagaaattacattaaaaaccacagctcaagcagggtgcagtggctcacgcctgtaattccagcattttgggaggccgaggtggatggatcacctgaggttaggagttcgagaccagcctgaccaacacggtgaaaccccgtctctactaaaaatacaaaaattagctgggtgtggtggcacgcacctgtagtcccagctactcaggaggctgaggcaggagaatcactggaacccgggaggcggagcttgcactgagccaagattgtgccactgcactccagcctgggcgacagagtgagactctgtctcagaaacaaaacaaaacaaaaaaccacagctcaaatggggctctgtggtgcacacctgtagttccagctgttcaagaggctgaggcaggcggatcacttcagcccaggagtttgagtctagcctgggcaacatagtgagaccctatctctaaaaaataaattattttttttttttttgagacggagtcttgcactgtcacccaggctggagtgcagtggcacaatctcagctcaccgcaagctctgcctcccaggttcacgccattctcctgcctcagcctcctgagtagctgggactacaggcgcccatcactgcgcccagctaattttttgtaaaaaataaaaatatttttaaaaaaacaattccacagctcaagtgccatctctgccacttcagcaatagcctatatttgctgagcacttgctacctgctctgaattgtgttaagcactttgcatgtattatctcttgagcttatgcctgagtataaatcatattttttcttttttttttttttttttttttgagacagagtcttactctgtcacccaggctggagtgcagtggcttaatcttcgctcactgcaacctccaccgcctgggttcaagtgattctcctgtctcagcctctagattagcagggattactggcgcccgccaccacacccggctaatttttttgtatttttagtagagacagggtttcaccatgttggccaggctggtctcgaactcctgacctcaggtgatccatccacctcaatctcccaaagtgctgggattacaggcgtgagccaccgcacccagctcattgtgattattttatgagatagaagatataataaaagaaatcatgttggctgggcacggtggctcacacctgtaatcacagcactttgggaggccgagacggctggatcatgaggtcaggagatcgagaccatcctggctaacatagggaaaccccgtctctattaaaaatacaaaaaattagccaggcatggtggcgggcacctgcagtcccagctactcgggaggctgaggcaggagaatggcgtgaacccaggaggtagagcttgcagtgagctgagattgcgccactgcactccagcctgggcgacagagcaagactctgtttcaacaacaacaacaaaaagaaatccaagagtgctaaggaggcacagaagtggggtttctgagccagccagagtggtgggagcgaggaatcagaaggagtgggggaagaggagtaaatactttactttagagaaggtagtggcttcaaggtttcagtaagtaatacttttccaggcaaagaagatggagaatattccaggcagaacacagcatgaacaaagaccaaagggatgaaattagaattctgtacacagtcataaaaaagaacaaaatcatgttctttgcagtaacatggacgcagctggaggccattatccaaagcaaactaatgcaggaatagaaaaccaaagactgcatgttctcacttataagtggaagctaaacattgggttctcatggacagaaagatgggaagaagagacactggggactcgtggcggggagaaatctcaccattgggtactattactatgttcaagtacctgcatgataggatcaatcttactctgaatctcagcatcactcaatatacccatgtaacaaacctgcacatgtaccccttgaatctaaaagttgaaatttttatatagatatagatgtgtgtgtacgtaaattagaattccagatctcccaggctcagggattagtatgaaagaaaagggaattggtggccaggcagtggtcattcatgcctgtaatcccagcactttgggaggctaaggtggaagctcgcttgagcccaggagttcaagaccagcccgggcaacataaggacacctcatcttggccgggcacagtggcttatgcccgtaatcccagcactttgggaggctgaggtgggtggatcacgaggtcagaagttcaagaccagcctggccaagatagtgaaaccccgtctctacaaaaaatacaaatacaaaaaattagccaggcatggtggcaggtacctgtaatctcagctactcgggatgctgaggcagaaaattgcttgaacctgggagacggaggttgcagtgagcggagattgcgccactgcactccagcctgggcaacagagcgagactcagtcttaaaaaaaaaaaaaaaaaaggatacctcatctctttcttaatttatttttgagatggggtttcactctgttacccagcctggagtacagtggtgcaatctcaactcactgcaatctccacctctcaggttcaagcgattctcctgcctcagcctcccatgtagctgggactataagcgtgtgccaccacgcctggctaatttttgtatttttagtagagacagggttttgctatgttggccagactgatctcgaattcctgacctcaggtgacccacccgccttggcctcccaaagtgctgggattataggtgtgagccactgcacctggctacctcatctcttaaaatatatatacacacacacatatacacacacatatatatacacatatatacacatatatatacgtgtgtgtatatatatataaattccagatctcccaggctcagggattttatatatatgtattttaaatatttattttaataatatatgtattaaatatttaatatataatatttattatttatatatatttatataatataccatatttatataatatagtatatttatataataaatatatactatatttatatataatatataccatatttaatatatatttaataatataattatatacatattttaaatatatatttaaaatatatgttttaaatatatatatttaaaatatatgttttaaatatatattttaaatatatatttaaaatatatattttaaaatatatttatttaaaatatatatttaaaacatatattttaaatatatatattttaaaaaaatatattttaaatatttgaggcaaggtctcgttctgtcacctaggctggggtgcagtggcaggatcatagctcaccgcagcctcgaccttctggtctcaagtgatcctcccacctcagcctcctgagaagctgggatcacagacgtataccaccacacctggctaattttttttatttttggtagagacagagcctcactatgttgtccagactggtcttgaactcctcacctcaagtgatctgccctcttcagcctcccaaagtgctgagattacaggtatgagtcactggacccggctggcattctagccttgcctgtcccgccacctccttacccctcaccaggtcctctctctgtcctctctcccacaggtccttcctgtttatccgctcaaaggtgctgagagccaacctccaggcctcctctggcccgaagtgggtgatgagcagctgggccatttccaggggaccggccttctccatgcttccccaggggatcttgccttctcccagctctgtcgcggtccccaggtataacttgaacttcttcagttccacagcctcgagttcttccaagtaggtggacaggcgacagaggccgtccctgcctgcggttcgtagcatgggggtgccgtgagccccaaaggagaggacctggaggctgagatgctcctatgcacgggacacagggcgaccccagcacaccttccattgcatcattcacaggcagcgggcggagaggctgagccagtggttggaggagagagcaagggaggaaagaccttttgctgaaataatgctttctcactcttcagttccctcctgccctgccccactcaccaatggctgttct

SEQ ID NO: 412 - DNA, 30803 bp, Homo sapiens; identical to SEQ ID NO: 411
  source 1..30803: mol_type = genomic DNA

SEQ ID NO: 413 - DNA, 30803 bp, Homo sapiens; identical to SEQ ID NO: 411
  source 1..30803: mol_type = genomic DNA

SEQ ID NO: 414 - DNA, 23128 bp, Homo sapiens
  source 1..23128: mol_type = genomic DNA
ttctttttaagacgagaaacttaattttattgatatggacgaagagcaaggaaacacagtatctgcatctccagatttccgataaccttggccagcacgatcccccctcctttagtggccagggctgtcttcttgctacactttcagtgccgcatattcatgagatcctgggggctcctgggtggtgtctgaagctgcctcagacagggcgctggtgcttagctcagcataggtcactccttgggggtctgccgtctttggagaaaatagatgaatattagaactgagtgttcaatatggcagccactagccacacatggctattgacatttaagttaattacaattaaatttaatttaaaacccaggtcctcggtcacaccagatgcatttctttttcttttctgtttttataaccctttatgcctgtgacatcaatggatctgcgtaagccttttttcattttttttaaatttttatttatttatttattttgggacagagtctggctctgtcgcccaggctggagtgcggtggcgtgatctcggctcactgcaacctccgcctcccgggttcaagccattctcctggctcagcctcctgagtagctgggattacaggcgcccactaccacgcccagctaattttttgtatctttagtagagatggggtttcaccatgttaaccaggatggtctcgatctcctgacctcatgatccgcccgcctcggcctcccaaagtgctgggattacaggcgtgagccaccgcgcccggcccatgcataagccttttaaatggagattttggttcccattaggggagtttcgtgacttgtctaagaccacatgcgtgataaacagtatacatttctgtatgggcttaaccaggaggcacacacgaccagcccattgtggtgagggagctcttgtgggactcctaagcgggaggactcaccgagagagataccctttccatattggataaatctgcctctgagtgagaaaggaaaaaaaaaaatcagttctcagctgcagaagtcagaacttagtctttctatccggtgattcccttaaacttcccctgtcccttaccggcagcctcctgctccggaagtttggaatggctggttctgaaagagagagacacacgtgaaaggatgggatgtgaagatttcggggagagggtgagggcaatggaggggagaggaagggagaagaagggagaggaggaaggtcacagaatgggctggggtgggggctcagggtgccaatcccggatgtgccaatgggttcccttgagaatgacatgggaataagtggagcatgagctatgccaagcatctacctcttggtggattcctcagatgatgaacctacaaaaaatgcaggaggaatttacctaccgagaaaatccttcactccccctctctccctttgcgttctctgagctcactgtgctggctgcatctgtagatgatgaagactgagaggaagaggagaaggatggagatgcagctgaagatggcgacaaagatggttctggtgtctggagggggaagagcaggtcagggaatcagcctggctcctgaaatccactgataggggcgagccgaaaagctaagagaagccagacagatggcctggcttccaagcctggatctcccacctcggagctggaacttcctattgctttggggaatttccttaatcttctccaagcttctgtttccccatctgtaaagtgaggatagcagcagtagctactttattggatggtgggtcagtacctatagaaagggctggaacagtgcttggcgcataggaaattccaaaaattcccagggaatgtttggtgcatagcaatgatattgatcatttattgtgagccagctctgttccaggtgctccatatatatatatacgtgtgtgtgtgtgtatatatatatataaatgtatatatatgtgtgtgtatatataaatgtgtatatatatatatatatatatatatatatatacatatatatatatatatacacacttttttttttttgagatggagtcgtgttctgtcacccaggctggagtgtgatcctggctcactgcaacctccacctccctggttcaaacaattctcctgactcagcctcctgagtagttgggattacaggcgtgagccaccacatctgtctgtgtaatcactgtctgaaatccactgatggggtgagtagaaaagctaagagaagccagacagatggcctggcttccaagcctggatctcccaccttggagctggaacttccttggagctggacatttcgaccaatagactttgagtaaagcagatgacccactgtcataggggtgggcctcatccaatcagttgaagactttaagactttaagagaaaagactgaggtcccccaaggtggaaggaattctgcctccagactcaagctgcaatatcaagtctcccctggatcccctgcctgcctgccctgcagatttcagacttgccagctccccacaatcacgtgaaccaatccattaaaatcaatctctctctccatatatgtatatacatgtatatgttctcttttttttttttgagacaaagtctcactcttatcgtccaggctggagtgcaatagtgcaatcttggctcactgcaagctccgcctcccgggttcaagcaattctcctgccttagcctcctgagtagctgggattacaggtgcccaccatcacgcccggctaatttttgtatttttagtagagacggggtttcgccatgttggccacgctggtcttgaactactgacctcaggcaatctgcctgcctcggcctcccaaagtgctgggattacaggcgtgagccaccacacccagcttatatctatatgttctattggttctgtttttctggaaaaccctggctaacacagacatgatctcagctcttaacttcaaacatatttcctttttctttttttaaaggagagagagagatgtgaaaggacgggatgtgaagattatggggagagggtgagggcaatggaggggagaggaggggagaggagggaggtcacagatgggagctcaggatgccaatcccagatgtgccaatgggttcccattgttgcccaggctagagtgcagtggtgtgatcatactcgaattcctgggctcaagtggtcctcctcactcggcctccagggtagctgggagtacagaccaccacgcccagccaacttcaaacacacttcaatgagctcgttgatgccaggtaatgaacagcagtgacacgggcatggaaggcgtttagagtggggaggggtggggctctctgaaggagacatgattccccaagacacagaacaagggatcagctgggagaattcagggaggattcctaataagaacagggttagagcagggtagaaaagaatgaccagtggccgggcacggtggctcacgcctgtaatcctggcactttgggagagtgaagtaggtggatcacttgaggtctggagttcgagaccagcctggccaacatggtgaaaccctgtctctactgaaaatataaaaaataagctgggcatggtggcgcacgcctgtagtcccagctactcaggaggctgagagaagagaattgcttgaacctgggaggcggaggttgcagtgagccgagatcgcatcactgcatcatacactcaactgaccaagactccaactcaaaaaagcatccctctcaggagataaaatttctaccaattaaaaaacaaaaacaaaacaaaacaaaaaaaactagttcttgagcaatattgccatgcaagtctacatcatagcgttttaaagtcttaacaacaaccctgcaaggtagtacaattatttccctcccactggtgaagggcatgcattcccgtgtgactcctgggattacagcaagggttgtgtccaaagctcacagcgttgaggaagagagagcaacctgttactaaagctaggcgacagagtccatgcagttcccccccgttttttgtttttcttggcactttagattcaagaaacacaagtcgtgagactttaaggagtaagtagcagaaacgtgattaaggaaaaaagttgagcaactatagaagtgaggccccagaaaggggcttcaccaagacccccgctatctttgttagtgtgctttgagtctgagaatttttcctaggtgtgcaatgatctgtggtcacattacagagccaagtctgagatgcttcacacgcctggtcctctgcaccaacagagggtctcccatccagacgcttcccctacttggttcgctatgtttgcattggcatttctacatatctatatatagagaattacctatctaatttatctatctcgctaatctatctaccatctgtctaggtatctattatctatctacctatctatctttatctgtctctgtacctacttacctatcatctatccaatctatccgtcctatctaattatgatttatctatctacctacttgcctatcacctatccaatctatctatcctatcatatgtaattaactatctgtctgtctaatttttctatcttgttaatctatcacttatctaggcatctatgtatctatctttatctgtctatccacctgcttacctgctgtctgtctaatctatccatcctatcatatctaattatcacttatctatctaccgacttacctatcatctagttaccaaatctatcatctatctaatgtatctatcaatcataaccagttatctatcatctatcatctatcatctgtatgtatctgtctattcacctactattatctatttaatctattctatctagttatctatctatctatccacctacttatctaatttttctatcttgcaactctatcacctatctaggtatctatgtatctatctgtgtatctgtatatctatctatctatctagctagctttatctagctacctagttacctatcatctatctatctaatctatcatctatctaatgtatctatcaatcatatctaattatctgtctatctaatcatctatcttatctattatatctagttatctatcatctagctagctagctaatctatctgtatctatctacctacttacctatcgtctatttatctatctaatctatcatatctagttatctatctacttacttatctaacctgttgtatctagttatctatctacctacttacctatcatctgtctatctatctaatctgtccatcgtatctagctacttatctacctatcatctatgtatctatctaatctatcatatctagttatctatttatctgcctacttgcctattatctatcacatctaattatctatctatccccctccctgaaataaggttctttctgagctgatcatcagggagcagcaaaaggagtggggagtttgaaacaagacatatttgagttctagtactgggtctcctacctcctgactttgtaaatgttcccttccctttctggaatacgttattttttggttaaatataaggagggggcagagagctaataatatctaacttgaagagttaggtaatgatgaaaaatcctggctttaaagcgctcagtctagaaactgactcattgtgtcggataatgggattgtaggtataatgatgattttttttcacccaatattccacctacacccatctctctctgtaatagattctgtcaatgttcctcaacccatgttccccagatccctttcccatttttatgcattctagatcgtggcttctttccctttccaaagtgaacatttgtatctcttctttgggggactgcctgggagaactccaaatgccttggaatttacatgcccgggacaaactgccactgacggctgtggggaccccagctccctagcctctggtcttcgaccttctctgtctccactgctttctgcaggatggagccaaagataccatctgagggacacagatatcccacacttgtttaatctattttcctcccagcccttcttccccactccctaaaatgtaattttcaagccaggcgtggtggctcacacctgtaatcccagcactttgggaggtcgaggcaggcagagcacctgaggtcaggagttcgagaccagcctgaccaacatggagaaaccccgtctctactaaaaatagaatattagctgggtgtggtggtgcatgcctgtaatcccagctatttgggaggctgaggcaggagaatctcttgaacctggtaggcggaggttgcagtgagccaagatcacgccattgcactccagcctgggcaacaagagcgaaactctgtctcaaaactaaataaataataaataaaataaaacgtcactttcacactaatgctgtctaagagcctgcttctggtggagctgaatcagagaacccctcaaaagcaacaatttttttttttttgagacagtctcactctgtctcccaggctggagtgcagtggtacaatctcggctttggaacctccccctctggggttcaagcaattctcctgcctcagcctcccaaggagctgggattacaagcacccgccacctcaccccgctaattttttatatttctagtagagatgaggtttcaccatgttggttaggctggtctcaaactccagagctcaagtgttctgcccactttggcctcccaaagtgctgggattacataagccaccatgcctggccataagcaacaattctatcagtgcatctccaaggacttatgaaaacagggcaggaacagctgctcctggactctcagtttccccagatggaagcagagaaacagcagccttgccttgtcctttctgttctccccttttccagcctacggtatctttcacacagcaattcactagaaatgagaagtacattattgcaaaattctcatcttcatatgaccccataatcagctgaactgggttcaccctgagatgtccacagatcctggccaaatgttgcatcagtatttgcaaattgccagaataaatcataacttgctacgctactaaagtcagcgtgagcaacaagatacagcctgacacggggcataaatggaggcacaggcaccagaaagaaagtcaagtcttgtgtgataaaattcatcttcattctctacattgcgattgaacatagagtcgttttctagtgtgttttaggcatataaatacaggctggggacatcatacctgtgcttacagatattttacttttattttatttatttactgaaacagggtctcgctctgtcacccaggctggagtgctgtggcgcaatcacagttcactgaagcctcaacctcctgggcgcaaacgatctttctgcctgagcctcccaagtagctgggactacaggtgcacaccaccacgcctggctaatttttgtattttttgtagagatgggatcttaccaagttgtccaggctggtcttgaacccctgggctcaagtgatcctcctgcctcatcttcccaaagtcctggtattacagacgtgagccactgcgcccggcaaagatattttattctgtttagaattgtgatgatacaaatttgaactcaaaaagtacattttaagaaattatataatacccactgggatggctataatttaaaaaaagaaaagtaagtgttgacaaggatgtggagatattggaacccacatatattactggaaggaatataacatgatacagccacaatggaaaatgatttggcagttcctcaaaaagttgaacataatagtcaccatatgtcctagcaaatccacttctaggtacatactcaagataatttacagcgcggagacaaacagatactcctaccacagtgttccagcaccattactcgctttagccaagaggtgcagacaacacaaatgtccatcaaaagaagaacggggccaggcacagtagctcaagtctgtaatcccagcactttgggaagctgaggcgtgtggatcacctgaggtcaggagttcgagaccagcctagccaacatggtgaaaccccctctctactaaaaatacacaaattagctaggcatggtgacgggcgcctgtaggtccagctactcaggaggttaaggcaaaagaatcacttaaacctgggaggcggaggttgcagtgagctgagattgtgccactgcactccagcctgggcgacagagcaagactccgtctcaaaaaaacaaaaacaaaaacaaaaaaaagaatggataagcaaaatgtggtctatccatacaatacgatgcttttcaccatgacaagaaatgaaacattgatgcatgctacagtacagacaaactttgaaaacattatgctaaagagaaaggagctagtcacaaaggatcacatagtgtatgaatccacttacacaaaatgtccagaatagacaaaatcatagacacagagaagcatatgaatggttggaagggcctggtgggaaagtgggaaatgaggagtgactgcttaatgggtacaagattttcttttagggtgatgagaatgttctggaattatgtagtggtgatggttatactacctcatgaagatacaaaatgccagtgaattggacactttacaagggtgaatttttggactgtgaattatatatcaataaaaaaagaaagaaaataaatgatacaagagctcaaaatagaaaagcttctcttcctcctccccctcacacctcactagatctcccacctcgtttctgatacttctgtgttcctctctcccattagatttcatatctttctcagaaaacgttcctgacgtgaattgtgttcgtagtgctagggtagcagacatttcccaagcctactatcatggaataaaaacgtttcaaatagttatcttgcaagaacactttggaggatacctttttgaaaaccgattataccagcacagactgctagcaacaaccttcagcaactttggctctttggagtaggttgcaggaagattatgacttgctgaaaggaaggatgattaagcatctagatgccaatttatattctgcatttggcccttaaagtctggatgagttcctgtttcagccgaatgctgccaaaagctctaactttttaattttttttttttttttttttttttggagacagagtctcactctgttgcccaggctggagggcagtggtgtaatctcggctcactgcaacctctgcctcccaggttcaagcaattctcctgcctcagtcacttgagtagctgggaatacaggcgcccaccacaatgcccagcaaatttttgtatttttagtagagacagggtttcaccatgttgcccaggctggtttcgaactcctgacctcaggtgatccgcccacctcggcctcccaaagtgctgggattacagatgtgagccacctcgcctggcccaaaagctctaatttttatgagaaactctgaggacagaatcttagtcaattgttaatgaataagcaacattagaaaaaaaattcaatattcacctatttttgagaattttagagttataacaaactcttgattatatatattcctgaagtacctactctgcgtaggtcctggtcctactccccaaatgggtcactgaaaaattcacccccattattccccaaatcccaccctagtttttcatcatgtcatatggcaaacaacgcactctgtgctgttttacacaccagcttcttcagaacccggaagcactttagaggttatctcccctcatcctccaccccccaaaacacagcagtttccccaataacattgagaaaatgggctttaaagttcttctaggccgggtgcggtggctcatgcctgtaatcccaacactttgagaggccgaggcgggggaattgcttgaggtcaggagtttgataccagcctggccaacatggtgaaaccccatctctactaaaaacaaaaaacaaaaaacaaaactgagctggatatggtggtgggtgcctgtaatcccagctattcgggaggccgaggcaggagaattgcttgaacccagaacccaggaagtggaggttgcagtgagctgagattgtgccacttcacgccaccctgggggacagaacaagactctttctcaaaaaaataaataggccgtgtgcggtggctcacgcctgtaatcccagcactttgggaggctgaggcgggcagatcacaaggtcaggagttcgagaccagcctggccaacatggtgaaaccccgtctctactaaaaatacaaaaattagctgggtgtggtggtgcgtgcctgtagtcccagctattcgggaggctgaggcaggaaaattgcttgaatccgggaggcgaaggttgcagtgagctgagattgcgccactgtactccagccttggtgacaaagcgagactctatctcaaaaaacaaacaaacaaacaaacaaacaaataaataaagttctccttgtgcactttaagcaaaggtgatcatgaagcagatctcattgggaaaaacatctcctttctaattatcttacctgttttcattgagggagcttcaagttcatcgtgtttatctagaaaataggagggaagaaaaggaattacactaatcatacaggaaccttggggacaggagtcctcacgtcctacttatagacatcctgttcttctttgggaagcagaaaagagaatggcttctccattccctagatgctccctgggtcctcagagcatggacagagcctcagattactcttcttaatagtcctggagtttgatagtatttttaataacaaaaatatttatgaatgaccctgctaacgccccctccagtttgattccttgccagtcttctctatcttgacaaagaacaccattcacccaaattctttctttcttttattttttttgagtcttgcactgttacccaagctggagtgcagtggcatgatctcagctcactgcaacctccgcctcccgggttcaagagattctcctgcctcagccttccaagtagctgggactacaggcgcccgccaccacaccctgctaatttttgtatttttagtagagacagggtttcaccatgttggccaggctggtctcaaactcctggcctcaagtgatcaacctgccttggccactcagaatactgggattccaggcatgagccactgcacctggcctatatttctatctccacagtggcaccatttagtctaagttaaaatatcacctacttggccgggcgcagtggctcacgcctgtaatcccagcactttgggaggccgaggcgggcagatcacaaggtcaggagatcgagaccatcctggctaacatggtgaaaccccgtctctactaaaaatacaaaaagttagccgagcgtggtggcgggcccctgtagtcccagctactcgggaggctgaggcaggagaatggcgtgaacccgggaggcggagcttgcagtgagccgagatcgcgccactgcactccagcctgagggacagagccagactccgtctcaaaaaaaaaataaaaataaaaataaaaatgaaatgaaatatcacctactcaccagtccctggcaaccaccagttgcttctgtgagtttggcttttttagactacacatatgagtgagatcctgcagaatttgtctttctgagtctggcttattttgtttagcatgatatatgcggagatgttgatgaaagggtataagtttccagttctaagatgaagaagttcaggtgctcagcatggtggcaatggatgtgctaattaatttgactgtgataatcattacacaatgtacaggtggatcaaatcatcagattgtataccttgaatatatacaatcttcatttgtcaatttgatatttttaaatttaaaaagtcgtattgcctgaaacgcaccaactcttactacatctagtcccttattttccaaaagcagccagaggccgggcatgatggcctgtgcctgtaatctcagatgcttgggaggctgaggtgggaggattacctgggcctgggaggtcaaggctgcagtgagctgtgattgcaccactgcactccagcctgggcaaccgagtgggaccctgtctcaaaaaaaaaaaaaaaaaaaaaagcagccagtgacccttccagcatataaataaaatcatgccatcctccagctcaacttcatcagtgggttcctgttctttcaaagcagactctaggaccagttcaaacacccacaagatcctagatgctctaggccctgccttatgtcctcctttctgtgtctcaatcattccaggaacactcacacttctgagactttgcttttgctgctctctctccctggagggctgttctccagatatcggtgtggttgggtcattctcatccttcatgcttgtggcagatagaccctaagggggcactcaggagactcaggagccctgcttcctggtgttcatgcctttgtctaatcccctcaccttgagtgtggagatctgtgactttcttctcaccaatagctatggcaaaggtgatgggatgttatgctcttgattatgttacattacataaaactctgtttgctagggcatttgctctctctttcttctctctctctcaatctctcttcttgcaagtgctgcagaatcattctagcatgaatcctacagctataaagaaccagatattgctatcaaccacaggagtggagaaatggacccttccccagtcaagcctccagatgagccagatgagaacacagcccttgttgacaccttgattgcatccttatgagacccaaagcagaggactcagctaagctgtgcctggactcctgacccacatcaactgtgagataataaataggtgtttcaggctgctaaattagtggtaatttgttatgcagctgtagatcactaatacaatgcctctcacagttattctccatctataatgtgttttttaattactctgatagcttgctcttatttctttctttcttccaaagaagaatgtgagctcctgttggccagagacctggtctgtctcagttcctacaatatgctcaggatctaccaaagtatctgaatttgtagggtgaatgggcagctatttttgtgccaggtattttgcattaatttttttttgtaatggaagcatttatatgcccattttgtaataagtaaaaagtagtataataaaaaagtaaaaagtagtataataaagtgatttgcaaagcagcaaacagattgtatatggaaggctgacctggaaaatcaaccactggaaattgatactatagcctgtcttgtgatgtaatggtacagctgcgatagaggtgaagaaatcaggaaacagtagatgatatgccagagaacataattgggaaatggcaaataatcgcgaggcttttagggctaaagtgtgggtgcagaaattcttaagactacaagaacgagttatggggaatacaatttgaaatcaatatcaaagtgatgagcaccttgttggagtatcattgatcaagagcctcagaaagagggtaaatcagaggtgaaacattaagtattcagttactcatcatgccccaagcccaggctaagtcattggtgtggacccacggctacttctacactacactgatgactgtaaagtctctccagggatttcccatgatatggcaggactgacctactggaagcaactgtggtcagttgagaggtattgtttagtgactaataaatgaatggatgaatggatggatggatggatggatggatggatagatggataggtgggtgggggtgagtgaatgggtgaaagggtggatgagtggatgaatgggtggaaggatggacaaatgagtggctgggtaaatagatgggtaggtaggtagatagatggatgaaggggtgggtggacagatgaatggaagggttggtggttggatggattaatggatagatgaatggatggatggatggatggatggatggatggatgagttgatggatagatggataagtgagtggatggatgggtgaatgagtgggtaggagggtggatgggttggtaggtgggtagatgggtgggtgggttgatagatgggtgggtagattgatagatggatgggtgagtagataaatgggtagatgaaagtgatgcaaaattattctttatccctcttccttgggatctcaagtcatgtatgttacaatcctcccacgtgcatcttctcactgtggtcctcatcatttttttttcagttacctgcaccgtgcctcccatacttttccacacaatgggatctcttagccccacaatccattatttgccattcctacatccctcatagagcactggacactctttctggctttccttctctggcataatgaaatataaattttcatttatgtctgaatagcaactgtgaagctcattgtttttgtgacaccggggaggtcacctaatctctatgagcaaaaagaagttagtaacacaaccaccctcataggaagtgaagactgaatgagttagtggaggcaagttacctgtcgtggagacaggaacatagaaaatgctggatacatgtcaaatgccagtgttatcactctatcctcacctgtcacccagatctccagcttgttgctggggaaggaggccaagtgtgatgagttgctcaggtaatacacacagctgtagtttccactgtcattacttgtcacgttccagagcatgaaatcagtctggttttttcttacttgcctgacttgtaatggttctgggatccccattttcaacagagcaattacaatacattcggttccattgtatggagtgagacatcgaagtgtcctgagacctggagtcatcccagggtctacattgactgagagcaaaggttctgggagtgatcctgaagaggacaaggcaatggaggtaaagagaagggccagggcttttccattttctactgcacttggggactatctcatccatctctccgtattaaccatgtctttcatcttctgcatttgatgctttaacatcttggggccttgctgcccttggtgggacctcccctcgcagggttagttaatttctagagccagtaaacaacttgtcctcaaggatgtccctcaaatgcaagccaatagatccagagcccatactctcaaccaccttaattatggggctctcacactcaaggtcaatgttgtcctctcctaatcaccccaggtccaagaactagacaaccagggacagcctctacaccccaaagccaattctttttttgtttttcttttctttctttcttttcttttcttttctttttttttttttttttttttttttgagacaggttctcattctatcacccaggcttgagtgcagtggcacgatcttggctcaccgcagcctctgcctctggggttcaagcaattctcgtgcctcagcctcccgagtagctgaaagcacaggtgcacaccaccacacccaggtaattattgtatttttgtagagatggagtttcgccatgttacccaggctgatgtcaaactcctgacctcaggtgatccaccctcctaggcctcccaaagtgctaggattacaggcatgaaccaccacacctggccaactctaatcttgttctccccacaaaatacaatcaaagctctggtccacagttcttcctcctccctctgcccctcattgaccctggtgcttccccacatactccccccagtatagccttcctcctcctcttgggaactgtaacagaccatcttttccatggcaatcatcacttggtctgtcagtcttaccataccccaattttctattaactgaccatattctacaccaccctcccacatccacatcattgggaccctctcagaatctctgatgagaatcttgctccacattcggttcccatttccacattgaaggtgttgcatctatccttcttcttcttttttttttttagacggagtcttgctctttcatccaggctgcagtgcagtggcacaatctcagctcattacaacctctgccttctgggctcaagagattctcttcctgcctcagcctccctagtagctgggattacaggcgcctgccaccacgcccagctaatttttgtattttaagtagaggtgaggtttcaccatgttggccaggctggtctcgaactcccgacctcaagtgatctgcccacctctgcctcccaaagtgctgggattacaggcatgagccaccgcgccgtgcctggcctgcatctatctttttgtctcctagattccttcttccccagccatgtcccacgacaggaaaagaaatacgtgcatcaggcaggctttggtgactcacgcctgtaatcccagcactttgggaggccaaggcaggaggatcacctgagctcaggagttcaagaccagcctgggcaacatagatcctgtctcaacaagtaatttaaaaattagccaggcatggtggtgcttgcctgtactcccagctacttgggaggctgatgtgggaaaatcgcttgagcctgggaggtcgaggctgcagtgaattgtgttcatgccactgcactcctgcctgggtgacagagcgagattctgtcaaaaaaaaaaaaagcagccgagcgcagtggctcactcctgtaatctcagcactttgggaggctgaggtgggcagatcacttgaggtcagcagttcgagatcagcctggccaacatggtaaaaccctgtctctactaaaatacaaaaattagccaggtgtggtggcgcacccctgtagttccagctactcgggaggctgaggcaggtgaattgcatgaacccaggaggcgggggttgcagtgagctgagatcatgccactgtactccagcctgggcaacagagcaagactccctctcaaaaaaaaaaaaaaggctgggtgtggaggttcacgtttataatcccagccctttgggaggccgaggcagatggatcacttgaggtcaggagtttgagatcaacctcaccaatatggtacaacctcatctttattaaaaatacaaaaattaggccgggcgcggtggctcatgcctgtaatcccagcactttgggaggcggaggcaggtggatcacaaggtcaggagatggagaccatcctggctaacatggcgaaaccccatctctactaaaaacacaaacaattagctgggcgtggtggcgggcgcctgtagtcccagctactcgggaggctgaggagggagaattgcttgaacccaggaggcagaagttgcagtgagccgagatcgtgccactgcactccagcctgggagacacagcaagactctgtcttaaaaaaaaaaaagcaaagccaaaccaaagaaatgtgtgcatcaaagagtacatctgcccttctcacctgtgaccaccagctgcaagtgttcactgctttctgaccactcatgggaggctgttgtcttgtaggcacaaaagtacctcccagcatccttaggcttcaggtccgtgaaggggaattcagcttcgttttctgccgagctctgttcctgcttgtacccagagtcgttcaccttgcgcagcacaaatgtcacattctgggaatgagcctgacacttcagggtcacattgctctcggcttcaaccaccgagctgggccaggcgtggagggagggcttgggcggtttctctggaaacaattcagagttaatttgagtctagaattcagacgattaaaggaaaaggtcatgaagcgtgggatgcaggaataaaagtttaagtaggagaaaactcaccattctttttctcatcttcgtagcccagacacagccctggaagagaaatctcaatgagagaaaaattatgtgcttgtccttgagtacaaatccagcagagaacgtatgactagctctttataggtctgagatatatatatatatataatgtatatatgtattatatataataaatgtattaagtatatgtacacatattacatataatacatatataaatataatatatatattaaatatatgtattacatatatgtatatatttttggcagatatctccccagacttacctcttacttttgttccattgtttgtcattcagaagctacgtgtatggagaaaattccagcaacttcttctttctttttttttttttttttttgaaatgtagtcttgctctgttgcacaggctggagtgcaatgacatgatctcagttcactgcaacctccgcctcccaggttcaagcaattttcctgcctcagcctcccgagtagctgggactacaggcacccgccaccacacctggctaatttttgcatttttagtagagacagggtctcaccatgttggccaggctggtcttgaactcctgacctcaggtgatccacacgcctcggcctcccaaagtgctgggattacaggcgtgagccactgcccccggcccagcaaccttttctgatgtattgaattgctttcatgagtaatcctttcaccatctagaaattgttcaacattcacctatgcttttttctggtattttctgtgattgcagtgttttgttttgttttgagacagagtctcgctgtgtcacccaggctggagtgcagtggtgcagtctcagctcactgcaacctcctccaccccctgggttcaagtgatactcgtacctcaggctccagagtagctgggactacaggtgtgtgccatcgtgcccagctaatttttgttgttgttgttgtagagatggggtttcaccatgttgcccaggctggtctcaaactcctgagctcaagtgatccacccgcctcagcctcccaaagcgctgggattacaggcatgagccaccgtgcccggcctgattgcagttttacccttgccacttaaataatgcaaaggttattttatcgtggagtgagagtggtgggttttttttttttttttatttttcgagatggagtctcgctctgtcacccaggctggagtgcagtggcgcgatctcggctcaccgcaagctctgcctcccgggttcacgccattctcctgcctcggcctcccgagtagctgggactacaggcacccgccaccaagcccagctaattaatttttttgtatttttagtagagacggggtttcactgtgttagccaggatggtcttgatctcctgacctcgtgatccacccgcctcggactcccaaagtgctgggattacaggcatcagccaccgcgcccggccgagaggagggttttcttgctcaattccaatagagagaatctgctcccccttccccgtgtcttctggtcccaaatactctcctcactttagctttggtttccacttacattatcccctccctcttctgtgttctgttctctacattccccgctgggaaggtagcgtcttaaacttgggtggaaaatgggatgtcagtcatggggcttgtttcagggtgaagttacgtagaatttaggtagaaattctctagagccacgacagtgtctcaggacattggttccttgttgacacaggtgccgatacagaacgtgaccccccaccaagcttcaccacagaggaatgaggtggaggcctcacgatggaccgaagctgcgttggcagcgagattagctgggattggcaggtaggaaacagcctctgggtgggcagggcatcccaggactcaggctctgttttgagaccctccccaaatcccgcttttagattcatgtcatctcatctctgctatccacccatcgtctgttcaaacagtgattcctatattcttttttctttttgagacagggtctcactctgtggcccaggctggagtgccagggtgcagtcacagctcactgcagcctcaacctcctgggctcaagtgatccatccatctcagcctcccaaataactgggactacaggcatgcaccaccacgctggctgattttaaaatttttttgtagagatgaggactcacgatgttgcccaggctggtctcgaacacctgagttcaagtgattctcccaccttggcctcccaacatgctgggattacaggtgtgagctacctgcacccagcccaattcccatattctttttcttttctttttttttttttttttttgacatggagtctccctctgtcacccaggctggagggcagcggtgctatcttagctcactgcaacctctgcctcccaggttcaagcgattttcctgcctcagcctcccgagtagctgggattacaggtccttgccaccatgcccagctaatttttgtatttttagtagagacggggtttcaccatgttggccagtctggtctcaaactcctgacctcaagagatctgcccgcctgggcctcccaaagtcctgagattacaggcgtgagccaccacacctggctgatttgtgtttcttgaaaagagaagttcaagttgtaactcccaggacctgcgaatgtgaccttatttgaaaatagcattgtctgatctttgcagatgtaattaattaaactaagatgaggtcatactagagtaggctgggtatctaatccaatataacttacaagaagagaaaaagagagacagagacacacagaaggaagacggccatgcgaagacagaggcagagaggccaggctgcaatcatagtgctttgggatgccaagataggagaattgcttgagcccaggagttggagactagcctgggcaatatagcaagatcccatctctaaaacagaaattattttaattagtccaacatggtggtgtgcacctgtagtcctagctgctcagaaggctgcggggaggactgcttgagctcaggaggttgaggctgcagtgagctatggtggtaccactgcactccggcctgggcaactgagtgagaccctgtctaaagaaaagaaaaaaaaaaacagagccaacgattggagtgatgcatctacaagttaaagaatgccgggagcgctggctcacgcctgtaatctcaacagtttgggaggctgaggcgggcagatcacctgaggtcaggagttcgaggccagcctggccaacgtggtgaaaccctgtctctactaaaaatacaaaaattagccaggcatggtggtccatgcttgtaatcccagctacttgggaggctaaggcaggagaattgattgaacccaggaggtggaggttgcagtgagaaagatcatgccactgcactctagcctgggtgacagagcaagactccgcctcaagaaaaaaaaaaaatgccaagaattgtcagccatcactagaagaggggcataaaacagacgctccttcatagttctcagaaggaatcaacattgcaaacaccttggtttcagacttctcatctccccaacttaaagcaattctaattcctttaagccaccaggcttgtagtactttggtatggcagccattgggggatgaggtcagtctcctggttgcccagcttactgtgctcagcagctggaggcttgggtatgaacccgatagtcatctctaaggcacaaatagccgggtgcagtggctcacacctgtaatcccagcactttaggaggttgaagtgggtagatcacctgagttcaggagtttgagaccagcctggccaacatggtgaaaccccatctctactaaaaacacaaaaaattagccaggcgtggtggcgtgtgcctataatcccagcttctcgggaggcggaggcaggagaatcgcttgaacccaggaggtggaggttgcagtgagctgagatcacaccactgcactccagcctgggagacaaagcaagactctgtcaaaaaaaaaaaaaaatgctcatctaaggtgcaaatgtgtgtaggagacgagcattaccccacaaggaagggctgcacccagaaaaggaggaaggaactgaagcagacgaagcacgtcgatgtccaccgcaccccccgtgcaccagggaggaactggggccttagggaggtggagctctgctgggtcaagcctagagtttctatgtagtaaagccgagattataacccaggtcatccgtttcacagtgtgagctctgtctgaatacatcaggttcaattggaggatggttaaaatcagcctaagaatcgagctggtcagaaaattgtcttcttggggccaggtgtggtggctcacgcctgtaatcccagcactttgggaggctgaggcgggcggatcacctgaggtcaggggctcgagaccagcctgaccaacatggtgaaaccccgtctctacttaaaatacaaaagtcagccgggtgtggtggcctgcacctgtagtcccacctactcgggaggctgaggcaggagaatcgcttgaacctgggagacggaggttgcagtgagcccagatcacgccattgcactccagcctgggctacagagtgagactctgtctcataaataaatgcatacatacataaataaataaataagagagagagagaagaaaattgtctttttgcccacagccttgcaccctgtagatccctaagcccagccctcctctattccgacggaggatgatggcagtactgcggtatttagcggctgcagactcggagaccccacagcagctctgcctttcccagcggagtctgtccccgtgtctctgcagcgcggcctcctcctcgcttgcatgtgggcggcagaactcacagaacccacagcccagacccacccaccgcaggtgtgcaacacctggaagtcattacttccacacaccgcatttccacctggactgccactcccacatgagtttttctcaccagcccaagcccattcgtcccagtcctggagactcaccgaggcaaagcagggagaggaattctgcggtcatagcgtcccttctgccagaaccaaggccccgccttgggttttacccttcaaaggcggagcgggactgggccggccgcagctctccggctgcccggttcgtccccaggatgtgcagatagaggaggttttgctctgacactctggttctctgccccactcttgcagtttccttctcac

SEQ ID NO: 415 - DNA, 26911 bp, Homo sapiens
  source 1..26911: mol_type = genomic DNA
ttagtagcacgattattttattatatgctttataaaaaaacaaacacccaaagacatacaacacaccgccctcaccccccagcggccattagggagggggcttatacttttcctaatgtagatctggccatcttataaagcagaccacattatttgtttccatatatacctgtagatatttctctcccctcaaatatttatatctcgactaaaaaaaggaggtgcaaagagtatataaagataaatgagattttcttgctgttgttatagtacaaacaccagatgactaccagtggagtaacagggcaaaacaaaaacacaaaccccaccttcagtgaggaatggaaggtctgttaccgacctcaagtagctgaatcacctgctgtaactggcacctccctgacaatcatgggtttgtagggacatgggccaggtgatggcttctacttgtttccagaaggctaatgtgtcctacaccctttcttagtaactaaagacgaactacgggagaacccagtatttggattctgcccagaggtattaaatgcacaaggaaaaattagttatgtccaagtagcaagcaataatatttttaaaccaacatggttaaatgttaagatttgtagaaatcaaaatatttattcacataattttaaactaaagttgaagctaatatatcttccgtggtaatgatttaagtgcaagtgatgcttggctttctttcacattcatttcttttcttctgagtgaaggcatatcagttattcttgaacaagtcaatacagctctgcaaaagggagacattgttctgtggggaaaaaaggcaaggcagaccagtgaattattaaaacttgccatatacctggaatgactcaagtacaccaacacggcttttcacgggaggtttaaagtcagccagagcaagctggcccttctcttcatcaaatcccaggtgaactgcaacgtaccacgcatccccatttcatgtttcagctcctctccctcagtgggtaaggctaccagccaaagagccgacgttcactccagcacctctgccctcacctgcttgctcctaaatgtgatcctgcttactgtaacttcttaagacactatcagtgcgttgttccatgaaggcaagggccttggaaagattgaataaaagttgctagaaattagggctgggagctttagctcacacctgtaatcccagcactttgggaggccaaggcaggtggatcacctgaggtcaggggttcaagtccagcctggccaaaatggtgaaaccccatctctattaaaaaaaaaaaaaaaaagttgctaaaaattagtcatgggtgacattataaacaagactacaaataaacaatgagtggctcccatcaactaagtactacagacgattaataccacaaggccaccccaactgcctgatgacaatgggttagtaaactgggaaataacttggaaaaaaccataaaagatgttggcttcatctgtagaaaacacttaccctggcatgttttatttccagttcagacatttcaattagattctttctaaatgctgccactctcttccgtttgaaatttatcagttctacaggaagaaaaaatgtttatgaaaccaagaaaaactaaacaattttcatgttcactttaactaccaaatggcattcttacaaatggtctccaatgctttcaggcaccagcattatttcctcacatttgtattatctctgtgactgggacacatcagacatctattaactgtggtgatacagctatcactgtctttaagtggaaaacatcactgaatcaccaagcatcgtgagtgggagagcagcagcttatgacttggagaacacgttgatgagcagcctcactctcaccctctaggtaccagtgactgggaacagggctggagtatgggtggtggtgagccacatacttcaccaatggcttgtgaaaatgcttctcaaaagaagacataccaggttcatgcaaacaacgttcagcagcactagccattagggaaatgcaaattaaaaccacaatgagattacctcacacctgctagaatgcattttctcaaatagatgaaagatcagtgttagcaacaatgcagagaaaagtgaactcttctacaccgttgctgggaatgtaaattagtacagccaccatggaaaatggtatagaggttcctcaaaaaactaaaaatagaattaccatatgatccagcaaacccacttctgggaatataaaaggaactgaaatcagtatctcaatgggatatccgtacttccatgttcactgcagcattatttacaatagccaaaatacaaaatcaattgagaattatccatcagtggatgaagacaatgtagtatagatacattatactatccggccttttaaaataacaaaattctctcatatgggacaatgtggatggatcttagaggacattatgccaaataaaataaaccaggcacagaaagacaaacattacatgatctcacttacaggtaaaatcttaagttgaactcctagaagtagagaacagaatgatggttatcagaggatgagggtggggtgctggggaaggtgggaaagagaatgggtagaaggctgcagctaaactcaaggaataaattttgagatctactgcacaacagggtgactacagtcaataatatatattgaaacagcaaatttcaaatgtattaccactgaaaaaaatgaaagatgttaattagcttgatctaataatttcacattatgtacctgcaaagcatcacactgtattccacaaatgcaatacaatgacttgtcgattaaaaataaaacttaaaacatttttaaatccaaaacagtgaaaaactgctacacgtattcaagacaggtttacttgatgatctttagggcatgcttccttttcatctactcctttttctttttttttcttgagacggaatcttgctctgttgcccaggctggagtgcagtggcgggatctcggctcactgcaagctctgactcctgggttcacgccattctcctgcctcagcctcccgagtagctgggactacaggcgcccgccaccacacccggctaattttttgtatttttagtagagacggggtttccctgtgttagccaggatggtctcgatctcctgacctcgtgatccgcccgcctcagcctcccaaagtgctgggattacaggcgtgagccactgcacccagccctttttcatttcatctactcctattgccatcagaattcggcattaatgacccattggaaattggaacaaaccaagaatatgcatgtccgccctaattccttcattgaatttgtgacatcaagttctgtcttgcagttttacttgactaaaactttgaccatcacccaaccttctgctggtgctcaagtgttcagagcagactcaccctccttcctgtctctacagtgctgtgcaaaagaactacaatacaagcagccacatccaagttaaaaagtcacaaatttcatagtgatatgtcaagtctatagtgcttgcactacaaggtgatgtttatcagtcccttggatatcctgggtgaagataagctccctgccttcctctagacctacacacagtaccagggctccatacacttaactattcacctcctgtgaaaccagcccttacccactgactcaactctagtcgtcagctcagctgcaagtctcagaaagcacttataccaaaggcaaacaggttaagacccaccaatctcagcattccacagaatactgtatttttagatagtgtacctatctggcattttgaatataggatataatcaatgtgggcgaaaactttaggcagtaaaggtagacctgaattggcatcattttttaaagttttatgttttttcttcaatctcctctaaaatttccagagccatgaaactggcctataagatttcaactcagtagttttgaagtgtgtacgtttccttgaaaattttagttttaaaaaaaaaaaaaaagctgtaattgtttcagaaacagggtagcatgaaggttactttggaagaacccaacacagcctcagagcctgtctacatgacatttgccaggaagctctgtgcctttgtgccttacagttaaggcattgtattataatcctgaatagacagacaaatgattagaaatctataaagtctaggtttcccccaggtagcttcaaacatgttgatgaacacatcatttccctatgtctagattaccctaccactgggaaacaagaaagttaggaaaaaactaagtaagatatgaatttttcatggaaacacgcgttagggggttgggattgagtccaacagtgccccactacaactactcacattctgggtaatccattccaacatttgctctgacatgttccatggcccctgagaaccccagagaagatccacagaatcctcttaggtaaggactacatattatactcatgttcaatagaaatggtgaaagtcctctgctctaagaggtgaaatggataaggcaagaaagaaccctatggatgtggacatggaccggacttgtgatccctgaaacctgcatgtgtgtgcaacggcatatgtgtgcacacacacatacatttcctagctcagtccactgaagggcacagaagcagagataccccgaaacgatgagcatactcagatgctggtaactgttcccaaagaaaaagaaccctggctccttgaaaaaatggccagtttcaaggctggagcagagagtaagattagcatggcctatcactctaaaaaagacgggttaggctgttacaaccacatgccagcttaaaggtgctcctattggcaaagtctggacaggcatcaaaaataacttggtaatacaataatgaattctaaaccattttaaaaactgggagtccatgactctaataaagataaaggaaatttctgagaaaagggaaggcttttttgtagtaggatgacaagtgccaacttgggtaggaaagctagagctagagatgagggaaatcgtctttctgcaatcgtcagagtaacagctggtttaggcaagaatcattaatacatgctaaacctagggaggaagtttgatgaagaccaaggtatttgcatggtcttaaattgcctcaccacagattgatgggggttaaaatagtaactacacagtggagaaactggatttggatactatctaattgagtaatcaaaattaccaccacgaatgaaggagagacacactgtccaatcagaagtgacaccccaataagggcatattacttctattctgccaggagcccataaccagatctaaacatgaggaaacctaccaaaagtcagaaatacaggatttgtaaagagattctctaaaaagactgatactgttaaaaactaagaactattccagagtaaaggagactaatagctaagacaaccagatgcaatcctagactggatcttgtagaggacatcaagacaaacatgaaaatacagagagcagattgtagacccaaagttaagtttatcacagcaaacaaccatactgtaaccatacaagagaatgtcttcagtcttaggaaataaaccacaacgtttttagggctaaaagaagcatgacatatgcaacttaatctccaatggtacagaaaaaccaggtgtgtaacgtttgtaagcacgcaaagccatgaggatgactgtgcatgtgcaagtgataaggcagaggggtgaagtgctgacactgggtgaaggatacatgggtgttttttgcactatttgtagaacttttctaagtttgaaattattttcaaattacagtacagaaagaagaatgtcctgctcaaccttcttttgcagattcggaaagttgttcaaatttctggcagcactcctgctggtgtgcctcagccaacttgacgtctttgctctttaaccgggccttatccagagctttgtttgagttctcatagtcaatgagggctttggtgcgtctgtataagagatcctgggaaaaaaattaacaggtatacatactaagtatctaaaccagtctaaaaaatagcccaagtgccaatgtaccacctgagatgttagtggcaataatctacctctacaccttccctctcccagagtatttttaaatctccagcttcgcagggatgagcaatgctgatagctttgttgagagctttttttagaattccttatatgaatcaagtgattactcaagagtgaaaacagaaggacttttgttttccagtaattcagtaaataaagttaactttaaaaattaaatattgtgtatcagagataacttgaaatatacagtcactgctgggtaagtcaagttgagcgctgctaaaatacaactgggcaatgaagtagtaagaaacataaccctaccctgcaaatcctgcttctggtaatctaccttggagatccacttagtcagatataaagattctttgcaatcttacaacagagtagaagttactttagtatctgaaatgagcaattatgatgtatagattacacatttaaaactaggtgaaataataactgatgggtgaaactactaggcctatttttgtatatactcaaataatcgtaagtgagctcttaattccatgaaagtagaaaataggctattaaaaaagtatgtttttaaaaactcccaagattcagaaaacatgccaaagggcaaattaactaaaataaaattgcatgatggggggaaaaattttttttactcttttactttctgatgacatttcagccttagagggcatacaatcctatctaattttattttgcctgatttaatacatttcacataaaattaaaacatatttgttcagggcaatgcagacaaagcatgtttcattcccaaaggttattctgcttaccattttgtccacatatacatataacgcttcacggctcaaaggctgcagggatacttgcaattcaataaaaactcccaaatcttctttgccccagaaacagccctttctgcatgttatgtcccacatcaatgacctataatcccccaaactattacctgtctacttcacacaacccatacagtgctgtcagatacacaagctttatggatacaatgccagaaaggcatgtcatttataaaaacaagtctgataaattcttattctgctcctttgtataaagaaactttttaaacagacttctggtcctgcactgctctgagaagctgagcaactctcttcctaccttagcagcttcaatgttgagcatgtagtatcggaggagctctgttagcttcaaatcttcatctgatgaaactcgaccctctactttctatatagaaaaggaaaggtcaccatcaaggcagaaagctatagattataaaatatatattatgaagaccaacacagaaatccttacccttagtttttcaaatagctcagcaaccttcaataggtacctggaaatgtacatataattttggtttaaggtcttaaatcatctataaaacatgatcttaccagtgtgcaagacaggaatgggtcaactcaggagtcctagcctttggtactttagcattaatttaaaagtagtgctctcacttcaactgaccccaaatagtagagaaaatggtcacaaaattacacacatgtacagcaccacactcagcctcttggtgacccttcggtcatcctgccatgcgcccaaatattcttattaaatgccaatgctgtgtaaaccaaggttggtttctaatgagctatgctatgggcatcacaaagcagtaaatatgctatttaattcgtcatggttctgccattagcctttcaatttcgagtcagaagtagtatcacctgttttgccaagcctggatgttaagtaaaatattgtcttacaccagaaatgcccaggatggagaaactgaaacacatacataagtgcagagtgaaaatggaagggtttttaattaatgaatgaaggtaatttcagaaaattgtacatcaaaacagctgtgtgttagactggggtcattaaattattctcatgaccactataaccaaatctcttcaaggtccagggcaggggcacatgttctcaggatctcctgaggctgcatcacaggccaaaaaaaaagaaggtctagggcattaccaggcaaaattgcaagcaccaattgccaggggaagatgcaagataaactcttacaaactccaaaactaaagaaaacaggcttttaagtgtgacagaaactactgctttgacaacatttactgtatttgtttacatatagaagagcccaagtcccctacaattgtcttacaagtgtcttatgtccagagaacatgtaagatgagtgctagagacttgtcttactgagcttgtaactccagagcaggaccatgtagtcactactcatttatgcttttaattacaccactcggcactcttcaattgggttaggggaaatgcttttccaaaaaaacttactttttgatgactgtgggctcttctaaagccaggctatgtaagcaggctgcggtgtggatatagtcatcggcaacatctgcagaaacaaggacaagtctttttatccaaacacagccaggctcatcagcaaagctctgactagcggtaaatgatatttacttttatgagatctggtcattttgtcagctttcacacaagaatctttgatcctattgtaatagttaataaggaagttcttctcttgctcaaagaagtcatctacctcctagaaggaagaaaaaaagaaccagacatttcatgaaatatactatccctgcagccttttacatttatcaatataaaaatatattgcttagaacatggcatataaacgtgagtaaagtttaacctctacagatcagggaattacaaatttacgatactatttcttaaccaaggctgggaaaaatcaagggctggcagaaaatgtctacagaagaatcacttaacaaccaccagtaaaactggcaccctaagacacagcaattttacgctagtacaatggttctaccaggtggaacatggccacttagccttggatacctatctgtgtgtgaatgaggtttttttttctcgattggtttcagactgggaggaaatcctggtatctggtaggcattggccaaggatgccaatgccaaatatcccataatgcatggatacaggacagtcccatacaccttaaactggaccaagtccgagtttcctaatttctgatgatgccctctctacttagcacctgtattctgggctccctggagtggcaaagccagataccagacagtaattgtaagggtaactcagttacaaaggaatgagaaggcccgagaagtagtaaagtaaatcatacctctaacggtaacggaaacgttattttgtattcttgtctttgtgctaacgccttgaaatccagtatgtaaataaaatctaaagtttggttccttagttgtgccagctaggttgcatgtcaagtgcttctctatcacctgtagttggtgaccaaactggacagtgtagttctgagagtgggataaaatactgatcttgtactttattttagaaattaactgagtaatctccctccttacagaaaaggagaaaatgaagccaagtgtggaaaggttcaagttgcttctcctgggacagaacaaggtgctctgggaaataagtgaaaattgaataagtagatgaaaattaccaaaatctgaagaacacttacatgtcttaaaagttaaccatttgtttcacaagtatctctttcaaagaaacaaaaggtcacctattcccgatgaagtaaaaaattttctccaacagccaaaggtcacttaccttaactccagtaaaaaggacttcatcagcacttttcaccacacttttgaagaagccaccaaacatctctttagtatttttccgcctaacacttagctaaaagaagaaaattccaaagagtttatatggtatggatttttctagattctcttaaagaagttctgagtaacattttaagtaatcctctttatcagtacaggcaaatgcataaagtatctttaattctgccttaacctccaagcttaaaacacctaatggctaaacccaaacataggtaggtcatctcattctaaaaggcttgacagattttgaaagactgactagaagctaagtcttagtggctctgaaatccttgggaaaattactgttctcttctatccatattaagtagcaaaaaccaaaacatgttaaaaagaaaaatagcataaaagtcataattcgcggccgggcgcagtggctcacgcctgtaatcccagcactttgggaggccaaggcgggcggatcacgaggtcaggagatcgagaccatcttggctaacgcggtgaaaccccatctctactaaaaatacaaaaaataagccgggtgtggtggtgggcacctgtaatcctagctactcgggaggctgaggcaggagaatggcgtgaacccagaaggtggagcttgcagtaagccgagatcgcgccactgcactccagcctggatgacagagcgagattctgcctcaaaaaagaaaagaaaaaagtcataattcaacaaaaagcgtaggtgggaagaaaataaattacacaaattttaatttccttaaaatgaacttagttaagtttggaattgttaagaaattaactaagggatgtttgggactgttaatttcttaaaaagaaacctaggttttggaaggggaaagaagtcaaaattttctttaagcagagttttacaaaaaatgacttacaatgaaggaaaagcagcatctaaaaaggtttccattgtgtaagaaattcaaaactttaaagcagtagaaactatcaagtacattttgaaagtataaacatttgaagtggattatcaaaatggaataaaaatgccttacatcctgatcatattccaggaaaacatgaaagttgcgatctttactgagaacagggtgagaagaaagccgctgaagaaagacttcatgggaggacacagtcttcttaaacacagcgagatactcactgaaaagagatgtgcacatggcattcagttgacacagctcaactacctgaccaataccactcctgattaattctatggccctgctcatgccaccacataaaacactgcaactggaccaaacagtatttcagtataaactggtgtctagttagatactaaggcagttgccatttttgaatctgtggaataagactatggaggaaagcaatgttgtaactggatttgatgggtcaagtccatgagctcctaaatctacatgcaattactgttacttagtagccacagaacatttgtttctttaaagcaatgagaaccctttaactgcagcctaagtatacagcatgagtctaatgaagctaaaagttaacaaaaattacaaagcagctttatctcaacctagacattaaaagtcaccttaaaattcctaacggtagaaacttggatctgttgtgttcagtgcctcattccccagagctggtcccgagagccactcaagtgtgtgctaaatgctttcagggcctggaggtttgagtgctgccctagatgacacaggggtttggagagggggagctgatggttgaagaggggaggaatgagtacttttcagctaagatgaggaaatgcaaggatggattcataagaaactttccaaaaatctatttttgtttgaaaaaattaaatgacaaccagattaaaatatacttgctgcctgtagacctggacttcctctttcaaattatctatgtgatggttactgagaatgctactctataacagcactatttggcctggcccaggggcagctcactataatctcagcactatgggaggcaaaagcaagctgatcacttgaactcaggagttcgagaccagccggggcaacacatgacgaaacccccaactctctagtttcttctcaacgtctagtaaccaagcttccgaaagaaaagctttgtacattatgagcaatttataaaggcacaaaagtttatttcctcactgtgccagaccagcatccttaataagtatgccctacatatgggaaaagacaactactctatcgggtattagtgtcaatggcctccaatgaatcaatgtgtgaagtacaaagaccatgtcccacactatgcaagatgtattactagttttagaaaacgacgctagggacctaattaaacagctgcacttaaaacaaaattaagtcaggttcttctacttatttttgtacacagcaccacttttctacttctcaaaagacagagcccaccaggaaaatccacttacgcttccagttcttgtttcatcttggcaaattcttctttggtcatagacccttcaccttctcccagtttctgcatcttctctcgaggaccatcaaagtcgggcttcgtaggagcaggtggaatctgcagcagaggcaggaactcatgagcctcttgtcccagcagcgatgttttctagttggtgcctcattctactcttgctggtccacaggagacaaccactccactcctgtggggctatttaaaagtcaactcctgttttttcttaaccttccttaactcttctggacatttaaaatgaggtgtcttcctgagagttgcatattcactttgatggcaatcatttgttcagtttatccattatagacaattgttcagagcacaacagtgtctatactgcttcagtgttcgcctaaaactagtacaacgaatgctaagcaccaaagatgagccatcaagattataaagtgttcagtattccaaaggaattttttcctaatcccaaaggataatcaaggactctaattttgaatgaaagacatatctaaatataagcttcggtattaattttgtttaatgattaagcaatcatcatttggagagcttcttcagtctgcctggcaggacaaaacgcgtggaaatctcctttaaaatcagttaagtctgttcctgccgccaagaaataacaatcaagggctgaaaactgcctccttgagcactttttttgtttttgggagaaagagtctcgctctgtcacccaggctggagtgacgtggcacggcctcggcttactgcaacctctgcctctcaagttcaagcgattctcatgcctcagcctccccagtggctgggactacaggtacgcaccaccacgcccagcaaattttttgtatttttagtagagacagggtctcatcatgttgcccaggcacgtcttaaaattctgagctcaggtgatccacccaccttggcctcccaaagtgctaggattaaaggcatggcctccttcagcaacttttgagaaatcttatcacaaactattaccaatagcagtgtttcctagaaatcaattctactgacataggaaaaaacataccagagaaaaaccaaacctaaaggtaggtaagactaaagtcattacactgttcacacccctttacaatgtaaataatgtaagcctgtatgcaccacctcaaagctgtaacactattccttcacatactttccacttgacagtcagcaaatactccagtaggtagatgaaatctaacttttcacaatccattaaaaaaagtggatataagtctcttttaaactaatgcatagcaaggcagaaagaactagcttatttgattttctaaaagactcacaataagcccagcatagtctgttgtttcaataagagtgtcatgtagccacacaaagtcttcatgttgccttgtaacagaaaactctgggctctgaaacgtgggcagtgtggtctgtaaagaaagaaagaagttaactggtaaccacgacttttagataagtgatctgggtttcctaggctacacagtgggaaaattctgcataatacatcataatatgatccagtaaagaacaaagcagttatacatgatctcctgtcatgaaagtcatagctaagattcaacctgaactctaacgatttctccccaaactccacctttctgaagcttgtaatgaatatcccatcagaatctactggtagaagttcagttctaagaaataagccacaaccctaattctatttttttgtttctgtgtacttttttttgtttatatacatttttgggacagggtctggctgtcacccaggctggagtgcagtggaatgatcttggcttcttggctcactgcaacctctgccttccaggctcttaagccatcctcccacctcagcctcctgagtagctggaactacaggtgtgtgctaccacatccggctaatttttatatttttggaagagacaggtttttgccatgttgcccaggctcaaacgatctgcccatcttgtcctcccgaagtgctaggattacaggtgtgagccacccaacccagccccaaattctatttttgtaagtctgaatttaccccccacccccaacttatgacaaagaagaaaaataaattttaaaaaaacctcttagctgtaacttactatggttctaaaaattgtccctggcttccttccttttcactccagtgaatgctgattttacctcctttgatctggtaagctcaggcagagaattatgtcaccagtctttttacactacctccggaataactgaagtgtgctattcaagccgcccaggcgttaagaaaaaaccacatgggaaaggtctttcccaatttagtaaatgctgaaaaaaagcaagctacagagacaaacttcccttggatgcaaattaaaaacaaagctggggcccggtgtggtggctctggctcacgccttgaatcccagcactttgggaagctgaggcacgtgcatcacctgaggtcaggagtttgagccgagtgtggtggctcaggcctgtaatcccagctactctggtggctgaggcaggagaattgcttgaacccgggaggcaggggctgcagtgagccaagatggtgccacttcattccagcctgggcaacacaatgagactgtctccaaaaaaaaaaaaaaaaaaaaaaaaaaaaaaacaaaaaaacaatgcccacagcccagggctctgccacagcagaatgctgctgccgccacaatggcactcacctgatgcttactgtgagatagattagggaggttctcacttaatagtgctaccctacgaatagcaactgtttcaagctcagggaatctcttctcacatccactgtgaataacaaggctgcaacctagcactgtatgtattaccactgcatgttacttacctttgtgtgcactgtaaatttgactttgtctctctcactgagcgcatcaggtatgtcaatctgaagcgagggatcaacattcaggtccacagatacagatctcagctgaaatacattttttgcgtattagtttcaaactcatttggccctaaaaaattattccaaaaatgagtagttactaaaaagcagtttatacatagatcatttagaaatgtcagttgagctgggcgcggcggctcacccctgtaatcccagcactttgggaggccaaggcgggtggttcacagggtcaggagatggagaccatcctggctaacatggtgaaaccccgtctctactaaaaatacaaaaaattagctaagcgtggtggcgggcacctgtagtcccagctacttgggaggctgaggcaggagaatggcctgaacactggaggcggagcttgcagtgagctgagatcacaccactgcactctagcctgggcgacagagcgaaactgtctcaaaaaaaaaaaaaaagaattaaaaattaaaaaaaagaaaaagaaatgtcagttgagacatttctaagtttatgtgaaactgaggggaaacccattcttcacatgcattggtatatccgaagtattcctgtaatgtaaacaacagctacaataatgtcatgtacaatacatttggccaaatacctgactgtacactaaggcctgaactaaatagaacaaaatcttgaattcttacataaatgccaaagtacaatgaacattcaagaggcattaaccaggccacacaaatatctgaaaggaaaacctggggagatggcacagagaacagtcatgtggaataggatcctgggtggagagttcagagtaaacctgggactgtttcaaatagccaaggaatctagacaggaggggtgaattagaaaaaccaaccaaggccttacttaattagcacaatcccactgtggttacacatgagcaacaagtgtgagcatcactctgaatactcaattaactgattttctgagctggaaattgagaggaaaaaaactacctaactccatttctgcccgtcaaaaaaaaaaaaaaaaaaaagagaggagagaacagtggcagcactaataggaactgggctattagggaaaagtgacttaaataaaagtacattaaagcagacaaggtggtggtcaatctgaaaacctgacacacaaggcacgaggaactcatagcgtaagcatctcattgccccattccttttactgtaaggagtgctaaagtaaagttgtcataacactggattacccaaagcacggaatgccaagtgaagattacaattaagaagatgaggtatttcactccaaatttccctttgggtccctttcttcaaaataaaaagttcaagactaaaaacttatgtacttaacctctaaaacttgaaaatctggtcaatcagctataaaaagactaaatatattcactaaaagcacatggattacttaagtttcaagtactccctttttccttaagcactgtatatttataattctgaaagccagagggagcctattacaatggctttcctccaaaaaattaagctcaagtagtcaccagaagttgattttaacatcaactattagtaagatcaaaacagatacttttgagtcctcacatctcaacctaagtatttttcttccacatgaattcttgataactcctatgaaatatctgcttgtctggcttaattttcacatgtccatttgtgagatctctgcaaacaaagataaagcttcaaggtctgcgacttcatttgatcataactgactccagctttggcgtattttctgataagagcttccttccttctgctaagttaacactggcaaatacagcctttaaaaatacctcaaatcattaactgaatgtgattgcagaggctataccaacgactctactgatcttaggcttatctgtcaaggtcaggcaggcccaagaacaggaataaacagagccaggcctaagaagtagccatggtctctggaggagacataggacagctcacaggacaggtctaaggtgcctttcccagagctcaaaaactgccacatttcctaagattccatttcctaaagtcacaaaccctgacttctagcactgctcaaatgaatatgctgacagttccattttcgctcacaagcccagcaaactcagtgagcctgtgaactccacatgggatacccttggaattcgaataggaggacccaagggggatgtaatcaagtaaatggagctcatttgtgcaccacagttaaagctgcaatggatgctaccagctgctttagctgcttttcgttcctctgaataattatcttctcttttcgtccctttccccatgtagaggtaatacccccgactatacctgtcttcctttctggttagtatagaaacatattttttgtttcagaatgtgatgaagacaaaaagaagaaaaccactaggttatgagtgactgcaaccacagcatatcaaacatccgaggttcactagcagccattttgcccagacatttcgccctaggaagggattcaagcaaaactccaatcacttgacatgacagtcctaaccaccaaataagcaaataatgcaatgttgtatttgggccttaaagaactgtctaaaagagagtattggcaaaacccctcagcatccaggccatcattaactcaatgtcccccaggcgcaagttaaatgaactttctcatattatagcatataaccctccagatgagacaaacatgggtagaaacttgtgaaatgactagagcttctaagtcagcatttgtactctcactcgggaagcatcaagtgtgaccaaaagttcagcattccttctgcttagtcaacaaacccactccacagtgctacagaacttgctaaataattgccaggctccactcttcccctctcacttgcctctgcctccatccccccttaagcttgaagggctcagagtactccttagccctgctggccaacacttgagtctctgacttaggccacagatgttacaatgcttacagtggccgtttacaacagttaacaaagcaggctttagaaccaagtccagccttgggcatgccggacctttaccatgcaaagttttacctcttttccagatcccttaggtcacttgtaagaatcaaattgaaaatatacctactctcaaataatttaagttttaaaactgacttctggctgggtgtggtggctcacgcctgcaatcccagcaatttgggatgccaaggtaggcagatcacttgaggtcaggagatcgagaccagcctgaccaacatggtgaaaccccgtctctactaaaaatacaaaaagtggccaggcacggtggctcacgcctgtaatcccagcactttgggaggtggaggcagctagatcacaaggtcaggagatcgagaacatcttggccaacacggtgaaaccccgtctctaccaaaaatacaaaaattagctgggcatggtggcgcacatctgtaatcccagctactcaggaggctgaggtaggagaatcgcttgaacccaggaggcagaggttgcagtgagccgacatcacgcgactgcactccagcctgggcgatgagagcgaaactccgtcttaaaaaaacaaacaaacaaaaaaacacacacaaattagcctggcatggtggcgtgcgcctgtaatcccagctactcaggaggctgaggcagaagaactgcttgaactcgggaggaggaggttgcagtgagccaagatcgcaccactgcacttcagcctgggcaacagagcgagtctccaaaaaaaaaaaaaaaaactacacataaaaaacaaacccaacaacccagcctgagcaaaacggtgagacctcatctctatttcagaatttttaaaaaatttttaaaaacctgacttttgtagatttcccttgaaactactggatcacgtatccaaagttttaggtaaagtttcagttcatgatgtacttccctaccaggtcaatccttacaatacggattataatcagccttcacggtaaacaagcacggcttcatttggaaagcacattttcaactgttttaaaaaatcgcagtgcttttggtaagagagccaaggcacttccctaaaaggagaaaagtagttacggaatccctgtgcatttcctcacctattcatcagcttcccagctggggcacatcagacactggctgcaggacaaccctgcagctgttgagctcctgcccaccagtcttcataaactcacttttggtccaaatttcacttacgactctaccagcaaagctgcctcttcaaaaggtttaatggcttacagagggcaaagggcacctggatgactgaacaacacaaaaggcaagattctaaaactcagaacccaccaggagaacagaaaaaatacagttttttctaagtggttatggtgactgcagactcagtgccaaaatgaaaaagacacagtccaaagaagtgaaactccacaatctctgatctgttagattggggctagttgaacagtcatttaaatctaatagtcatttgtatacaatgtaagacatggatacaatatgcagtgctagcctgtattttcctatttgaatatcccacataaattactacagataggataaaaaagacacatatctatttaaatgacttcctagtttccattccaaaagcagaagatatgtacttaagcagcacatgctacagtgtcttctctttcaaactatctgttcctagcctctagggattttgttttgttatgtttcattccactgcctaagaaactaagattttgccagcaagagggccaatatgacaaatcatcgatgattcttagcatggagccaagaagcctgcctccttgatcagattttcagctggaaagatatccacaccttgcctagtccaatatttgttaagtgagaatataaaattcaaagatgttctgtcacactctagatttgtattaatgtccacaaatattaaagattcacatgatacatatttaggaaacacatgctactttgttactgtttgaactctcaggaaacaatgttcccattggtgctccgaattgttactattctctgccatcctgaagataactaatacgtacctatctgtgttcaatctcagctttagattatggcactggtgtgtgagaaacaactggttcaactaactataagcaatatattaactctgcttttttttttttttttttgagacggagtctcactctgttgcccaggctggagtgcagtggcacagtctcagctcaccgcgacctccacccccggggttcaattctcccagatactcctgcctcagcctcctgagtagctgggattacaggcgcccaccaccccacccagctaatttttgtatttttagtagagacagggtttcaccatgttggtcaggctggtctctaactcctgacctcgtgatctgcccgcctcagcctcccaaagtcctgggattataggcgtgagccaccgcgcccagcccaactctgcttttacaggtattggctctcattccctagccattggttctccccttcctgtaattcaggcctgcaatataatttcttagtcccccaaggaaaacagaactaaagacttctaacagaagatctcagtctactaacatagctaatagctattaaagctactcaggcatcggcttaataaaaaactaaagggctgcagcaagtgatcagattttcaccactcatctttgtgagatgggtctcagagggccccgtccctgctgacaccaaccattcttaccggtagcctgccaacacacaagcagttcacagtagaacactgcagactgcagggcattttcaggctacatagcctcaagttcctagaacaggaactgaggcttggaagaaggtcagtgcagcgcactcagcgaatggataaactgaatcatcatttcacaaggctgcaagcccatgtactaatggaatcaacatggaaccagagttaaattactgccttaaatatctaatgcatgtcaagaaatccatctaattactaagtaccgaaattataatactttcaaatgaattcacaaagcaaaacagctgaactaatgatctgtaaggatctcctggcagataaatcctactgggaatcaatacaccactgctaccaagaaagcaggtccaacaaatgaataaaagaaacccagccaggcagagaggttcttgtctgtaatcccagcactttgggaggctgaggcaggaggatcgcccgcggccaggagtttgagacaagcctgggcaacacagcaaagccttaaaaaaaatcacctaggctcggtggcctatgcctttactcctaacactctgggaggctgaggtgggaagatcacttgagctcaggattttgagtctgcagtgaactacgatcagaccactgaactcgagcctgggagcaggccgagaccctgagaccctgtctcaaaaagtaaaaaacagaaatgccagtttcctttactcagagctaaaagccttcacctactacccaatcccatcatggctccctcccaaaagttcactggcataccatatcaagtcagcaagcccccttttttgtagcagggtctcactctgttgccaaggctggaacaagccctcttcaacaaagctaagatggtccatattactcatgtggatgagggtgttgaaggacatttactgccttccttcatggtctcacttcatgatcaaaccaagatgcacaggaaataggtttgacaatttacctttaccaagaaagacgattcagcaacagtggtagagctgcctgtttgaacttaaccttggtcatctcagtttgaaatacaaatggcagcatggagagcaggctgcccgctttttggttggacatttctttcactcttgagtttgaggtacagcaaatttcccaaatcattcagatgtaaatattccaatactcagaccaggggcccattcaggaggctgagtgcaggaagatggcctgagctcaggagttcgataccagcttgggcaacacagcaagactgtcttgagaaaaagaattctaaacaaaataaatacaagaattcaaaacaaaattcatgaaagatataggaagggtgagggaagaagtccaacattttatcacccaccagctaccaagtatctaacagcacaatgtcctagctctgcggtgctcttgaaagaaaaagtgaaaaccctgacaagggagccatctggatttgtattcctcaccatttaccatgactagaatgcttaggagtgtgcccttcagaaactgagcttttcaggcagaaaattagttttctctccagaccatataggaatgcctaaaaaagttatgccaaaatgtaaaaagaagagtcaagccaaggacccccatttttaaacttaagtgttggctgcccctcaaactgcaacttactcctcctggggtactatggtttgcctttaggcagcatgtgaaggtgtgaagatctcttttaggagatcttgtcagagtacctcaatggccaatcagaaaacaggtattaagggtgaagaagccactttttggaaagttagatcatgcagagaaacttaatttacactttaatagccgtttctcactattgggatcattaaaagttagactgtttccttaaatactatttaacttcactacacactgttgtgaccacgggctatttaagacattcagggtactaacctatagatctgttctcacctaatttgctcgagcatcaagaccctgataataaagacagaaaaatgctgaaacagcagaattttaaaccaagttcccctctgcagcacaagaaactcaggtaagtttccagtgtccaaagcctacactcacaaacacaaacacgaagccctccctttgcaaccctcaagtacccagaacctgctgaagaaaaccatctttcaccaccttttgttaaggttcctcagtattagtggaaaagctttattctcacaaagatatccaacaatgctaatttttacatggcatgttatttccttaggcaagattaatagaaaacctgaaaaattcgcaacaagcacacaaagactagcttctgtaacacaacctgaccccacccatatcacaccattttagaaggaagtccgtttaaaccagtgattctcaaacaggcaattttgacttcttatcaccatgggaggggaggaggccgcgtcctagcagaggccaaaaacagttgcttcacatcctacaacccagagggcactcctcaacaaaagtgatcaggctaaaatgtcaacagtgctccccaggttgagaaactgaattttaaactcaacctctagtttagatgaccactaggtctcaccgaatgaggagtttacagctcagaaacaaatctagaaaacttaacagccttggccaagcacaatggctcatgcctgtaatcccggcatgttgaactggatggtgaaaccccatctctaccaaaaaatacaaaaattaggtgggcatgctggtgtgtgcctgtagccccagctactcaggaggctgaggtgggggtgatcacctgagctccccaggtcgaggctgcagtgagttgtgatcgtgacactgcactcccgcctgggtgacagagccagaccctgtctcaaaaaaaaaaaaaaaaaagcctcttggccatttctacctatggccaaaataatgtgaacagataatgaccttttagagtattcacaaatggggatcttaagacaccgagtacaagttactgaactagaactaaggcgtgggaagcttgatacgtcatacttcctcaacttagaaaatagttgcaagggtagcataaagcttcagtccacaaagtttgtaagtttggacttgctatggtattggtcaaagttcaggattgttcctatactaaccaactgcactccattctagctaatggagaacaaaaatacccctagaggcagcttccacaccagttaaacacgaaaccagagcagcagtacttagtctacaaacactcctgagtaggtaagaggacagatatcattcaccaaagtccctgtaaccaagcagtaagttaaggccaagttgttactgtcaaggaaggagaaccccctagttaaaaatagcactaggctgcgaaggtcgagttcaaataccagcctggccaacatggtgaaacccggtctccacaaaaatacaaaaattagccgggcatggcggtgagcgactgtaatcccagctacttgagaggctgaggcaggagaatcgcttgaacccagaaagcggaagttgcagtgagctgagatcgagccattgcgctccagcctggacgacagagcgagactccgtctcaaaaaaaaaaaaaaaatcaaaaaccagtaaatagaggaccagttaggaaccaaattaaccatgcatctcttcccctgaactattttctgaggaagaaggcaaaccccaacaccctcggctaaagaatgtaacaaaatgccagtgtctggctaccagacacgactgacacagtattccctttcagttttgctgaattggccaaaatgagtattgggctagaattcaaaatcctgaagaatcaagtatgtccccctaccttagtgagtcttaattaactccatccttagggagaattccaaaccaaagtaaattatcaggagggcatttaaacaatttaagtaacacacatttcaggtaacacacaaaacatttcagttgactaccgaaattgtattatggcaaaaagttgcccaagacttagtttcccattatttcatacttgccccaaactccctttcagttaaccataacaccatctaggccagaccacagcaggttatcagcatcagcagagatcagaaaacaaaaataaagccacgcgtcagggtaattatttatttttattgtctctttattcctgtaatgtaaaaaggaaaacaatgtcatgtaactctcttcgctacagatacggacagtttctgtagcctctaaaacaggcaggaaatggccttcataaccattctccaattttgctggaggatcagggtggtggaagtcattttaaaaaccagctgcaatatactgtactaccagagagtggggtgaagcaattgagtccttttacctagctgactccgaatcaagacagctaaaagaatgtaccagaaagaaagaaaaaataaaatgctaccaaaatcccaatccattatctaccctttatggagaaaagtacctttataatgttttacaaagaatcgtggtctcaagtttccactttgttttagtaataaagaactttcaaaaaaaaaaccactctaaacaacaccctcctgtatagaaagctctattttaataattaatgcaatgatacccttgttggaacaatccagccgctttgaaactctggtatttacttactagatgaacaagtttctctatggaggtgcctttaacttctcaagaaatgtgtaagttaagacggctccaaattacattttaagagagccttgtatttttagaggttctttttcatcggtcagaaaaacttacgttgacgattctgcaagaaaggttgctcgcaaaccatgcatcgcaaagctaccgaggcaaatttaaagaaccaatgaaaaagagtggaggctcgtctgaatctttaattggctatgggaatttcaatttattgcataaataatcttttagacctcaagatacacgtgacctagggacagtttacatcaatgggcaagacttaaaaatagacaccaagttcagcaagtatttgagcacctactaaaaattacacaactcccacaacaacgcattttgcgtttctaaagttgtaagcagcatgttcggacgcttgatgcaatttcccaagttgtttgggccccccccccaaaaaagtcttctcagtaaaaggtggggggaaggagggtattttgggggcaacaaaccaaactggtctgtcgcatgttaagtcaatttcacgttcacctactggtcaccacgaagccgaggaaagttttaaaaagaacattccggggtctccagagatcatctctccaagtccgctcggcaccggcgcctgagctggggctaaggtcccgcgtctctggttctgtcctaatagaatccgggacatccacagggattccccggggcagccttcagtgaagaccagggagaggggccgcccgggtctcacgggtgcttcccgcgctggggatggcggcgagcagccacggcctatggacgcgcaagggaaagaatgcagcgaccccggagctcgcagggccgcccgcccaggagtctgaggctgggaggacctcaccttgctgcggtcctcctcctgctgctgcagcaactcgggaaccgcggccatggcgacgcgggactcgagcaggggccgcctggctgtgcgaggaaagaagaagctgggccgccgccgccgccgcctgggcgcctctc

SEQ ID NO: 416 - DNA, 27247 bp, Homo sapiens
  source 1..27247: mol_type = genomic DNA
ttagtagcacgattattttattatatgctttataaaaaaacaaacacccaaagacatacaacacaccgccctcaccccccagcggccattagggagggggcttatacttttcctaatgtagatctggccatcttataaagcagaccacattatttgtttccatatatacctgtagatatttctctcccctcaaatatttatatctcgactaaaaaaaggaggtgcaaagagtatataaagataaatgagattttcttgctgttgttatagtacaaacaccagatgactaccagtggagtaacagggcaaaacaaaaacacaaaccccaccttcagtgaggaatggaaggtctgttaccgacctcaagtagctgaatcacctgctgtaactggcacctccctgacaatcatgggtttgtagggacatgggccaggtgatggcttctacttgtttccagaaggctaatgtgtcctacaccctttcttagtaactaaagacgaactacgggagaacccagtatttggattctgcccagaggtattaaatgcacaaggaaaaattagttatgtccaagtagcaagcaataatatttttaaaccaacatggttaaatgttaagatttgtagaaatcaaaatatttattcacataattttaaactaaagttgaagctaatatatcttccgtggtaatgatttaagtgcaagtgatgcttggctttctttcacattcatttcttttcttctgagtgaaggcatatcagttattcttgaacaagtcaatacagctctgcaaaagggagacattgttctgtggggaaaaaaggcaaggcagaccagtgaattattaaaacttgccatatacctggaatgactcaagtacaccaacacggcttttcacgggaggtttaaagtcagccagagcaagctggcccttctcttcatcaaatcccaggtgaactgcaacgtaccacgcatccccatttcatgtttcagctcctctccctcagtgggtaaggctaccagccaaagagccgacgttcactccagcacctctgccctcacctgcttgctcctaaatgtgatcctgcttactgtaacttcttaagacactatcagtgcgttgttccatgaaggcaagggccttggaaagattgaataaaagttgctagaaattagggctgggagctttagctcacacctgtaatcccagcactttgggaggccaaggcaggtggatcacctgaggtcaggggttcaagtccagcctggccaaaatggtgaaaccccatctctattaaaaaaaaaaaaaaaaagttgctaaaaattagtcatgggtgacattataaacaagactacaaataaacaatgagtggctcccatcaactaagtactacagacgattaataccacaaggccaccccaactgcctgatgacaatgggttagtaaactgggaaataacttggaaaaaaccataaaagatgttggcttcatctgtagaaaacacttaccctggcatgttttatttccagttcagacatttcaattagattctttctaaatgctgccactctcttccgtttgaaatttatcagttctacaggaagaaaaaatgtttatgaaaccaagaaaaactaaacaattttcatgttcactttaactaccaaatggcattcttacaaatggtctccaatgctttcaggcaccagcattatttcctcacatttgtattatctctgtgactgggacacatcagacatctattaactgtggtgatacagctatcactgtctttaagtggaaaacatcactgaatcaccaagcatcgtgagtgggagagcagcagcttatgacttggagaacacgttgatgagcagcctcactctcaccctctaggtaccagtgactgggaacagggctggagtatgggtggtggtgagccacatacttcaccaatggcttgtgaaaatgcttctcaaaagaagacataccaggttcatgcaaacaacgttcagcagcactagccattagggaaatgcaaattaaaaccacaatgagattacctcacacctgctagaatgcattttctcaaatagatgaaagatcagtgttagcaacaatgcagagaaaagtgaactcttctacaccgttgctgggaatgtaaattagtacagccaccatggaaaatggtatagaggttcctcaaaaaactaaaaatagaattaccatatgatccagcaaacccacttctgggaatataaaaggaactgaaatcagtatctcaatgggatatccgtacttccatgttcactgcagcattatttacaatagccaaaatacaaaatcaattgagaattatccatcagtggatgaagacaatgtagtatagatacattatactatccggccttttaaaataacaaaattctctcatatgggacaatgtggatggatcttagaggacattatgccaaataaaataaaccaggcacagaaagacaaacattacatgatctcacttacaggtaaaatcttaagttgaactcctagaagtagagaacagaatgatggttatcagaggatgagggtggggtgctggggaaggtgggaaagagaatgggtagaaggctgcagctaaactcaaggaataaattttgagatctactgcacaacagggtgactacagtcaataatatatattgaaacagcaaatttcaaatgtattaccactgaaaaaaatgaaagatgttaattagcttgatctaataatttcacattatgtacctgcaaagcatcacactgtattccacaaatgcaatacaatgacttgtcgattaaaaataaaacttaaaacatttttaaatccaaaacagtgaaaaactgctacacgtattcaagacaggtttacttgatgatctttagggcatgcttccttttcatctactcctttttctttttttttcttgagacggaatcttgctctgttgcccaggctggagtgcagtggcgggatctcggctcactgcaagctctgactcctgggttcacgccattctcctgcctcagcctcccgagtagctgggactacaggcgcccgccaccacacccggctaattttttgtatttttagtagagacggggtttccctgtgttagccaggatggtctcgatctcctgacctcgtgatccgcccgcctcagcctcccaaagtgctgggattacaggcgtgagccactgcacccagccctttttcatttcatctactcctattgccatcagaattcggcattaatgacccattggaaattggaacaaaccaagaatatgcatgtccgccctaattccttcattgaatttgtgacatcaagttctgtcttgcagttttacttgactaaaactttgaccatcacccaaccttctgctggtgctcaagtgttcagagcagactcaccctccttcctgtctctacagtgctgtgcaaaagaactacaatacaagcagccacatccaagttaaaaagtcacaaatttcatagtgatatgtcaagtctatagtgcttgcactacaaggtgatgtttatcagtcccttggatatcctgggtgaagataagctccctgccttcctctagacctacacacagtaccagggctccatacacttaactattcacctcctgtgaaaccagcccttacccactgactcaactctagtcgtcagctcagctgcaagtctcagaaagcacttataccaaaggcaaacaggttaagacccaccaatctcagcattccacagaatactgtatttttagatagtgtacctatctggcattttgaatataggatataatcaatgtgggcgaaaactttaggcagtaaaggtagacctgaattggcatcattttttaaagttttatgttttttcttcaatctcctctaaaatttccagagccatgaaactggcctataagatttcaactcagtagttttgaagtgtgtacgtttccttgaaaattttagttttaaaaaaaaaaaaaaagctgtaattgtttcagaaacagggtagcatgaaggttactttggaagaacccaacacagcctcagagcctgtctacatgacatttgccaggaagctctgtgcctttgtgccttacagttaaggcattgtattataatcctgaatagacagacaaatgattagaaatctataaagtctaggtttcccccaggtagcttcaaacatgttgatgaacacatcatttccctatgtctagattaccctaccactgggaaacaagaaagttaggaaaaaactaagtaagatatgaatttttcatggaaacacgcgttagggggttgggattgagtccaacagtgccccactacaactactcacattctgggtaatccattccaacatttgctctgacatgttccatggcccctgagaaccccagagaagatccacagaatcctcttaggtaaggactacatattatactcatgttcaatagaaatggtgaaagtcctctgctctaagaggtgaaatggataaggcaagaaagaaccctatggatgtggacatggaccggacttgtgatccctgaaacctgcatgtgtgtgcaacggcatatgtgtgcacacacacatacatttcctagctcagtccactgaagggcacagaagcagagataccccgaaacgatgagcatactcagatgctggtaactgttcccaaagaaaaagaaccctggctccttgaaaaaatggccagtttcaaggctggagcagagagtaagattagcatggcctatcactctaaaaaagacgggttaggctgttacaaccacatgccagcttaaaggtgctcctattggcaaagtctggacaggcatcaaaaataacttggtaatacaataatgaattctaaaccattttaaaaactgggagtccatgactctaataaagataaaggaaatttctgagaaaagggaaggcttttttgtagtaggatgacaagtgccaacttgggtaggaaagctagagctagagatgagggaaatcgtctttctgcaatcgtcagagtaacagctggtttaggcaagaatcattaatacatgctaaacctagggaggaagtttgatgaagaccaaggtatttgcatggtcttaaattgcctcaccacagattgatgggggttaaaatagtaactacacagtggagaaactggatttggatactatctaattgagtaatcaaaattaccaccacgaatgaaggagagacacactgtccaatcagaagtgacaccccaataagggcatattacttctattctgccaggagcccataaccagatctaaacatgaggaaacctaccaaaagtcagaaatacaggatttgtaaagagattctctaaaaagactgatactgttaaaaactaagaactattccagagtaaaggagactaatagctaagacaaccagatgcaatcctagactggatcttgtagaggacatcaagacaaacatgaaaatacagagagcagattgtagacccaaagttaagtttatcacagcaaacaaccatactgtaaccatacaagagaatgtcttcagtcttaggaaataaaccacaacgtttttagggctaaaagaagcatgacatatgcaacttaatctccaatggtacagaaaaaccaggtgtgtaacgtttgtaagcacgcaaagccatgaggatgactgtgcatgtgcaagtgataaggcagaggggtgaagtgctgacactgggtgaaggatacatgggtgttttttgcactatttgtagaacttttctaagtttgaaattattttcaaattacagtacagaaagaagaatgtcctgctcaaccttcttttgcagattcggaaagttgttcaaatttctggcagcactcctgctggtgtgcctcagccaacttgacgtctttgctctttaaccgggccttatccagagctttgtttgagttctcatagtcaatgagggctttggtgcgtctgtataagagatcctgggaaaaaaattaacaggtatacatactaagtatctaaaccagtctaaaaaatagcccaagtgccaatgtaccacctgagatgttagtggcaataatctacctctacaccttccctctcccagagtatttttaaatctccagcttcgcagggatgagcaatgctgatagctttgttgagagctttttttagaattccttatatgaatcaagtgattactcaagagtgaaaacagaaggacttttgttttccagtaattcagtaaataaagttaactttaaaaattaaatattgtgtatcagagataacttgaaatatacagtcactgctgggtaagtcaagttgagcgctgctaaaatacaactgggcaatgaagtagtaagaaacataaccctaccctgcaaatcctgcttctggtaatctaccttggagatccacttagtcagatataaagattctttgcaatcttacaacagagtagaagttactttagtatctgaaatgagcaattatgatgtatagattacacatttaaaactaggtgaaataataactgatgggtgaaactactaggcctatttttgtatatactcaaataatcgtaagtgagctcttaattccatgaaagtagaaaataggctattaaaaaagtatgtttttaaaaactcccaagattcagaaaacatgccaaagggcaaattaactaaaataaaattgcatgatggggggaaaaattttttttactcttttactttctgatgacatttcagccttagagggcatacaatcctatctaattttattttgcctgatttaatacatttcacataaaattaaaacatatttgttcagggcaatgcagacaaagcatgtttcattcccaaaggttattctgcttaccattttgtccacatatacatataacgcttcacggctcaaaggctgcagggatacttgcaattcaataaaaactcccaaatcttctttgccccagaaacagccctttctgcatgttatgtcccacatcaatgacctataatcccccaaactattacctgtctacttcacacaacccatacagtgctgtcagatacacaagctttatggatacaatgccagaaaggcatgtcatttataaaaacaagtctgataaattcttattctgctcctttgtataaagaaactttttaaacagacttctggtcctgcactgctctgagaagctgagcaactctcttcctaccttagcagcttcaatgttgagcatgtagtatcggaggagctctgttagcttcaaatcttcatctgatgaaactcgaccctctactttctatatagaaaaggaaaggtcaccatcaaggcagaaagctatagattataaaatatatattatgaagaccaacacagaaatccttacccttagtttttcaaatagctcagcaaccttcaataggtacctggaaatgtacatataattttggtttaaggtcttaaatcatctataaaacatgatcttaccagtgtgcaagacaggaatgggtcaactcaggagtcctagcctttggtactttagcattaatttaaaagtagtgctctcacttcaactgaccccaaatagtagagaaaatggtcacaaaattacacacatgtacagcaccacactcagcctcttggtgacccttcggtcatcctgccatgcgcccaaatattcttattaaatgccaatgctgtgtaaaccaaggttggtttctaatgagctatgctatgggcatcacaaagcagtaaatatgctatttaattcgtcatggttctgccattagcctttcaatttcgagtcagaagtagtatcacctgttttgccaagcctggatgttaagtaaaatattgtcttacaccagaaatgcccaggatggagaaactgaaacacatacataagtgcagagtgaaaatggaagggtttttaattaatgaatgaaggtaatttcagaaaattgtacatcaaaacagctgtgtgttagactggggtcattaaattattctcatgaccactataaccaaatctcttcaaggtccagggcaggggcacatgttctcaggatctcctgaggctgcatcacaggccaaaaaaaaagaaggtctagggcattaccaggcaaaattgcaagcaccaattgccaggggaagatgcaagataaactcttacaaactccaaaactaaagaaaacaggcttttaagtgtgacagaaactactgctttgacaacatttactgtatttgtttacatatagaagagcccaagtcccctacaattgtcttacaagtgtcttatgtccagagaacatgtaagatgagtgctagagacttgtcttactgagcttgtaactccagagcaggaccatgtagtcactactcatttatgcttttaattacaccactcggcactcttcaattgggttaggggaaatgcttttccaaaaaaacttactttttgatgactgtgggctcttctaaagccaggctatgtaagcaggctgcggtgtggatatagtcatcggcaacatctgcagaaacaaggacaagtctttttatccaaacacagccaggctcatcagcaaagctctgactagcggtaaatgatatttacttttatgagatctggtcattttgtcagctttcacacaagaatctttgatcctattgtaatagttaataaggaagttcttctcttgctcaaagaagtcatctacctcctagaaggaagaaaaaaagaaccagacatttcatgaaatatactatccctgcagccttttacatttatcaatataaaaatatattgcttagaacatggcatataaacgtgagtaaagtttaacctctacagatcagggaattacaaatttacgatactatttcttaaccaaggctgggaaaaatcaagggctggcagaaaatgtctacagaagaatcacttaacaaccaccagtaaaactggcaccctaagacacagcaattttacgctagtacaatggttctaccaggtggaacatggccacttagccttggatacctatctgtgtgtgaatgaggtttttttttctcgattggtttcagactgggaggaaatcctggtatctggtaggcattggccaaggatgccaatgccaaatatcccataatgcatggatacaggacagtcccatacaccttaaactggaccaagtccgagtttcctaatttctgatgatgccctctctacttagcacctgtattctgggctccctggagtggcaaagccagataccagacagtaattgtaagggtaactcagttacaaaggaatgagaaggcccgagaagtagtaaagtaaatcatacctctaacggtaacggaaacgttattttgtattcttgtctttgtgctaacgccttgaaatccagtatgtaaataaaatctaaagtttggttccttagttgtgccagctaggttgcatgtcaagtgcttctctatcacctgtagttggtgaccaaactggacagtgtagttctgagagtgggataaaatactgatcttgtactttattttagaaattaactgagtaatctccctccttacagaaaaggagaaaatgaagccaagtgtggaaaggttcaagttgcttctcctgggacagaacaaggtgctctgggaaataagtgaaaattgaataagtagatgaaaattaccaaaatctgaagaacacttacatgtcttaaaagttaaccatttgtttcacaagtatctctttcaaagaaacaaaaggtcacctattcccgatgaagtaaaaaattttctccaacagccaaaggtcacttaccttaactccagtaaaaaggacttcatcagcacttttcaccacacttttgaagaagccaccaaacatctctttagtatttttccgcctaacacttagctaaaagaagaaaattccaaagagtttatatggtatggatttttctagattctcttaaagaagttctgagtaacattttaagtaatcctctttatcagtacaggcaaatgcataaagtatctttaattctgccttaacctccaagcttaaaacacctaatggctaaacccaaacataggtaggtcatctcattctaaaaggcttgacagattttgaaagactgactagaagctaagtcttagtggctctgaaatccttgggaaaattactgttctcttctatccatattaagtagcaaaaaccaaaacatgttaaaaagaaaaatagcataaaagtcataattcgcggccgggcgcagtggctcacgcctgtaatcccagcactttgggaggccaaggcgggcggatcacgaggtcaggagatcgagaccatcttggctaacgcggtgaaaccccatctctactaaaaatacaaaaaataagccgggtgtggtggtgggcacctgtaatcctagctactcgggaggctgaggcaggagaatggcgtgaacccagaaggtggagcttgcagtaagccgagatcgcgccactgcactccagcctggatgacagagcgagattctgcctcaaaaaagaaaagaaaaaagtcataattcaacaaaaagcgtaggtgggaagaaaataaattacacaaattttaatttccttaaaatgaacttagttaagtttggaattgttaagaaattaactaagggatgtttgggactgttaatttcttaaaaagaaacctaggttttggaaggggaaagaagtcaaaattttctttaagcagagttttacaaaaaatgacttacaatgaaggaaaagcagcatctaaaaaggtttccattgtgtaagaaattcaaaactttaaagcagtagaaactatcaagtacattttgaaagtataaacatttgaagtggattatcaaaatggaataaaaatgccttacatcctgatcatattccaggaaaacatgaaagttgcgatctttactgagaacagggtgagaagaaagccgctgaagaaagacttcatgggaggacacagtcttcttaaacacagcgagatactcactgaaaagagatgtgcacatggcattcagttgacacagctcaactacctgaccaataccactcctgattaattctatggccctgctcatgccaccacataaaacactgcaactggaccaaacagtatttcagtataaactggtgtctagttagatactaaggcagttgccatttttgaatctgtggaataagactatggaggaaagcaatgttgtaactggatttgatgggtcaagtccatgagctcctaaatctacatgcaattactgttacttagtagccacagaacatttgtttctttaaagcaatgagaaccctttaactgcagcctaagtatacagcatgagtctaatgaagctaaaagttaacaaaaattacaaagcagctttatctcaacctagacattaaaagtcaccttaaaattcctaacggtagaaacttggatctgttgtgttcagtgcctcattccccagagctggtcccgagagccactcaagtgtgtgctaaatgctttcagggcctggaggtttgagtgctgccctagatgacacaggggtttggagagggggagctgatggttgaagaggggaggaatgagtacttttcagctaagatgaggaaatgcaaggatggattcataagaaactttccaaaaatctatttttgtttgaaaaaattaaatgacaaccagattaaaatatacttgctgcctgtagacctggacttcctctttcaaattatctatgtgatggttactgagaatgctactctataacagcactatttggcctggcccaggggcagctcactataatctcagcactatgggaggcaaaagcaagctgatcacttgaactcaggagttcgagaccagccggggcaacacatgacgaaacccccaactctctagtttcttctcaacgtctagtaaccaagcttccgaaagaaaagctttgtacattatgagcaatttataaaggcacaaaagtttatttcctcactgtgccagaccagcatccttaataagtatgccctacatatgggaaaagacaactactctatcgggtattagtgtcaatggcctccaatgaatcaatgtgtgaagtacaaagaccatgtcccacactatgcaagatgtattactagttttagaaaacgacgctagggacctaattaaacagctgcacttaaaacaaaattaagtcaggttcttctacttatttttgtacacagcaccacttttctacttctcaaaagacagagcccaccaggaaaatccacttacgcttccagttcttgtttcatcttggcaaattcttctttggtcatagacccttcaccttctcccagtttctgcatcttctctcgaggaccatcaaagtcgggcttcgtaggagcaggtggaatctgcagcagaggcaggaactcatgagcctcttgtcccagcagcgatgttttctagttggtgcctcattctactcttgctggtccacaggagacaaccactccactcctgtggggctatttaaaagtcaactcctgttttttcttaaccttccttaactcttctggacatttaaaatgaggtgtcttcctgagagttgcatattcactttgatggcaatcatttgttcagtttatccattatagacaattgttcagagcacaacagtgtctatactgcttcagtgttcgcctaaaactagtacaacgaatgctaagcaccaaagatgagccatcaagattataaagtgttcagtattccaaaggaattttttcctaatcccaaaggataatcaaggactctaattttgaatgaaagacatatctaaatataagcttcggtattaattttgtttaatgattaagcaatcatcatttggagagcttcttcagtctgcctggcaggacaaaacgcgtggaaatctcctttaaaatcagttaagtctgttcctgccgccaagaaataacaatcaagggctgaaaactgcctccttgagcactttttttgtttttgggagaaagagtctcgctctgtcacccaggctggagtgacgtggcacggcctcggcttactgcaacctctgcctctcaagttcaagcgattctcatgcctcagcctccccagtggctgggactacaggtacgcaccaccacgcccagcaaattttttgtatttttagtagagacagggtctcatcatgttgcccaggcacgtcttaaaattctgagctcaggtgatccacccaccttggcctcccaaagtgctaggattaaaggcatggcctccttcagcaacttttgagaaatcttatcacaaactattaccaatagcagtgtttcctagaaatcaattctactgacataggaaaaaacataccagagaaaaaccaaacctaaaggtaggtaagactaaagtcattacactgttcacacccctttacaatgtaaataatgtaagcctgtatgcaccacctcaaagctgtaacactattccttcacatactttccacttgacagtcagcaaatactccagtaggtagatgaaatctaacttttcacaatccattaaaaaaagtggatataagtctcttttaaactaatgcatagcaaggcagaaagaactagcttatttgattttctaaaagactcacaataagcccagcatagtctgttgtttcaataagagtgtcatgtagccacacaaagtcttcatgttgccttgtaacagaaaactctgggctctgaaacgtgggcagtgtggtctgtaaagaaagaaagaagttaactggtaaccacgacttttagataagtgatctgggtttcctaggctacacagtgggaaaattctgcataatacatcataatatgatccagtaaagaacaaagcagttatacatgatctcctgtcatgaaagtcatagctaagattcaacctgaactctaacgatttctccccaaactccacctttctgaagcttgtaatgaatatcccatcagaatctactggtagaagttcagttctaagaaataagccacaaccctaattctatttttttgtttctgtgtacttttttttgtttatatacatttttgggacagggtctggctgtcacccaggctggagtgcagtggaatgatcttggcttcttggctcactgcaacctctgccttccaggctcttaagccatcctcccacctcagcctcctgagtagctggaactacaggtgtgtgctaccacatccggctaatttttatatttttggaagagacaggtttttgccatgttgcccaggctcaaacgatctgcccatcttgtcctcccgaagtgctaggattacaggtgtgagccacccaacccagccccaaattctatttttgtaagtctgaatttaccccccacccccaacttatgacaaagaagaaaaataaattttaaaaaaacctcttagctgtaacttactatggttctaaaaattgtccctggcttccttccttttcactccagtgaatgctgattttacctcctttgatctggtaagctcaggcagagaattatgtcaccagtctttttacactacctccggaataactgaagtgtgctattcaagccgcccaggcgttaagaaaaaaccacatgggaaaggtctttcccaatttagtaaatgctgaaaaaaagcaagctacagagacaaacttcccttggatgcaaattaaaaacaaagctggggcccggtgtggtggctctggctcacgccttgaatcccagcactttgggaagctgaggcacgtgcatcacctgaggtcaggagtttgagccgagtgtggtggctcaggcctgtaatcccagctactctggtggctgaggcaggagaattgcttgaacccgggaggcaggggctgcagtgagccaagatggtgccacttcattccagcctgggcaacacaatgagactgtctccaaaaaaaaaaaaaaaaaaaaaaaaaaaaaaacaaaaaaacaatgcccacagcccagggctctgccacagcagaatgctgctgccgccacaatggcactcacctgatgcttactgtgagatagattagggaggttctcacttaatagtgctaccctacgaatagcaactgtttcaagctcagggaatctcttctcacatccactgtgaataacaaggctgcaacctagcactgtatgtattaccactgcatgttacttacctttgtgtgcactgtaaatttgactttgtctctctcactgagcgcatcaggtatgtcaatctgaagcgagggatcaacattcaggtccacagatacagatctcagctgaaatacattttttgcgtattagtttcaaactcatttggccctaaaaaattattccaaaaatgagtagttactaaaaagcagtttatacatagatcatttagaaatgtcagttgagctgggcgcggcggctcacccctgtaatcccagcactttgggaggccaaggcgggtggttcacagggtcaggagatggagaccatcctggctaacatggtgaaaccccgtctctactaaaaatacaaaaaattagctaagcgtggtggcgggcacctgtagtcccagctacttgggaggctgaggcaggagaatggcctgaacactggaggcggagcttgcagtgagctgagatcacaccactgcactctagcctgggcgacagagcgaaactgtctcaaaaaaaaaaaaaaagaattaaaaattaaaaaaaagaaaaagaaatgtcagttgagacatttctaagtttatgtgaaactgaggggaaacccattcttcacatgcattggtatatccgaagtattcctgtaatgtaaacaacagctacaataatgtcatgtacaatacatttggccaaatacctgactgtacactaaggcctgaactaaatagaacaaaatcttgaattcttacataaatgccaaagtacaatgaacattcaagaggcattaaccaggccacacaaatatctgaaaggaaaacctggggagatggcacagagaacagtcatgtggaataggatcctgggtggagagttcagagtaaacctgggactgtttcaaatagccaaggaatctagacaggaggggtgaattagaaaaaccaaccaaggccttacttaattagcacaatcccactgtggttacacatgagcaacaagtgtgagcatcactctgaatactcaattaactgattttctgagctggaaattgagaggaaaaaaactacctaactccatttctgcccgtcaaaaaaaaaaaaaaaaaaaagagaggagagaacagtggcagcactaataggaactgggctattagggaaaagtgacttaaataaaagtacattaaagcagacaaggtggtggtcaatctgaaaacctgacacacaaggcacgaggaactcatagcgtaagcatctcattgccccattccttttactgtaaggagtgctaaagtaaagttgtcataacactggattacccaaagcacggaatgccaagtgaagattacaattaagaagatgaggtatttcactccaaatttccctttgggtccctttcttcaaaataaaaagttcaagactaaaaacttatgtacttaacctctaaaacttgaaaatctggtcaatcagctataaaaagactaaatatattcactaaaagcacatggattacttaagtttcaagtactccctttttccttaagcactgtatatttataattctgaaagccagagggagcctattacaatggctttcctccaaaaaattaagctcaagtagtcaccagaagttgattttaacatcaactattagtaagatcaaaacagatacttttgagtcctcacatctcaacctaagtatttttcttccacatgaattcttgataactcctatgaaatatctgcttgtctggcttaattttcacatgtccatttgtgagatctctgcaaacaaagataaagcttcaaggtctgcgacttcatttgatcataactgactccagctttggcgtattttctgataagagcttccttccttctgctaagttaacactggcaaatacagcctttaaaaatacctcaaatcattaactgaatgtgattgcagaggctataccaacgactctactgatcttaggcttatctgtcaaggtcaggcaggcccaagaacaggaataaacagagccaggcctaagaagtagccatggtctctggaggagacataggacagctcacaggacaggtctaaggtgcctttcccagagctcaaaaactgccacatttcctaagattccatttcctaaagtcacaaaccctgacttctagcactgctcaaatgaatatgctgacagttccattttcgctcacaagcccagcaaactcagtgagcctgtgaactccacatgggatacccttggaattcgaataggaggacccaagggggatgtaatcaagtaaatggagctcatttgtgcaccacagttaaagctgcaatggatgctaccagctgctttagctgcttttcgttcctctgaataattatcttctcttttcgtccctttccccatgtagaggtaatacccccgactatacctgtcttcctttctggttagtatagaaacatattttttgtttcagaatgtgatgaagacaaaaagaagaaaaccactaggttatgagtgactgcaaccacagcatatcaaacatccgaggttcactagcagccattttgcccagacatttcgccctaggaagggattcaagcaaaactccaatcacttgacatgacagtcctaaccaccaaataagcaaataatgcaatgttgtatttgggccttaaagaactgtctaaaagagagtattggcaaaacccctcagcatccaggccatcattaactcaatgtcccccaggcgcaagttaaatgaactttctcatattatagcatataaccctccagatgagacaaacatgggtagaaacttgtgaaatgactagagcttctaagtcagcatttgtactctcactcgggaagcatcaagtgtgaccaaaagttcagcattccttctgcttagtcaacaaacccactccacagtgctacagaacttgctaaataattgccaggctccactcttcccctctcacttgcctctgcctccatccccccttaagcttgaagggctcagagtactccttagccctgctggccaacacttgagtctctgacttaggccacagatgttacaatgcttacagtggccgtttacaacagttaacaaagcaggctttagaaccaagtccagccttgggcatgccggacctttaccatgcaaagttttacctcttttccagatcccttaggtcacttgtaagaatcaaattgaaaatatacctactctcaaataatttaagttttaaaactgacttctggctgggtgtggtggctcacgcctgcaatcccagcaatttgggatgccaaggtaggcagatcacttgaggtcaggagatcgagaccagcctgaccaacatggtgaaaccccgtctctactaaaaatacaaaaagtggccaggcacggtggctcacgcctgtaatcccagcactttgggaggtggaggcagctagatcacaaggtcaggagatcgagaacatcttggccaacacggtgaaaccccgtctctaccaaaaatacaaaaattagctgggcatggtggcgcacatctgtaatcccagctactcaggaggctgaggtaggagaatcgcttgaacccaggaggcagaggttgcagtgagccgacatcacgcgactgcactccagcctgggcgatgagagcgaaactccgtcttaaaaaaacaaacaaacaaaaaaacacacacaaattagcctggcatggtggcgtgcgcctgtaatcccagctactcaggaggctgaggcagaagaactgcttgaactcgggaggaggaggttgcagtgagccaagatcgcaccactgcacttcagcctgggcaacagagcgagtctccaaaaaaaaaaaaaaaaactacacataaaaaacaaacccaacaacccagcctgagcaaaacggtgagacctcatctctatttcagaatttttaaaaaatttttaaaaacctgacttttgtagatttcccttgaaactactggatcacgtatccaaagttttaggtaaagtttcagttcatgatgtacttccctaccaggtcaatccttacaatacggattataatcagccttcacggtaaacaagcacggcttcatttggaaagcacattttcaactgttttaaaaaatcgcagtgcttttggtaagagagccaaggcacttccctaaaaggagaaaagtagttacggaatccctgtgcatttcctcacctattcatcagcttcccagctggggcacatcagacactggctgcaggacaaccctgcagctgttgagctcctgcccaccagtcttcataaactcacttttggtccaaatttcacttacgactctaccagcaaagctgcctcttcaaaaggtttaatggcttacagagggcaaagggcacctggatgactgaacaacacaaaaggcaagattctaaaactcagaacccaccaggagaacagaaaaaatacagttttttctaagtggttatggtgactgcagactcagtgccaaaatgaaaaagacacagtccaaagaagtgaaactccacaatctctgatctgttagattggggctagttgaacagtcatttaaatctaatagtcatttgtatacaatgtaagacatggatacaatatgcagtgctagcctgtattttcctatttgaatatcccacataaattactacagataggataaaaaagacacatatctatttaaatgacttcctagtttccattccaaaagcagaagatatgtacttaagcagcacatgctacagtgtcttctctttcaaactatctgttcctagcctctagggattttgttttgttatgtttcattccactgcctaagaaactaagattttgccagcaagagggccaatatgacaaatcatcgatgattcttagcatggagccaagaagcctgcctccttgatcagattttcagctggaaagatatccacaccttgcctagtccaatatttgttaagtgagaatataaaattcaaagatgttctgtcacactctagatttgtattaatgtccacaaatattaaagattcacatgatacatatttaggaaacacatgctactttgttactgtttgaactctcaggaaacaatgttcccattggtgctccgaattgttactattctctgccatcctgaagataactaatacgtacctatctgtgttcaatctcagctttagattatggcactggtgtgtgagaaacaactggttcaactaactataagcaatatattaactctgcttttttttttttttttttgagacggagtctcactctgttgcccaggctggagtgcagtggcacagtctcagctcaccgcgacctccacccccggggttcaattctcccagatactcctgcctcagcctcctgagtagctgggattacaggcgcccaccaccccacccagctaatttttgtatttttagtagagacagggtttcaccatgttggtcaggctggtctctaactcctgacctcgtgatctgcccgcctcagcctcccaaagtcctgggattataggcgtgagccaccgcgcccagcccaactctgcttttacaggtattggctctcattccctagccattggttctccccttcctgtaattcaggcctgcaatataatttcttagtcccccaaggaaaacagaactaaagacttctaacagaagatctcagtctactaacatagctaatagctattaaagctactcaggcatcggcttaataaaaaactaaagggctgcagcaagtgatcagattttcaccactcatctttgtgagatgggtctcagagggccccgtccctgctgacaccaaccattcttaccggtagcctgccaacacacaagcagttcacagtagaacactgcagactgcagggcattttcaggctacatagcctcaagttcctagaacaggaactgaggcttggaagaaggtcagtgcagcgcactcagcgaatggataaactgaatcatcatttcacaaggctgcaagcccatgtactaatggaatcaacatggaaccagagttaaattactgccttaaatatctaatgcatgtcaagaaatccatctaattactaagtaccgaaattataatactttcaaatgaattcacaaagcaaaacagctgaactaatgatctgtaaggatctcctggcagataaatcctactgggaatcaatacaccactgctaccaagaaagcaggtccaacaaatgaataaaagaaacccagccaggcagagaggttcttgtctgtaatcccagcactttgggaggctgaggcaggaggatcgcccgcggccaggagtttgagacaagcctgggcaacacagcaaagccttaaaaaaaatcacctaggctcggtggcctatgcctttactcctaacactctgggaggctgaggtgggaagatcacttgagctcaggattttgagtctgcagtgaactacgatcagaccactgaactcgagcctgggagcaggccgagaccctgagaccctgtctcaaaaagtaaaaaacagaaatgccagtttcctttactcagagctaaaagccttcacctactacccaatcccatcatggctccctcccaaaagttcactggcataccatatcaagtcagcaagcccccttttttgtagcagggtctcactctgttgccaaggctggaacaagccctcttcaacaaagctaagatggtccatattactcatgtggatgagggtgttgaaggacatttactgccttccttcatggtctcacttcatgatcaaaccaagatgcacaggaaataggtttgacaatttacctttaccaagaaagacgattcagcaacagtggtagagctgcctgtttgaacttaaccttggtcatctcagtttgaaatacaaatggcagcatggagagcaggctgcccgctttttggttggacatttctttcactcttgagtttgaggtacagcaaatttcccaaatcattcagatgtaaatattccaatactcagaccaggggcccattcaggaggctgagtgcaggaagatggcctgagctcaggagttcgataccagcttgggcaacacagcaagactgtcttgagaaaaagaattctaaacaaaataaatacaagaattcaaaacaaaattcatgaaagatataggaagggtgagggaagaagtccaacattttatcacccaccagctaccaagtatctaacagcacaatgtcctagctctgcggtgctcttgaaagaaaaagtgaaaaccctgacaagggagccatctggatttgtattcctcaccatttaccatgactagaatgcttaggagtgtgcccttcagaaactgagcttttcaggcagaaaattagttttctctccagaccatataggaatgcctaaaaaagttatgccaaaatgtaaaaagaagagtcaagccaaggacccccatttttaaacttaagtgttggctgcccctcaaactgcaacttactcctcctggggtactatggtttgcctttaggcagcatgtgaaggtgtgaagatctcttttaggagatcttgtcagagtacctcaatggccaatcagaaaacaggtattaagggtgaagaagccactttttggaaagttagatcatgcagagaaacttaatttacactttaatagccgtttctcactattgggatcattaaaagttagactgtttccttaaatactatttaacttcactacacactgttgtgaccacgggctatttaagacattcagggtactaacctatagatctgttctcacctaatttgctcgagcatcaagaccctgataataaagacagaaaaatgctgaaacagcagaattttaaaccaagttcccctctgcagcacaagaaactcaggtaagtttccagtgtccaaagcctacactcacaaacacaaacacgaagccctccctttgcaaccctcaagtacccagaacctgctgaagaaaaccatctttcaccaccttttgttaaggttcctcagtattagtggaaaagctttattctcacaaagatatccaacaatgctaatttttacatggcatgttatttccttaggcaagattaatagaaaacctgaaaaattcgcaacaagcacacaaagactagcttctgtaacacaacctgaccccacccatatcacaccattttagaaggaagtccgtttaaaccagtgattctcaaacaggcaattttgacttcttatcaccatgggaggggaggaggccgcgtcctagcagaggccaaaaacagttgcttcacatcctacaacccagagggcactcctcaacaaaagtgatcaggctaaaatgtcaacagtgctccccaggttgagaaactgaattttaaactcaacctctagtttagatgaccactaggtctcaccgaatgaggagtttacagctcagaaacaaatctagaaaacttaacagccttggccaagcacaatggctcatgcctgtaatcccggcatgttgaactggatggtgaaaccccatctctaccaaaaaatacaaaaattaggtgggcatgctggtgtgtgcctgtagccccagctactcaggaggctgaggtgggggtgatcacctgagctccccaggtcgaggctgcagtgagttgtgatcgtgacactgcactcccgcctgggtgacagagccagaccctgtctcaaaaaaaaaaaaaaaaaagcctcttggccatttctacctatggccaaaataatgtgaacagataatgaccttttagagtattcacaaatggggatcttaagacaccgagtacaagttactgaactagaactaaggcgtgggaagcttgatacgtcatacttcctcaacttagaaaatagttgcaagggtagcataaagcttcagtccacaaagtttgtaagtttggacttgctatggtattggtcaaagttcaggattgttcctatactaaccaactgcactccattctagctaatggagaacaaaaatacccctagaggcagcttccacaccagttaaacacgaaaccagagcagcagtacttagtctacaaacactcctgagtaggtaagaggacagatatcattcaccaaagtccctgtaaccaagcagtaagttaaggccaagttgttactgtcaaggaaggagaaccccctagttaaaaatagcactaggctgcgaaggtcgagttcaaataccagcctggccaacatggtgaaacccggtctccacaaaaatacaaaaattagccgggcatggcggtgagcgactgtaatcccagctacttgagaggctgaggcaggagaatcgcttgaacccagaaagcggaagttgcagtgagctgagatcgagccattgcgctccagcctggacgacagagcgagactccgtctcaaaaaaaaaaaaaaaatcaaaaaccagtaaatagaggaccagttaggaaccaaattaaccatgcatctcttcccctgaactattttctgaggaagaaggcaaaccccaacaccctcggctaaagaatgtaacaaaatgccagtgtctggctaccagacacgactgacacagtattccctttcagttttgctgaattggccaaaatgagtattgggctagaattcaaaatcctgaagaatcaagtatgtccccctaccttagtgagtcttaattaactccatccttagggagaattccaaaccaaagtaaattatcaggagggcatttaaacaatttaagtaacacacatttcaggtaacacacaaaacatttcagttgactaccgaaattgtattatggcaaaaagttgcccaagacttagtttcccattatttcatacttgccccaaactccctttcagttaaccataacaccatctaggccagaccacagcaggttatcagcatcagcagagatcagaaaacaaaaataaagccacgcgtcagggtaattatttatttttattgtctctttattcctgtaatgtaaaaaggaaaacaatgtcatgtaactctcttcgctacagatacggacagtttctgtagcctctaaaacaggcaggaaatggccttcataaccattctccaattttgctggaggatcagggtggtggaagtcattttaaaaaccagctgcaatatactgtactaccagagagtggggtgaagcaattgagtccttttacctagctgactccgaatcaagacagctaaaagaatgtaccagaaagaaagaaaaaataaaatgctaccaaaatcccaatccattatctaccctttatggagaaaagtacctttataatgttttacaaagaatcgtggtctcaagtttccactttgttttagtaataaagaactttcaaaaaaaaaaccactctaaacaacaccctcctgtatagaaagctctattttaataattaatgcaatgatacccttgttggaacaatccagccgctttgaaactctggtatttacttactagatgaacaagtttctctatggaggtgcctttaacttctcaagaaatgtgtaagttaagacggctccaaattacattttaagagagccttgtatttttagaggttctttttcatcggtcagaaaaacttacgttgacgattctgcaagaaaggttgctcgcaaaccatgcatcgcaaagctaccgaggcaaatttaaagaaccaatgaaaaagagtggaggctcgtctgaatctttaattggctatgggaatttcaatttattgcataaataatcttttagacctcaagatacacgtgacctagggacagtttacatcaatgggcaagacttaaaaatagacaccaagttcagcaagtatttgagcacctactaaaaattacacaactcccacaacaacgcattttgcgtttctaaagttgtaagcagcatgttcggacgcttgatgcaatttcccaagttgtttgggccccccccccaaaaaagtcttctcagtaaaaggtggggggaaggagggtattttgggggcaacaaaccaaactggtctgtcgcatgttaagtcaatttcacgttcacctactggtcaccacgaagccgaggaaagttttaaaaagaacattccggggtctccagagatcatctctccaagtccgctcggcaccggcgcctgagctggggctaaggtcccgcgtctctggttctgtcctaatagaatccgggacatccacagggattccccggggcagccttcagtgaagaccagggagaggggccgcccgggtctcacgggtgcttcccgcgctggggatggcggcgagcagccacggcctatggacgcgcaagggaaagaatgcagcgaccccggagctcgcagggccgcccgcccaggagtctgaggctgggaggacctcaccttgctgcggtcctcctcctgctgctgcagcaactcgggaaccgcggccatggcgacgcgggactcgagcaggggccgcctggctgtgcgaggaaagaagaagctgggccgccgccgccgccgcctgggcgcctctcgggggcggccacggccccgcctccgccggcctccctgcccgacggcggcaggaggcctccggactccgccaccatcccagctgccccgggagcaggcgagcagggcgccacgtgctcccccagagcagcctcccagtccccgctgccgtccatcttggagccgggcaaagacgccacgtggggcctacccttgctccgctccacgaggaggccgccaaccgcagggccgcgacacggacgggaagcaacggacactctcccagcaagacgcgtctagagaaagaccgcgtttcggtgcggggggaatttattactcagcccgagtccaagatggca

SEQ ID NO: 417 - DNA, 237 bp, Homo sapiens
  source 1..237: mol_type = genomic DNA
gtgatcagattttcaccactcatctttgtgagatgggtctcagagggccccgtccctgctgacaccaaccattcttaccggtagcctgccaacacacaagcagttcacagtagaacactgcagactgcagggcattttcaggctacatagcctcaagttcctagaacaggaactgaggcttggaagaaggtcagtgcagcgcactcagcgaatggataaactgaatcatcatttcac

SEQ ID NO: 418 - DNA, 22001 bp, Homo sapiens
  source 1..22001: mol_type = genomic DNA
agcgaagtgtggtggcttccaaggtaccgacacttgccgtaggctgggcttttatttaagtcgtcttttctctaatccagactcctgccacaggggccaccgccgtcctggccccgccaggggtccgcacccacggcggagcgggaggcgactttttgcggtcacagtaatgggacctcagcgccgccaccagctctgaccggcgagcgacgggaccctccaacccgatttccacgtctgtgcaacgggttcattctagacccacggtagagggtgtgaggaccaaatgagaagtatccacacagaatacttagcagagagcctggtgtctaggaattagtcgtcgtctgtcacctaggactgtgtggccgccatgggacgggctccatctttgtgtttttccgtgtctcgcacacgcctcccttcctgggcgtcacattcctgcagattagaaactgggacgtcttgcctcaagctgtctactaattcgcatttagtatgtgtcggtccttcgggtattgagtcttgatttatttataaattttttttggaggcagggtctcgctctgtcgactttcttaagaaagggctctgtccaaacatgtcgaaaaagttcacaattttgatgtgcaatatcattctgatgcagctttcgctttgatggttgttttctctccaataggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaagtaattatctcaattctgattctatatgtttgctatgttttctataatagagagcaacggtgtcaaaagaatgaggtttggttttgtttttttaacttactagcaaggaactcccttcagatagtaattaacattaaatagcactttatgtgtattaactcacttgatcctcatggtagtcctgtggagtatagatactgttatccacattttacagatgaaactaaaatagatcaaatatttgactaaataatacataaaattcacttgttttataagctaccaacaatattagaattgcttgttttccttgattattgaaaaaagtcacctggtaacagaattctagttgtttgctagataattctgtttagaatccagtaaatacccactgtcctacttattagcgtaaactgactcgtaaatttaaagaccttgaagcagaccagaacacatgacctatatttagaccttggtaaacataatcagaggttcttcataaggatctgaggataaatacactttaaccttcaacttctaatttactaacttggacaagtgaggagaatagcttccttaaatttaatattccattcaaaaacaaagaccattggcactggtgaattagctagtcccataaattatataggggtcttttgttaaaggaaagtttcacatcaatcattcctttacccaagcttcccaaagtgcagtacatgtactcttagtagtacacaaactctttcatttttgttttaagaatagtgtactgacccttgccatagcctgggcttctatttaagtcgtcttttccctaatccagactcctaaaactatgcgtgtaacacattaaacatgtcacatgttctaaagaaaaatactaagtatatataggtggtattggatatgtaccaaatggtcaaggcctttgctccttataatattcctcagctgtgtggggcaaggattatatatgcaagagctaactgccttcctaagatagttaattagtagcaaccaccaaactattgtctgctttccaagcaagcaacataaaaatcttctaatggcatcttacagttttgtatttgtaccactaaaatttagaattgatagttttctcatgagaagttattttccttaaaccaggaatgtacagctgaaattactaataagaaatgtattattaaaaggcagaaacctgctggaacacatgggaccccagggcctgtagctcttggcacaaagtaaggaagtgcaccagagaggaatttctgtttggaatgtgaatgagccccaatagcccaggcagagagaagactggttgttttttttttcatagagtcagctttgttgatctagattagcactcagctgtgtttctcagttaactcagtagcaaccttaagaaatgagcagaatcgcttaccccagcaccccgcccagacttgaccgccgggacccaagtgattctcccatctcagcctgctgagtagctgggaccacaggcgtgcaccaccatgcctggctaatttttttattttttgtagcgacaagggtctccctatgttgcccaggctagtctccaactcctgtcttcaagtggtgctcccacctcggcctcccagaatactgagactacaggtgtgacccactgtgcccaggcagaatcactctttttagaaaataagtattagtaagcagtgggttctgaaataaataaagggacaattagtgtcatggtgaataaaagaaaaagggctcactaaattgattaacgggtctggaggatactggatcccaaacccaagaaggtggcacccaagaagaattacattttaaaaattaagaagatttttttaatgaaaaatattggatcagtaatttctacccagtcttctcaaaggtgagagcatagaaatgtgtctggcattcttccaaatacttgagcagtttcccaagcatcagttcatcttttgaagactggtgggaatgagaaagtctgacttattctgatttatattttgtgtataaatacacacaaagggatggggtttaggttttaatttttttttttttttttttgctacgctgatttaatcctgaagtattagccatcctgccagttccatcatgagaatactggagatgcatgaaggttttttttagtgcacttcatatacgaggacttgaaaacatttcactttcattactttgagtgaataagcagacttgatgctacatgcagtgaatattcttggatcattttttatttttataaattgaatcatgttgaatgttctgagccttagtgtctaaaggatcctgtaatctaggttttcatgtttgtgatcatgtgtatatgaagaacctagccaggggtaagtttgcagcgagaaatgtatggtctattggcatggcatttgctaagtttttttcttcctgtttttaacatgtttgtcttctgcttcattaacctagtgtgtagatgaatgctatacacttctttttcctaggctttaattccatcagtcataaatttcttgtaggtctttcacgtgttaataattccaattgagtcaagtaaatttggagtagaataacttagttcctaagttgaatttcatttaactctccaaataatttttcagaagggattccattttttgctaatgatagaattgacatttccagctgggcatagtggctcatgcctgtaatcctagcactttgggaggccgaagcaggcggatcacttgaggtcaggagttcaaaaccagcctggccaaaatggcgaaaccccatctctactaaaaatacaaaaaaattagccgggcgcagcgatcacttgtaatcccagctactacggaggctgaggcaggagaatcgcttgaacctgggaggtggagattgcagtgagccgagatcataccactgcactccagcctggaaaaaaaaagaattgacatttccatctttgtaaaaaatagttgaaggccgagtgcagtggctcatgcctgtaatcccagcactctgggagaccaaggtgggacgattgcttgaggccaggtgtttaagaccagcctaggcaacgtagagagattgcatctctacaaaaaaaaaatttttttgaattagccaggcgtggtggcacatgcctgtagaggaagctgagacaggaggattgcttaaggccaggtgttcaaggttacagtgagcaatgatcgagccagtacactccatcctgggtgacaagtaagaccctgtctcaaaaaaaaaaaaacttgacaaatgtaaagttgttttccgccttttctgtgggtctctctgcaagcatgttccaagcacgtgtatttcctgctctgtttctctgagtatctaattggtgatttccaagattgcttcctttgctctactgtgtggtagattggaaacagattctggtgccaggctgcctgtccagctttttgctttggggcaaattaacagcactgcctggtgggatagggcctcattcattaaaatgggggtaacttacaatccctattttgctgggttgttgggtttgaaaattaaataatgttttgaaagctccaaggccattgcttagcataacagtcccccctctttctctcctcttactaagaaacaagtgaatatatttcttgtgtttgttgagtctctttgtgtgtttttttttttttttttttttttgagattgtcttgctctgtcacccaggctggagtgcagtggcatgatcttggctcactgcaacctctgcctcctgggttcaagcaattctcctgcctcagcctccagagtagctggaattacaggcatgcgccaccacacctggctaatttttgtattttgagtagagactgggttttaccatgttggccaggctggtcttgaactcctgacctcaggtaatccgcctgccttggctgcccaaagtgctgggattataggcataagccaccatgcccggccatgttcccttttttaaaatgtgtatgaggagggggcttactatgcaagcgcttggaggccaacgagcactgaaaatgaggagagagttcaaaaatcaagttagatcctgggatacgccaacaaatccagacactacagttctttcggagaaacctggggacgaaaagtaaggctttgacctcagaaaatgaacatacaggaaaaataatgtgtcctaatgtgtcctaatgaaatttctctagtattcacatgttataaaatgttaggaagaaagaagatgtgtcctcctacaagccataaatcagaattctaataatctaaagctaattagaaaaatattacatgttaaatattaaatattagaatagaaaaatgtatgagggaaaaaaattgagacacagctgaatttttcaggctgttccagcactaaaaaaaaaatacaggagaagaatgtcacatattttcctcttcctccccctccagattccataatatcaaattcataacttttcatttgcgcatgccttattttccattccttgtttgtcactaatcctgttagtaaaaggattcccccacctatgttcataattaagttttggtctaaaaagaactacaaacagaagcacagttccctagatttctaatttttttttattttatcacagccagttaacttattacattggatacttaaacacatagtaccataaactggatgtggtcttgtagccgccagatcttcagttttgactttggcccaattctcctagaagtacttaattttaattcattttattacctaacgtcctattaataatcccgttggtttcaaagtatattcttaggtttcacaagaggctgaaatttggtcttaggggttgtcacttaaaaataactaatgtaatttttggccgggcacggtggctcatgcctgtagtctcagcactttgggaggccaaggctggcagatcacgaggtcaggagttcgagaccagcctcaccaatatggtgaaaccccatctctactaaaagtagaaaaattagccaggcacggtggcgggcgcctgtaatcccagctactcaggaggctgaggcaggagaatcacttgaccccaggaggcagaggttgcagtgagccaatatcgcccactacactccagcctgggcgacagagggagactccatccaaaaaaaaaaaaaagaaaaaaaaatgtcatttttaattgtattgtttcagggcgttttagagtatttgtttttcagtgttagctttgtttgtgtttcccccctccccttttccctgattttcttttcagacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagtaagtatgagattggaggtgaattaatacagcgtaggacagatggtgcctgtcaaaggtgtgcctgtaggtactgtagcctctgtctgtttaatgtccagacctttgtgctaggtaaaagaattgggtggggcggggttgagaacaggtacaaggagaagagccacgtaacctttgtcatccagtactccaaaatcaaattgtttgctggagaaaggtatattctttgtttgtttgttttgttttgagacggagtgtcacccaagctggagtgcagtggtgcaatcttggctcactgcaacctccgtctcccaggttcaagcggttctcctgcctcagcctcctgagtagctgggactacaggcatgcaccaccgcacctggctaatttttgtatttttagtagagacagggtttcaccatgttggccaggctggtctcaaactcccgacctcaagtgatccatccaccttggtttcccaaagtgctgggattacaggcgtgagccactgcacctggccgagatttttcaatctccctaacatggcctgtttgccagcctgtccttcccctcccccaaagcaaggtacctgccataagatccaatttcattcctgcgttttctttcctgtttttctaaagatagcaccatgatctgttggttctgaaaatcaactcttcctggcttccaggcagtgcttgacatggatcagagatctgaacttactaaagcttcccatggttgttttgttttgttttgtttcgttttgttttttgagacggagttttgctcttgttgcccaggctggagtgcagtggtgcgatttcagctcactgcaacctccatctcctaggttcaagctattatcttgcctcagcctcccaagtagctgggattacaggcatgcgccaccatgtgtggctgattttgtatttttagtagagatggggtttctccatgttggtcaggctggtctcgaacttcggacctcaggtgatccgcctgcctcagcctcccaaagtgctaggattgtaggcatgagccaccacgcccggtccccatggtttttatatcgtagctgtcttactgttttactcaggtacttcagagtccaagtgttacaggaaaggggtcctgatccagaccccgagagggttcttcgatctcgggcaagaaagaatttaggttgaaggcaggcacagtggctcacgcctgtaatcccagcactttgggaggccgaggtgggcagatcacctgaggtcaggagttcaagaccagcctagccaacatggcaaaactccgtctctactaaaaatacaaaaattagccaggcgcagtggtgtgtgcctatagtcccagctactcgggagtctgaggcaggagaatcactttaacccgggaggcagaagttgcagtgaaccgagatggtgccactgcactccagcctgagcaacaggtgagactctgtctcaaaaaaaaaaaaataaaagaaagaaaagaaaaagcattcaggatgagtctgcagtgcaaagtaaaagcaggtttattaataaagtaaagtagtggaagtatagctactccatagacagagcagggcgttcctgaaagtaagaggaggaacacttccaccctaagtacagtgctcatatatataagataaaaaaagagatcttggggagatgtgctctactgcaagggtttgtgataaaggattaattttcttaattattatattttgcaagaatcgatactatctttaaagcaaaattaggaatgccttcgttctccagatatcagggtatctggacactcccaagtctgggtctgtttagtaaacattattaatttgttcccttaaccttaaacatctagaggctatgaatgcctgactttctgggaatgcagcccagcaaggcccagcctcactttcctagccctcactcaagatggagttgctctcgttcgaacgcctctgatacaaaggtggctacaacctgcaggtacccctaatccaaataaggcaagcgatcactaagaacaagatagaaaaatccgttcatgtaaaccttgaagctctagttaaaatttaagtttaaaagcttgtctattccacagcccaatacaaattcgtaaactttcttaaaacattatgagatttttttttggttatttatttatttatttttagttcatcagctattgtgtggcccaagacaattcttccaatgtgggccaggaagccgaaagagtgggcacccttgatagtctgaaaactgtttagaccacctaatggttttattttttatttatttatttttgagacggagtttcactcttgttgcccaggttggagtgcaatggcgtgatcttggctcactgtaacctctgcctcctgggttcaagcgattctcctgcctcagcctcccaagtagctgggattagaggtgcacgccaccacacccggctaatttttgtgttattagtagagatggggtttcgccatgttggccaggctggtctcgaactcctgacctcaggtgatccacccacctcagcctcccaaagtgctgagattacagacgtgagccaccgcgcctggcctagaccacctaatggttttatagcacaactgcgtcatatctgagaagagccctgtataccaagagatttaatagactttggttgccttttagataaaccaaggaagccatacagtcacctccacccaaggcctacaagaagttcctgacacccaatgcttgtcatagagatgataaaatatgtccatagcactgttgtttgttttttgctttttaagtcaacatcaaccttggtaatatgaacatttttgaaactacggtttttttttgttgtttttgtttttgtttttgagacagagtcttgctctgtcacccagactggagtgtggtggcccaatctcagttcactgcaacctctgcctcctgggttcaagcaattctcctgtgtcagcctccccaagtggctaggactacaggcacccaccaccacgcctggctaattttttgtgtttttagtagagatggggtttggacatgttgcccaggctggtctcgagctccgggccttgagtgatctgcccgcctcagcctcccaaagtgctgggattgtaagtgtgagccactgcacccagcctagaattttttttttttaagacacagttttgttcagttgcccaagctggagtgcggtggcatgatctcggctcactgcaacgtccacctcgcaggcccaagcgattctcccacctcagcctcctgagtagttgggaccacagatgcgaacaaccacgcccagctaatttttttgtatgttttgtagagatggggttttgccatgttgctcaggctgatctagaattcctgaactcaagcaagctgcctgtctccgtctcccaaagtgctgggatttacaggtgtgaggcaccgcgcccagctaagaattttttatttttgttatttttttaattttatttatttatttttttgagatggagtcttgctctgtcacccaggctggagtgcagtggcgcgatctcggctcactgcacgctccgcctcgggttcacgccattctcctacctcagcctccccagcagctgggactacaggcgcatgccaccacgcccggctaatttttttttttttgtatttttagtagagacagggtttcaccgtgttagccacaatggtctcgatctcctgacctcgtgatctgcccgcctcggcctcccaaagtgctgggattacaggtgtgagccaccgcaccgggcctaataattttttattttattttagtttatttttttgaggcagtctttcactgtcacccatgctggagtgcagtgatgcattcagggctcactgcagtctctaactccccaggctcaggctgtccttccacctcagcttcccaaatagctggaactacagggatgcaccaccacacccaactaatttttctattttttgtagatgtggggtctcaccattttgctcaggctggtcttgaactcctgggctcaagtgatccaccacctcagcctctcaaagtgttggaattacaaacgtgagcccctatgcctggccgattttgtttttgagaaggagttttgctgttgtcgcccaggctggagtacaatggcgagatcttggctcactacaacctctgcttcccgggttcaagtgattctcctgcctcagcctctctagtagctgggattacaggcgcctgctaccatacccagctcatttttgtatttttcatagagacggggtttcaccatgttggccaggctggtctcaagctcctgacctcaggagatctgcctgcctcggcctcccaaagtgctgggattacaggtgtgagccactgtgcccgaccccactgaatttttaatgggtaatatgctattaagagtaactccccacacccactctgtattgaacctctgtttaaaaagctcctgtgttcctgagatattgtatgaccatatgtacaatcatttgtccccacactcattttttaacacaagatgatataccctgcttttttccacttaaaaaaattatttaaaaaaaaatcaggctgggcgcagtggctcacacctgtaatcccagtactttgggaggccaaggcaggcagatcacgaggtcagaagattgagaccatcctggctaacacggtgaaaccccatctctactaaaaatacaaaaagttagccaggcatggtggcaggcgcctgtagtcccagctacttgggaggctgaggcaggagaatggcgtgaacccgggaggcggagctggcagtgagctgagatcacgccactgcactctagcatgggtgacagagtgagactccatctcaaaaaaaaaaaaaaaatcttttattagtttatatagatctgtaacattcttttctcatgtaataattttccaccacccacaattaacacttaacactggtgcatttgcttaaaactttttttttccttatccctgtgattacatggagatcttttttttaaagaaatataatattacagattaaccccaaattctgttgaaccacccgtggccaaaggcgattgctgttttaagtttggcactacctccttctagtctgccttctacgctcttttttgttcttttctttttttaatgaccaatgatctgtgacacagcatcaggagaacctaagaatatgtgccctctatactcttagcacacacataatgctatgtataatacacatgcataggcagcacttatgtatgatttcatgcagaactgtgacagtcataatatacagacatctctagatacacagcatcacaaagctagtaagatattgggctcaggagccagctgcttgagtttggattctggcttggcttttcatcttaaccttagattaattacttagtcgctctctgtctcaatttattcatctttaagataagacaaatggtagtacctaccttgttataaaatgagatattccctgaagagtgcttaatgcatactatgtattcagtagatgttacattattattttgatctacttctttttttacttttttatagaaataattcttgctgtgttgcccagactaatctagaactgggaaggaagtatgatcctcacctcagcctcccaaagtgctgggattacaggcgtgagccaccttgcccaatctactactcgtgtgtgtgtgtgtgtgtgtgtgtgtgtgtgtgtgtgtcagagtctcgctctattgcccaggctggagtgcagtggcacaatctggactcactataacctccgcctcccaggttccagcaattctgcctcgccctcctgagtagctgggattacaggtgcctggctaattttttttgtatttttaatagagacagggttttgccatgttggccaggcttgtttcgaactcctgacctaaggtgatccacccatctcagcctcccaaagtgctgggattacagacttgagccactgcacctggccctacttctctcttaactcgttttttgtattcttttgtatgaatgagccttacccatttccctattgggaacactcagattatttctagttttccacaattacaaacagtgctgcagcaaatgtgcctctttgtatattacagagctgttctaggcagatgcacagattcatttgtttatttattttttttcttgagacggagtttcacccttgttgcccaggctggagtgaaatggtgcggcaccgcaacttccacctcctgggttcaagcgattctcctgtcttgtactcccaagtggctgagattacaggcatgtgccaccatgctcagctaattttttgtttttagtggagacagggtttcaccatgttggccaggttggtctcgaactcctgacctcaggtgatccacccacctcagcctcccaaagtgctgggattacagacatgagccaccatgcctggcctgtttgttttagacgtgtgatatatgcagttacaatccatttagttggtctgaagtagacccggacatgactgcttcttaaatctcccaggcacttgtcacttcacttgtactcaggatatcaagccattgctatcctatactttaggaaggttgctgggtcaagggtatgcattttaaattaccaagaatatgagtgaatacatttaacaatacagtgttagtaattttgataacattgtatttttaatttgcatgtcacataagtgagactgagcatcttttcatttaagagctatttgtgaactgttactgtacttttaatttgggtttacgctactatgatgttaaaaaatgtttttgactgacaataattatatatatttataggctacagtatgatattttgatatatgtatacctaatggaaagattaaataagctaattatcatatccatcacttcacctatttatcattttttggtggtgagaatctttaaaatctactcttttagcaacttttaaatatacaatgcattattaaatatggtcaccatgctgtgcaacagatcactaaaatttattcttctgacctaactgaaacctcttaccctgggatcagcatctcccctttcctcttccccactctccatccctatcctcttgtaatcaccattctactctctctctttctgagttcgacttttttagattccacatataaatgaaatcatgcagtatttgtctttttgtgcccagcttatttcactcagcaaaatgttcaccatgttcacccatgtcacaaatgacagaatttccttctttttaaaggctatgtagtgttctattgtgtgtgtgtgtgtgtgtgtgtgtgtgtgtgtgtatccacattttctttatccatttatccatagatggacacttaggttgtttccgcatcttggcctttgtaaataatgcttcagtgaacctgggattgcaggtgtctcttcaacatactgattttaattcgtttggctatatatccaaaagtaggattcctggatcgtatagtagttctggtttcagtttttagatgttttagttttctgaggaacctccatgatgttttctcaaatggctatactaatttacatgcccaccaacagtttatcagggttctcttttctgcagtcctcaccaacacttaccttttgtctttttgataatagccattctaacaggcatgaggtaataatagcccagtgtgattttgatttgtctttcactaatgattagagatattgagcatattttcatctatctgttggtcattcatgtcttcttttaagaaatattcattgagctcctttgcccattttttaatcaagttatttgttttgttactatttagttgtttgagttccttatatactttggatattatccccttatcagataggtggtttgcaaatattttctcccattctgtggattgtgtcttcactgttgtttcctttgttatgcagaagctttttatttggatgtatatgtctgtttttgcttttgttacctgtgcttttgggcttctgagaaatcatggctcagatcagtgttggggagcttttctcctgttttttttctagtagttttacagtttcaggtcttaaattttaagttgatttttgtatgtggtatgagatagggtacaatttcattcttatgcaagtcgatacccagttttcctaacacaattgacaaaacattccccattgttcgttcttggtacctttattgaaaatcaattgactgtaaattcatggttttgtttctgggctatctgtcctgttccattggtttaaggtgtctgcttttatgctattatcatgctgtttgattataacagctttactttatacagccatgttccacataacaatatctcagtcaacgacagactacatgtaaacagtggtcccataagattataatggagctgaaaaactcctatcatctagtgatgttatgttatagtgcaacatactactcgtgttcgtggttatgctggtataaactaacctcctattcagtcatataaaaacagcacataccattatgtacactacagtatataattgataatggtaataaacaactattactggcataagctggtatataaccagcttataaacaactattactggcatattactggtatttactatgattctgaccctgtgtaggcctaggctaatgtgtatgtttgtgtcttagtttttaacaaaggtttaaggggtaaaaaataattttaataatagaaaaagcatgtagaataaagatatcaaaaaagaggccggggcatggtggctcacacctgtaatcccagcactttgggaaaccgagacaggtggaccacttgaggtcaggagttcgagaccagcctaggcaacacgatgaaactccgtctttgctacaaatgcaaaaaattacccgggtgtggtggcacatgcctgtaatcccagctagtctggaggctgaggtaggaagattgcttgaacccgggaggtgggggttgcagtgaaccaaggttgcaccactgcactccagcctgggtgacagagcaagactttgtctcaaaaaaaaaaaaaaaaaaaaagaaaaggaaaatatttctgtatagttgtacgatgtgtttgttttaagataagtattattacaagagtcaataaattaaagaagtggccgggcatggtggctcatgcctgtaatcccagcactttgggaggccaaggtgggtggatcacctgaggtcaggggtttgaaaccagcctggccaaaatggcaaaaccccatctctgctaaaaatacaaaattagccaagcgtggtggtgcatgcctgtaatcccagctatttgggaggctgaggcaggagaatcgcttgaacctgggaggtggaggttgcagtgagccaaaattgtgccattgcactccagcctgggcaacaagagtgaaacaccatctcaaaataattaaagaagtttatacagtaaaaaagttacagtaagctaaagttaatgtattattgaagaaagaaaaacgttttttataaatttagtgtagcgtaagtgtacagtgtttataaagtctatagtagtatacagtaatgtcccaggccctcacattcactcaccgctcactcactcaatcacccagagcaacttctagtcctgcaagctgcattcgtggtaggtgccctatacaagtatactgttttttatcttttataccacatttttactgtaccttttctgtgtttagatgcactaatgcttaccattgtgttatagttgccagcagtattcagtacagtaacatgctgtacaggtttgtagcctaggagcaaaggtctgggtgtgtagtaggctatcctacctaggtttgtgtaatatactctatgtttgcacaatgacaaaattgcctaaccatgcatttctcaggacatatccctgtcattaagctacacatgactgtactttgaaatcaggcagtgtgatgcctccgacttcattcttttcactcaagattgctttggctattcggagtcttttgtggttccgtgttaattttaggatttttttttttctatttctgtgaaaaatgatgttggaatttttttttctttttgagacagagtttcacccttgtcgcccaggctgcagtgcaatggcacagtctcagctcactgcaacttctgcctcccaggttcaagtaattctcctgcctcagcctcccgagtagctgggattacaggggcacatcaccacgcctggctaatttttgtatttttagtagagacgaggtttcaccatgttggccaggctggtctggagctcctgacctcaggtgatctgcccaccttggcctcccaaagtgctgggattacaggtgtaagccaccgtgcccggcagaattttttttttttcttttttcctgagacagggtctggctttgttacccacgctgttgtgcagtggtgcaatctcggctcactgcaaactccacctcctgggctcagcctcctgagtagctgggacaacaggctccagccacaacacctggctgattttttggtattttttatagagacagggtttcaccatgttgcccaggctggtctcgggctcctgagctcaagcagtccacctgccttggcctcccaaagtgctggagattacaggtgtgagccatcacacctggcctgccattggaattatgataaagattgcgtggaacctatagattgctttggatagtatggacattttaacaatattcttccagtccataaacagaggatatcttaccatttatttgtatcattttcagtttctttcatcaatattttatagttttcagaatgctattaaggtttttttttttacatttattaagttctacaattacagtacattgctgcaaacagtgttctgtggcagaaatataacatggtggctcacacctgtaatcccagcagtttgggaggccaaggcgggtggatcacttgaggttaggagttgaaaccagcctggccaatagggcgaaaccccatctctactaaaaatacaaaaattagctgggcgaggtggcgcacacatgtaatgccagctactcagggggctgaggcagaagaatagcttgaacccaggaggcggaggttgtggtaagccgagattacaccactgcactccagcctgagtgagactccatctaaaaaaaaaaaaaaaaaaagaagaaccaggaatggcatcctagagttactggggcccttttctcaactacacagattgtcaaacttggcaatattacaaaacaattctgaagacaataaaattatctctaaacctaaactgtccagtagagtagccactaacccctatagctattgagcatttgaatgtggtcaggccaaactaaggtgtgctatagcaatatacaaactacatttcaatgactttgtacaaaaaagaatgtaaaatatccctataataaaaaaaagacgtaaaatatcccattaatcatttgttagttgattacatgttgaaatgatattttggatatgttgggttaagtaaaatgttaaaatttcagctgtattttttttttcttttccgatgtggctactagaaaatttaaaatgacacatggctcacattttacttcttttagccagtgctgctctagactgagtttgcatgaggtgtaactgtctagagctatagtgacatgtaagtaatatacatgctttgtacaaaatctccctataaactgctgattttgaaattgaagtcatgaaagacagattgaaccgatagagtcctttgagagtcaccagttactggtccactctctgtatccttttgatatttgcatttggcaagtataaacccgaccaggataggggatggggggaggaatccactggttatttgatgcaaaaaaagagggagaaaaagtgggggggtgcacttatagtcccagctacttgggaggctgaggtgggaggatcacttgagcccaggagtatgcgtttagcctgggcaacatatgaaaccccatctcttttttaaaaaaggaaaaaaatggtgaataagagcaatggtcattggctgacaagtaacaaactatacataagagaactgttaacctagtagagattttcattgtgatctattacctacaaagtcttcctgtggtttctctttaggggcaagctctgtgtgattgattggaagacatcagagaaaccaaagccttttattcaaagtacatttgacaacccactgcaagttgtggcatacatgggtgccatgaaccatgataccaactacagctttcaggtcaggacactgagcctttacttaaagctttgctcaatgcttacttaaaactataactccgggccgggcgcagtggctcatgcctgtaatcctagcactttgggaggccaaggccggtggatcacttgaggtcaggagttcaagaccagcctggccaatatggtgaaaccctgtctttaccaaaaatacaaaaactagctgggcatggtggctcatgcctgtaatcccagctattctagtagctgaggcaggagaattgcttgaacccgcgaggtggaggttgtagtgagccaagattgcgccactacactccagcctgggcaagagagtgagactccatctcgaatctgtctcaaaaaaaaaaaaaaaaacttctcagtgggggggtaggaggagaaaaattgtaaaaaaaaaaaaagttaaaaaatagaactccttgaggtttttccttttttaatctctatttttatcccattgcttaacgtcttccttgttcctttcccacttaaaaaagcactttttggctgggcacagtggctcacgcactttgggaggccgaggcaggcagattgcttgtgctcaggagtttgagtccagcctgggcaacatagtgaaaccccgtatctacaaaaaaaatacaaaaattagctggacatggtggcgcacacttgtgccagctacttgggaggctgaggtgggaggattgcttgagcccaggaagtggaggttccagtgagccgagattgtaccactgcactctagcctggccgacagagcaaaaccctgtctcaaaaataaataaataggccaggtgtggtggcccaagcctataattccagcactttgggaggccgagttgggcagatcacctgatgtcaggagttcaagaccagcttggctgacatggcgaaaccctgtctctactaaaaatacaaaaattagctgggcgtggtggtgtgtgcctctagtcccacctacttgggaggctgaggcaggagaatcgcttgaacccaggaggcggaggttgcggtgagccaaggttgttccactgcactccagcctgggcaacagagcaagactgtctctctccaaataaataaataaataaataaataaataaatagcactttttggccaggggtggtggctcatgcctgtaatcccagcactttgaaggaggccgaggtgggcagattgcttgagcccaggagttcaagaccagcctgggcaacgtgacaaaactccatcattactaaaaatagaaaaatcagccggaagtggtgcccgcctcagcttcgagggtgcaacgagccgagattgtgccactgcactccagcctggacgatgggagtgggatcctgtctcaaaaaagaaaaaaaaagcacttttccaccctcttcttgggccttttttttttttcaatggctctgtaaggatcacagcccagtcttcaatgttttatctgtcatctttgtgttcttgtgtcctggtgcagtctttgatcaacctaccttagaaactgagttaggagatatcctgtagattattttatactgagtttgccctggagtaagaaggaaacgaacctaaactctggacctactgtagtgaaacgagaattgccctgtgtttcttcctaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagctgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaat

SEQ ID NO: 419 - DNA, 33726 bp, Homo sapiens
  source 1..33726: mol_type = genomic DNA
tcaatgttccattttgcttttaaaagcttcacaagaacatttcatttattaaaatagtttctgtaaactctttcagaataacaaaattcacttgccttgcttaaacagcatttcaagtagaagtatttttatttcaaggcaccataaaatgatgatctctctaagaaatacctctccttccgtgtgtgaaaatccttgggggaaaaaaaaatcccacacggtgttcttggccatcaggatcatgaaaacaaactttggtgaatgtgagcaactgcgccagacaggacacaggttacagggcctgacgtcactaacggcaactgacaatcttggaatggaccctactgctgatgtttcaaaaggacacagaggtgaactggtcacttctaattaagaagagccagtggggtgggggaagctgaaaaccaaaaatccacgtagacatacgtggcagtgtgaacgtctgtcctccccttccttctcctcacttcctctcctcctcctcactcaggctggtattctcctggtgtgcggatgtcagcttgccctgcagaagggctgccagttttttagatgtctttttgagaaacgagctgcccggatgggcactgttcacgtgcaggtacaggtcctcctgggtggggcccgtgtagccgcaatcctcgcagacgtagagcttgtcccgccgctgcttataggcatactgctgctgcaccccatggattttcttcaggtgggactccagagagcagcgctgggtgaaggctttattgcagacgttgcatttgtagggacgaatgcctgaaaggatgagggacagacacagcatcggttggtcatggccaagccagaaccacccaactatgaagccagtaaaagtcatgccatgaccaaggattcatggcagcatgaggacaatggttacagcaggagagaaaactgtctacaaaaaatcatagcatccacctgagtaaacctaacacaaacagatgccaacatagaaaacaaacaaacaaacaaacaaacaaaaccaccacctgctttagggaggaagatttttattcttccaactcacataccttaatgttttcatattattgtgagcaaagtaaacttttaaaaaaaattaattcgggccaggtgcagtggctcacgcctgtaatcccagcactttgggaggccgaggcaggcggatgacttgaggtcaggagttcgagaccagcctggccaacatggtgaaaccccgtctctactgaaaatacaaaaaactagccaggcatggtggcgcgcacccatagtcccagcaactcgggaggctgaggaaggagaatcactggaacccaggaggtggaggttgtagcgagctgagatcgagccactgcactccagtctgggcaacagagtgagactccattaaaaaaaaattaatttgggtattcccagaaacagagcctgggacaaagattccagtacaagtagtttatttgagaggtgatcctgggaagaacctatagggcaacgaagatgtgaggcagggaggggtaggatccagtagaggggaagctacccagccagttacacggtggacaaccagggtccagtcctctgtgcaacgcagggagacagtgtggcacacaccttggcgtcatcccacccctccaggagctgaggtcagtcactggctgccggctgctcctgggtggttttgattctccatccccagcacttctgcctgccttgtgcagacagactgggctccagcagggaacccctcaggcagaggtgcaggggtggacagttgccacttggacaggtgtgcccagaaatggcagatgcccaggccattggcaggacactaaggcatttgtggcagttatgaaaatcatttccaaacaagatctcatgctggcattagaactgggctaacactggacctgccttctagctgagatatcacaggtacaatatagagcagggagctcagcctcatcaaagcattgccgctcctacctccatgattggtactcaccctgatgtgtatggcagaatgtcagataaagaatataaacatggactctgtgtgtgtgcaacagactatttagatgagcttggacagtacagtattttacatacttgccagagcctcagaatcacctggagaacttttgaaaatcttaactcacttctcctaagaccaactcagtgggtctggggtaggaatcaggaatccatttttttttttttttttgagacggagtctggctctgtcacccaggttggagtgcagtggcgcaatctcagctcactgcaagctccacctctcaggttcacgccattctcctgcctcagcctcccgagtacctggaactacaggcacccgccaccacgcccagctaattttttgtatctttagtagagacggggtttcaccatgttagccagaatggtctcgatctcctgaccttgtgatctgcccccctcggcctcccaaggtgctgggattacaggcgtgagccaccgcgccgggcccaggaatctatttttaacaaacgtcgctggatattccagtgttcaacttggctttcaagagccacaggttagggtctttaagattctggttgtggtcttgcctgaggtcaggtaaggtagtggcagggcagagacctcagagcacacccagctcagcaccctacactggcgaaggtcaccccttgagccagtggctgaataggaggctcacactcaaaaagaaggatgggacttaaaggtggaacaacagacgctggggactaccagagggcggacagagggaggggccaagggctgagaaactccccattgggtactacgcgcactacctgggtgacgggatcatctggacctcaaatctcagcatcatgcaatgtacccatataaacaaacctgcacatgcaccccctgaatctaaaatcaaagttgaatttttttttttaaggttgagactggtatgtgacagaagcaagcacactaagcagaatctcacatgacagattctaggaaattcccgtaggccatatcagcaagttttattgggctttaagaaacgaattggctgggtgcttcacagtgactcacacctgtgatcccagcactttgggaggctgacgtgggcggatcacctgaggtcaggagtttgagaccagcctggccaacatggcgaaaccccgtctctactaaagatacaaaaattagctgggcatcatggcacatgcctgtaatcccagctactggagaggctgaggcaggagaattgcttgaacccaggaggcagaagttgcagtgagtcgagattgtgccactgcactctagcctgcgcaacagagcgcgactccgtctccaaaaaaaaaaaaaataagtaaataaataaataaataaatgaaattaagaaatcaccatagtaaggtttttttgttttttgtttttgagactgagactcgctctgtcgcccaggctggaatgcagtggcaccatctcggctcactgcaagctccgcctcctgggttcacatcattctccggcctcagcctcccgagtagctgggactacaggcgctcaccaccacgcccagctaatattttgtatttttagtagagacggggtttcaccgtgttagccaggatggtctcgatctcccgacctcgtgatcctcccatctcggcctcccaaagtactgggattacaggcgtgagccactgcgcccggctgtaaggtctaacttaggctctcaaagagaggttatggctgtgaaggagacacacgtcacaaaagcatggaagttgagagagggtgaatatggtactgggggtgcatggagcatgaagaggccactgccacagccacgagaccatcctagagcctagagacaggagggatgccacctggagaaacccgcagaccctgtacagattcccgggcctgcctcagggaccccaggcactaggtcaggggctgggactaggaagctgtagttttatttttaatattttattttattttatttttttgagactgagtcttgctctatcactcaggctgaagtgcagtggcataatcttggctcactgcaacctccgcttccctagttcaagcaattctcctgcctcagcctcccaagtagctgcgactacaggtgcccgccacaacagccatctaatttttttatttttagtagagaaggggtttcactgtgttggccaggctggtgtcaaactcccgatctcaggtgatccacctgccttggcctctcaaagtgctgggattacaggcatgaaccaccgtgcctggccctaatagttaccttttattaaaatataaaaaataggctgggtgcggtggctcacgcttgtaatcctagcattttgggaggccgggctgggtggatcgcctgaggtcgggagttcgagacctgcctggccaatacagtgaaaccccgtctctagtaaaaatacaaaaattagcctggtgtggtggcccacatctgtaatctcagctacctgggagaatgaggcacgaaaattgcttgaacccagcaggcagaggttgcagtgagctgagatagtgccaccgcactccagcctgggcaatagagcgagaccctgtctcaaataaatacataaataaataaacaaaataaataacaaaaggttactattaatagttgtttaaatttaaaagtaatataccccccagttttatggtgaaaaacagcagtaaattaaaaaaaataaaacagaaaagatccctttgtcaccccatgcacctctccttccctagtcctaactcgcaagtttcttgtgatccttcacattttctacaaattatatatatgtacatttttattttattttattttttgagaaggagtctcactctgtctcccaggctgcagtgcagtggcacaatgtcggctcactgcaacctctgcctcctgggttcaagcgagtatcctgcctcagcctccctagtagctgggaccacaggtgcctgctacaatgtccagctaacttttgtatttttttagtagagaccgggtttcaccatgttgaccaggctgatcttgaactcctgacctcaggagatccacctgcctcggcctcccaaagtgctgggattacaggcatgagccaccacgcccggcctacatatgtattttaagattaataaatatatgtcatctctgggtgttgcctgagcaggagaatttgttaaagcttccccaggaggctctagtgtgcagccaagtatgaaaacgagagttctaaataaatgcacattcacattggcatatgcacggatgtacatgtttccgaaacataaacctggggttctggagagacggtctggagggtggtgaaggcttacacttgccattgcgtccctgtctgtactacttcccatctccaaccacctgccagtattaataataataattttcgtactaactgtggttccttctgggcagtgtaatgacaatgaatctcccaccttttctcttaaaactattctaggatgggtgcatggctcacacctgtaatcccagcactttgggaggccaaggcaggaggatctcttgagtccaggagttcgagactagcctggcgaacatggggagatccctgtctttacaaaaaagtaaaaaattagctgggcatggtggcatgcccctgtggtcccagctactcaggaggctaaggtgggagagatcactggaacccaggaattcaaggctacagtgagccatgatcgcaccactgcactccagcctgggcgagagtgagaccctgtctcagaaaaacagaaaacaaacaaaccaaccctcaccaatcaaggttaagaaagttttaaggcaatattttaaaaatcaaaatatcgaatgaatggatgaactctgttggttccaggaaagaaaggccacatctttgggactagttttccacataggcaaggactacagactcctctcctaaggaatgcgcccgctctagctttcatgtttgcactgtaatgcagactttgtgttttcccggccttctgggcccatgcagcagcgagcagctggctcccactacccagtagatcaagcggcaaacccgatttccaaccttcagctcatcagagcagaaatccacccagagattagttgctcctttcactagttagtagaaataaccgactactgttttaaaacatccaaactaaaaatatggggaagctggcacacttaacatcaggctttaacctggatgcaacaaactcctggaggttcccatcctcaaaggtgatctgcccccgaggagaggccagccaggccaccactcagccccatgtgcacagggccacatctccttcctctcttcagtcaacacagcctctgagcatcttctatgagcagagtacccagcaaggcctggatagcaaacgctagaagattccaaagccctgcatcatgcaaacaagagagatgatggcagtgggggctttttttccagggagtgggtagaattagagcctggcttggaagaggagtgactcgcagacagagatggaaaggagacataggcccagaaagctccagttatggcacttctgacttttgccaaatgcactgctctgtgccccagcacttctgcttccccatttgctagtgtaaacgccaccattcacccctcattcactggtgcgggcactgccatgcggcagccccttggtgaccctttctaggcttgggaacaagcacctccctcccagagcacccccatcacccacacattcagggggacgtgggtggccagagaggagccctgggcaagacggactgatgccaaggcccctcccaccactgaggctcacccatcttggtgctctcacgcaaaggccaaccgtgcctgtgtctaaagcaggacatgggaactgaagagcaccacccatgcgctagacgtcattaacctactgacacccacacgactgtgagtccaaggccaccgaagagccaggctgcggatctgctgcttattaactgaaacgggggcggctgctccagcccgaaaggccgtttcctcacctgtcacaggggtgtcatagctcttgcatggctgctgtgaggattagccgagatagactaagttctcaatgggatacagctcaacataatgcagataagcctcattcgtaagctggctgctgaccagcctggccaatatggtgaaaccccacctctactaaaaaatacaaaaaaaatttagccgggcatggtggcgagtgcctgtaatcccagctactcgggaggccagggcaggagaatcgctggaatctgggaggcagaggttgcagtgagctgagatggcgccactgcactccaacctgggtaacggagcgagactctatctcagaaaaaaaacaaaacaaaaacataagctggctgctgggtacatgagtatttcgcagatttgtctttaaactgtacctatatgtatacttttgtacgtgttacttatttcacaacaaaaggaaaggataattttttaaaatgtggctggtggaggagaggggggactgctttcgccgtctgcccttttgaattttgtaccatcagcctgtcctacctagtccgaaaaatattgtttattgggttatcaaaaagggtttgttgttttccatttttttacccctaatagcaaatcaagcttcgtgccatacatcctcaaggaaaattctacactttggaactttctagttgctttccttgctatagctcaactgctcctttactgaactttatccgaaggtgaacttcagcgagaagatttttacaggcatgcttgtgggagtggacatttacggcagcctccccggaaggcaatttggcaatggccataaaaaaaaatcacactgtatctaccctttggcccagcaatttcacatcagggaaattatcctacaggaagactcacacagggaggcgaaggatatacaagatatactcatggtaggattgcctgaaatgaaagaaaggaaagaaggaaggaaagaagaaaggaaggaagcgaggaagaagggaaggaaagaagagagggaaagaaagagaaagaaagaaaggaaaggaaaggaaggaaggaaggagagagagagagaaagaaagagagaaagaaagaaaggaaagaaaagaaaagaaaaaagaaggaagggaaggaggaaggaaggaaggaagggaggaaggaaggaaggaaatctgcaaatggaaacaaatgtcatcaattgaggaataggaaaagtacagtccctcgatactggaaattttgtcatgatttcttttattattattattattattattttgagatggagtctcactctgttgcccaggctggggtgcagtggcaccatctcagctcactgcagcctctgcctctcgagttcaagcgattctcctacctcagcctcctgagtagctgggattacaggcgccagccaccatgcccagctaatttttgtgtttttagtagagacagggtttcaccatgctggccaggccggtctcaaactcctgacctcaagtgatcagcccgcctcggcctcccaaagtgcggggattacaggtgtgagccaccgcacctagctccaagatatatattatgtgaaaaagcaatatacattaaaaacttttgggaaaaaaattaaatggtggaactggggcttggcatgtgaagggagtttacatttttttctttccttttatctcctaatgaacatattacctttttagctaaaaagtaaattaagataaaatacaaattaaaaataaaacaatgaagcgagggtttgttaactggaccaggcaattccgcatgacagcattcaggccactaggggtggaggtgacttgactctttcttctccatctggcccactccaaacatctcccaatctgcatttttcccaatctagtcaatccttccctttgggctccaaacaaagacaccattgttttctcttctttaatcaagatgggatttgtgtgccttctcctccctctgaatgtaggccccgatggaagataaggacagaaggcgccctagagggtggggccggtgccccctccccacctccctgacctcagaattggaattcctcggcttcaccctgtggaactcagcagcttccccaggaatggcatgagccctgaactgcctcctttattccagccagcgttgttaagttataaccagcatgggtttatgacctccctgggccacgtggctccctgcaaagccttagctgggagccccacggatgtgtgtgcccttctcacctgtttatggccctttacgctgtcttctctgcagctttttatattgtctgaaatcttttacagaatacttagtcattttacaaatgagcaaaataaaacactttccataaacgcgggacttaaatgatgggcctggcacatcgggcacttccgaagcaatagtctgcatttcctgcatgctcgctcctggggactctggcactgccggtccactgaccaccctttgagtagggagggtgtggacactcagtgcagagtcttgtgcttgcaagggctggttattattttttcctctaaaataaagatctcctccctctcctcccaaaccaaatcgtttacttcaacagagaaccattcttaggaagcatcctagcctgttcaacctaaaacacttaaataaatccgaaagaatgtcctataaatactatatatatcctataaatataaaggcccatgtttttcacaggctatgaactgaatacacattcatttcctggaagctcatgtcccctctctctattttgagctggtcagcaggcagaatttcccatgttgtcctcagtgatcctgtcaacttcactgaagtacagcaagtccctcaattatatagtggctgctgctggcttcccatccagaccgcttttctgggtcagtgcatgtccccagctgtcgtgtggcttctggctgtccccttctttaaggaatcagcactgggcaagtgaccttccagatgctcaggagtgtctccctgacctcgcccagggcagacacagccctcagccaacgtcagactgaaatgggggtaaaaaagtccctgcccccaccttgcctgtagcagatccatcctggagtccattcacactcctgatcccccctgggatgaggtcgaggctgcactccagctaacagcaaaacccatgctcatcctctgccctcacaggctccacttgacagccctccctcaataaaccatttgatgggaagccgcttccaaaccccacctaagataatttggattgaaaatagccacttgttttcacaaaatattacagagtttttctgcacaggtcagtttctctcttccagtcttcagtaggacaccatttaactaacactcccttcccctctttctctctctctctctctctctctctcacacacacacacacacacacccctccgatttacctttcttgggtgaactcacagccaaaaaagaagtcctaatcttttctttcgtctacttggatattaatgtaagacatcttcaggttctagtttccctggatcttttccaagatatttctttgtgttttgagtctttccttagatatcctgtttgctcagtagttgcaggggattggaagagatgggggagtcgggggtggtgcagattaaccctgattctctagctcactgtctttgcccacctcatcaatattatagctacaattctccaacaaagggtcctcggccctgggtcctgggtcctgggtccaggccatggcctggtctaattggactgcaaacaaacatacccctcatttaactatctgtcgtatttatgttaagtgtctatatctttgtttctggcctaaatacaacatttacttataagaaccaatagcaaaaatacaacactcacagctcaatcaaaggcaagaccaggccaggcgggtgcagtggctcacgcctgtaatcctggcactttggaagggtaaggcaggctgatcatctgaggtcaggaagtcgagaccagtctggccaacatggtgaaaccccatctctactaaaaatacaaaaattagccaggcgtggtggcatgtgcctataatcccagctacagctacctgggaggctgaggcaagagaatcgctggaacccaggaggcagaggctgcagtgagccaagacgggagccactgtactccagcctgggcaacagagcaagactccacctaaaacaaaacaaataagcaaacaacaaaggtaagaccaaattcccactgaattcaagtaaggtcttttggagctggtgaagtttgttcacatgaactaaaacatcatctgagaaacccacatttttgcactttgtaccaactgtctcttttggacagagctgaagagatggctcggcaagcctgttcctctgagcttgccaccagctgatgtgtcaggaagcccccggctgctctttctggtcttttattacatggagacacaccttcatcagaaaataggtcgggatggggtaaataggtctaaaacatttccatagttccatttgttcatccctttaagtgtcaaaatgatgattaaaatttttaaaggttatcttagtgccatccaatagaaattaaaatgcaagctgctttataagttaacgttttgtagaagcctcaaacaggtaggaagaaacaggtgaaatgaattttaatgctatattttgtttaactcattatgcccaaaatactaccatttcaatgtaaaatccatattaaaaattgagatttttggccgagtgcagtgcctcatgtctgtaatcccagcactttgggaggctgaggcgggcagatcacctgaggtcaggagttcgaaaccagcctgaccaacatggagaaactccatctctactaaaaatacaaaattagccaggcatggtggtgcatccctgtaatcccagctactcaggaggctgaggcaggagaatcacttgaacccgggaggcagaggttgcagtgagccaagatcaagccattgcacttcagcctcggcgacaagagcaaaactccatctcaaaaaagaaaaaaacaaaaaaattgagatttttacaccttctttttttgcattacaacttgaaacttagtgtctcttttgcctatacaacacatctcaatctggaccagcccctcctctgagactcaggagccacacacagccagtggccgccggaccagccagcacacctctaggtttttcactcctagctgcctcctaagccctagcctttcccctaaggtgataactgcgaaaccctttgggaaaacgtcaggtggaaggtattttcattcactaacttaaatgattttcagctccctcacaggagtcactagaagagtaggagatggagaaaatctgagaacctcaggttgggagtctgaaggggtacaggcaccccctttcttgcttcctctgtgggcagaggacatcttggcaccactgaactcacacgctcacaggctcctctacaacctactaaaccccaagctgaagtgtgcactttgtgctactaataggtctgagtttccctttatctcaccttcctctagaagcaagcaggcttctagaaactgcaacaggccgggcgcggtggctcacgcctgtaatcccagcactttgggaggccgaggcgggcggatcacgaggtcaggagatcgagaccatcctggctaacaaggtgaaaccccgtctctactgaaaatacagaaaattagccaggcttggtagcgggcgcctgtagtcccagctactcgggaggctgaggcaggagactggcgtgaacctgggaggcggagcttgcagtgagccgagatcgcgccaccgcactccagcctgggcgacagagcgagactccgtctcaaaaaaaaaaaaaaaaaagaaagaaactgcaacagggcaggctggtgaggcccctgcctcagggggaatgctgaggaaggcactgggaggcaaagagggcagagaaggagaccctacagaggataaaagaccatgaacttcagggccagccagttctggttcccagctccaccactgatgggttgtgtgagctccctgagcctggtttcctcctctgcaaaaggtggagaacaacagcactgactgctttgggtaatttgagatgacaggataaaggccggaggcctggcatgaaggagagtgaccgtgtgtggcttgcttctgcctgcagggctgtgttactctctgaagggtcccctagtctctgccgagccaccctcctcacttgctaaatcttctgcctcccagggcggatgccccactcatatccccttagcagatcgccaggcatctcagatggttcctgcatctctctgcctaaggatgctctccaggcctgcaaagggctggggtgggcagagggtagggagaactgcccaggagtcaggaggtccaggatggacacccaaggagggatgggggttgattgagcaacctggggtgcattctatatggttcttcagaggatctccagtgggattgagcctccgctgcccgtagtgataacccactcattattattgagcttttattggctgtcttccctcctgacctcccctccctcctctactgtgttttctgggatcacctcccaaatacattgctcacatccaaatccttgtgtcgcgtctgcttcttgggcaacccaaactaagacactcctcattagcaacgctcttcctccttctgtcctgctgtagaaagcttgctcatccttcaacgcccagctgaaagactaccttttctaagaagcccccctgacatgcagttagaaacaaggcacctcccaggactcccctttggcatgtgccactttttcttctgtctggcatatcggctgtttcacttgtctcacagtcagatgtctgagttattcctccctatgttggctgagagctccatgagcacagaggtgaatcctagggcctgttacacatcaggtcctcaggaagcctctgccaactgttgcaattttactactaataatagctaatatttactacgcacttacaatataagaagcacttttatgtaattctggccccaaaacctcacaaccatcactttaagtggcaagtattaaaatgatcacacccattctagagatggaaaaattaaggtgaaagacgaataatttagaacaagtctcacagtcagctaactcagatcaggagttcttaactactatgtgaccgcctcaacttgtaaactcttctctgagaagctgtcagtccctaatatttcccttagtctccagcaatggagaattaactcaatcacaggggaggcaaggccatcagctcagtgtttactccagctgaaggtaccaacagctagccatgcttcctgggccccctgcgttgtgtcctagaagccagggtgggggagtgaccacagagtccatccaggcagggaatgccctcaaggacatcctcagagatgatgtccttgagacaccctcaaggaggggctgagacaccctccagggccaccaatggccagcgacttcaggagtggtcctgatttcctgcccctggggtcaggaggaaagcccagctttgctgctgctggatgggtcccttgacaacctcgagacctcccctaggcctcttataagaccccctactgccctatggatcctccacctctccctaagcattctcctcacccccacccaatggccagcttagactcacagaggtcaaacttttattgattcactggtgctaggaaaagcagccatataaccagacccaaagagcacactatgggattccatttacatcaagctcaaaaacaggcaacagtaacttaagctgttagaatttgcaacagtggttttccttggagagaaaaaggcagactgagaggggtagtgacttctagtggctggaaatattctgtttcttggtctgactgctagtcgcatgagtgtgttcactttgtaaaacttcctaaatttgctgaggtcggcacttaggatctgtgcacttttctagatgtatgttacactaaaatgaaaagtctctttagaaaaagtttttggccgggtgtggtggcttatgcctgtaattccagcattttgggaggccaaggcgggtggatggcttgagcccaggagtttgagaccagcctgggcaacatgacgaaatctcatctctacaaaaaatacaaaatacaaaaaaaattagctgggagtggtggcatgcacctatagtcccagctactaggggtgctgaagtgggagtatcagttgagcccaggagttggtggctgcactccagcctgggtgagagagcaagacgctgtctcaaaaaaaaaaaaaaagaaagaaagaaagaaagaaaagaaaaagttttaaaagaggaaaacagaaaagaactatgttaggattccagccactctctaaggtgacagaaactctttccagaccagggaggcagctcacggccagtcctctaagagcaaacacgcatgatatgaactagaaaataggatgcagaggcctaagaaggaacctgtatgagggctgagtagctgggagccccatctggagggaggaaaaagtgtcttcccttccctaccaaaataccaaggacggaaagggctcggggactatagatagcaaaccctttttttttccccttgagaccgggtcttgctctcttgtccaggctggagtgcagtggcacaatcatagctcactgcagcctcaaactcctacgttcaagcgatcctccagcctcagtctcccaagtagctaggactataggcacgcaccaccacgcctggctaatttttaaattttcttggggagacagtctttcgatgttgcccaggctggtctccaactcttggcctcaagcaatcctcccaccttggcctccttaagtgcaaggattacgagcaggagccactgcacccagcctgcagatagtaaattctataagtctgttgggagggtgggtggtaacctggatagggttgaatgggttaagatgggatgggataggatgagctgaaatgggttggagtgagatgggctgatctgaggtgggctgtgataggatgtgatgggataggacgtgatgggctgggatgggctgagataggatggggatttgaagatgggacccacattgtaaaggcctttacacgaagcccatcaagatgagagatgaggagtctggatttcattctgttcagagttggagatttcttagcagggaagtagagtccttagaattctcctggagggatcactctggcagaggtgtggacaatggagctcaggcgggaaagcatggaggccaggtgtttctcagatagaagcagtgaggccgagacaagaggccaagggcacccccaggactctgtgaagaactggaactggggagaacctggattcccacttcctaagtcagaaaactgaggcaggtcccagaagaggaagatgcttgcctgccaggctccagtacgaggctcgggtcagctctaaaggcaatgagctcctttttgtgtctcaggaggaacacgatgctatccagagacaggcttatgtcccaagagagaagtataaaatactcattgtggggccacaagaaccacattccagcagccagaaccaaggggctgagctgtggcaggccccgcgtgtgtgccatgcatcatgattctcagaatacttccagccagggatccgttttgagcctcgctagaactcacatcgatatctccattttacaggggtgaaaggcaggctaccaaaggtggctcacctggcccaaggtgacacagctggcaggtggcagagtcaggaggtgaacccagaagggctggccctaacgccccatcatcttgtgatctttctttttttttctttttttgagatggagtcttgcaatgtcacccaggctggagtgcagtggcatgatcttggctcactgcaacctccgcctcccaggttcaagcgattctcctgcctcagcctcccaagtagctgggattacaggcgccaccaccacgcccagctaatttttttgtatttttagtagagacagggtttcactatgttggccaggctggtctcaaactcctaacctcgtgatccgcatcttgtgatctttctagaaacacaacattgttccacggtctcaacctggttttttggtgggaaagaaacaggagctcttggccagaataacaaaacagagaacaaagcacgcactccccgctcacctgtgtgtgtgcggacgtgcctcttcaggtcgaaggtgtcgttgaagcccttgccgcagaaggtgcacaggtgtcttttcacctggttgtggcacttgaggtgacggttcagcatgcgctgcagacggaagcccttgccacacaggtcacagctgtgaaccaccgagtcgctgcacgtgcctgtggtgaactgggggcagagagaggccatgagggtccccgggcaggcaggcacatccagtaggctcactcaagagacccacctccctgtgtcttgaggctgccctgtctgcggcttctgcccctaaaattttcaagcaggttttggctttgggaaaggtgaagtaacaactggcagttcctcccacccttttttttttttttttttctttttgagatggagtcttactttttttgcccaggctggagtgcagtggctcgatctcagctcaccgtaacctccacctcttgggttcaggtaattctcctgcctcagcttcccaagtagctgggactacaggggcacatacaaccacgcctggctaatttttgtattttcagtagagacagggtttcaccatgttggccaggctggtctcaaactcctgacctcaagtgatccatccgcctcagcctcccaaagtgctgggattacaggcatgagccaccgcacccagccagttgctcccactttttattctccccttcttccttagaacaaacctctgacttctagctgggcatactgtcttacagcatcctacaggcatgtgatggggtatgaatgttaggcccctccaaatgtcttgttgaaatgtgatccccagtgttggaggtggggcctcgtgggaggttacaggggcagatccctcatgaatggcctggtgccgtccccgtagtaaagagcgagttcttactctcatcagttcatgggagagctggctgtttaaaagagcctggtggccaggcgcggcgtctcatgcctgtaatcccagcactttgggaggctgaggtgggtggatcacctgaggtcgggaatttgagatcagcctgaccaacgtggagaaatcccatctctactaaaaatacaaaattagccaggcgtggtggtgcatgcctgtaatcccagctactcgggaagcagaggcaggagaatcacttgaacccaggaggcaaaggttgcggtgagccaagatcgggctattgcatccagcctgggcaacaagagcaaaactccgtctcaaaaaaaaaaaaaaaaaaagagcccggcacttcctcccctctctcttgcttcctccctcaccatatgacacgcttgttccccttccgccttctatgagtggaagcttcctgagggcctcaccagaagaagacaccagccctatgcttcttgtatagcctgcagaaccatgagccataaacctcttctctataaattagccagtctcaggtattctttatggcaacgcaaaatggactaagacagcatggccatggactacctggccaatgaaatagaaatctccttgaaggggagcaaacggtgccttcttcctcctccactccttcctgctgactagagcaccaacagtcaccttggaccatgaggtgggaggagcagaaaggagtctgggtcctcatgacatcatggagcctggtatgttatattacagacagtacccaaagagagccacactcaattctgtcctccttgtgcctgcatcctgctccatttatcaagagatggagactgttttccctccccttgaatctgggcagggcttatgaccagttggatcaacagaatgcaatgaagatgtgtcagttccaggttttaagagaccttgtagcttccatttcttccctcttataagccagctgccacataagaagtctgaggctaccatgctgtgaggaagcccaagctagccatgtggacagccaaaggccacatgggggagcacggaggagccagatatgaataaagcctgattggactctccatcccaactcagggctgccaccagctgaatgagtcgcccccactaacactacccagagtagaactgcctagcagagccatgcctatggcttttgtcttgacccacgaaatcataaacgcataaaattatcattttgtaaagcggcttggtcagtacccacagctttgttatcagcaaaaccacaaccagacctgggtctggactccctgcccagtgctttctaccaccttcgctgctgctaaggaagaacatagaatctacatctgggtgataaaaatgatgtgttcaattttagtatctgatttggtaacttttgaacatgtgatgtgaatgttaccaaatcagatcctttagaagatggatcccattgctctgccaaaattcatcactagcaagaagactggtcctctcctggctccacactctcccagcttcaaatactctcctctttcatccaccctgggtattgccctcccaggactcaagggagctcagttgctcccttgccgatgcagccttctccaaatactgcagcccatgactaaactgctcactgtcccacttaaaccagtgcctctcagactccagcatacctatgcctcccctggggtcttgttaaaatgcaggttctgattcaggaggtctggtagggtctgatgtgctgcatttctaaccagagcccaggagatgccactgcagctgatgcacacgccacactagccctgagaagtcatgctatattccatctcattcccaagtttcactatgcacacagttcatcttgttttctcaactcaacactttgaggatggtcagcaagcattcggtcccattcctgcctccctacccactgctccaagcctagtctagggccagtgcacaatcagtatgtgctgaccggcagctgggagcaggtggcaggatgcagagagtctcaagggaggcacaagaccccagaacagggtattccagtcagcctcctccactagttcattttcctttgcttggagcttaatttgccccagctaacattgataagtccctgatctgtgacaagccctgtgcttagagctggaggcaatacagttagagatggcttaatccccagtccctaggaagctgccgagtctagtgggggtgcaggcaagtcaacagccattgacatctgagaggcccaggggtccgagggggcacctaccccagacctacagcaccagggaagatgcttccagaggaagtgagctccttagtcaggcaaagatgaggaagaaaaggggtgcacagcaaagaacattccaggagaggacaatgggaaagagggaactgtgtgtggttcagcatggctagcctgagcctgggagagcagttaatgaagagagcagtggtagctgagaagaacaagatccccttaggagtctaccttgagggccctactggagctggaatgtagtcaaagggcaagagggagccactggaagacaaagggggaacatcacaggggctgagttcgatgacccagttgggtggctgtcctggatcctcatcaactacctcactccccagaactgcagctgcccacctctacccaaggctttcctatcacccacgcagttcatgttctccttgcccggcagtccccatcctgcttacttccacccttgaagggatttgaaaagactaaatatgctccactaagtactttgagcttctaaagaccaagtgtgcacaagcacatttgagtggtagtgaggggctaatgaaatagaacaaagacaattaccctggtaattccagttaaaattagtaaaaacctgcaactgtcttttgaaagtcttgcagaatgtgcctaaggactcaccaaccatagttcaaacatgaattcttgtttaatctttttgacaaattcctatttttaaaatgctctgaatgcaatacagatgccttctattgcagtctagaatgaaaatctcaaatcgtcggtattattttgtttgaaaagaataagatcttgaagggcacagggaagggagatcagtgacaatttaagggagtacagggccagtagatcatctgatcaagacatagaaagtgtgttatttatttttgtttgtttttaattttttttagagatagaatctcactatgttgaccagactgatcttcaactcttatcctcaagggatcctcctgcctcagcctcccaaagtgctgggattacaggcgtgagccacaatgacttgccaggaagctttataaaacaggggagaaaatgggagtggagagaaggggttggagactgaaggcacacctaattctcaaggggacgtttcctctggttttcttagagcaaaaatggaaattctccacatatccctcagcaaaggcaatttttccatttctccccatttcacagcatggaaagctgagtcaccaagaagtggctcaggtagggaattcatcctgtggcacaccctccaatccattaagtgctgcttaccacccttatgaccaatccagccatcagatattaacaaattacactcaaagtcttcaggagccttgttgaaagaagatgtaaggttatttaatggcaaaaaatcatggctgacaaagctagcttctgccagactatttcacttctcagaaaggaagggatctttgtaaattcctaaacatgaaatttatccctaaaagtatatttaatatgccttgtgccttgaaatttggtttgtaatagcaaaggactggaaactaaatacatgtctatcaataggaacttgtgaaaaaacggtggcagaaccttacaattaatgcactggacaaaggtaagaggctagaagcagttcaagtgtcacctgccagccatgtgagtgagcccttgtggatgtccatcccagtcaaacccccagaagactccagcctcagccgccatctgactgcaaccacaaggcaagaactgccctgctaagcccagtcatcccacagaggtggatgatacaatactacatcatttcatctattaaatttggagattcttgtgaagcagaaataggttaactggaacagtaataaacgtatcattctctccagacgccagacctgccacatttctaagtgtctctcccaggactgcatggtacagaagacacatctgactcctggactgatgtctcatggggcagaggaccagctgaccccgcctggatcaggatcacagctctgctcactggagcacctttattttgtttacataggtttacacctaacactgtacctcctaaaagttaaaaaagagttaatcgatcttaccttgttcctctacaagtactagactaaacttaattacatcttagtcatgttagttacaaaacaatagtggaatagagagacaataaatctgaaggatcaaaaaaaaaaaaaacctagatctggctaggggtgtgatatggaatgtcatttaacatccctatgtcacaatttccccacatgtaaaacaataaaatggtattagatgatctcttcagcagtataagaagctaagagcagggtctgttttccagtttcctcaattccttcaattcctgttctaccacttagtttgtggcaagttacctaacttagttgtaggcaagttacctaacttctctaagccttcatttcatcacctgtaaaatgtgaataataatatttgcattggcaggcgtggtggctcacgcctgtaatcccagcacttcaggaggccgaggtgggtggatcacctgaggtcaggagttcgagaccagcctgaccaatatgatgaaaccccgtctctactaaaaatacaaaaattagccgcgcatggtggctactcataatcccagctactcgggaggctgaaacaagagaatcgtttgaacccgggaggcggaggttgcagtgagccgaaattgtgccgttgcactccagcctgggcaacaagactgtaactctgtctcaaaataaataaatataaataaatataataataatatctgtctcttagaaataaatgaaattggcagggcacagtggctcacacctgtaatcctagtactttgggaggccaaggccggtggatcatctgaggtcaggagttcgagaccagcctgaccaacatggtgaaaccccgcctctattaaaaatacaaaaattagccaggcatggtggtaggtgcctataatcccaactacttggaaggctgaggcaggagaatcacttgaacccgggaggcggaggttgcagtgagctgagattgcgccattgcactccagcccaggcgacagagtgagactccgtctcaaaaaaaaaaaaaaaaaaaaaaaagaaagaaatgaagaaattaaatcttaatttaattaacctggtgctttgtaagtcctattatagttagaccaactccaaaattctgtggtcctaaacaaaaggtaattggtcaaaatttcttgtttctcggccagatacggtggctcctgcctgtaatcccagcactttgggaggctgagggggcagatcacctgaggtcaggagttcgagaccagcctggccaacatggtgaaactccatctctactaaaaatacaaaaattagccagttgtggtggtgcacgcctatagtcccagctactcaggaggctgaggcacgagaatcacttgaacccgggaggcggagtttgcagcgagccaagatcatgccactgcattccagcctcagccatagagcaagactgtctcaaaagaagaaaaaaaaatttgtttcccaatttgcttttgaatttttctctctttgatggaagaaaaggggaactaaaaaaaacaaaacgaaactaaaaagggagccactagctcccagtccttcatctgcaactctgtaattcaaaaagctctgaaaaacagctgggtatagtggctcatgcctgtaatcccagcactttgagaggtgtaggcaggaggatcatttgaggtcaggagttcaagatcagcctggccaacatggtaaaaccctgactctactaaaatacaaaaattagctgggcatggtgatgcacacctgtaatcccagctactcaggaggctgaggtggggggcggcggttacagtaagccgagatagcaccactgcattccagcccgagtgacagagagagaccctgtctcaaaaaataaaataaaataaaacaaaacatatgacaaaaagctctgacaaccaacattctctcctatctcccgtgacagtgaaatctgacctgagctgatgtaaaaatatgtgcagactttatcccatttagtgtcaatattcacattttaatatggaaattattaatatatttaattataaggtactgctccaagcctgccaggggtggtttttacaccatgctaccttctggaaaagcttaatcgtctcacccttaatccaaaattaacactttgcaaaaggcttattaacgaggtggggaaactaccatacagggagggaaatgaccttggtcttgaaattaattcagggcacgaagacgaagagacaatgaacagctctccaaccccatggcctggcgcttttctgagcactgtcctgttttctgcaggatctcggctttcatttcaaaaaatgtgcaaaattctcctcaagttcttcttctagaaaacaggactcagcggcagaacaaaccaatcattgtctccgcactgctgaaaactgcaggaacatccagggagtcagggccttcggctggccctctgaccagcttcaaagccggctcagatcattcacctgtcaaacttctaaaggtgaaaacaacgacaaaaaaaagaacaacttttattttctgttgatgtttctagcagacaagttcatttagttaatggtctatgggaggatattctgagtccaaggctaccttctggtggccatttggaccagatttccaccgacacggtgcgatgcttgaatgctaaaagcatgctaagcatatttccccaattcgtttggcattcagattccccccccgatcctatgtaccatttccttagacttcacaactcccctacatggcagaatggagagccttctcaaatgcagagaagatgaagggaatatatatctttataaacctgaagaagaaactgaggcccaaagagatatgacttgcccacggccacatgacttgtagtggccaaccctgagaattttgaatgtggtccgtcatctgcaaaacttgtgcctacagttccctcaggacaggcccacaggtctgtggggcaggaggagggggcatgaaccccattgtttgtctcatatcatcatgagtccttaatgtcagactatcaacactaagggctaaagcatcaaagccacatattgactacggctgacatactggacagtacagttgtcccacaatgcaatggaacaatgctgaaaggttgaggatccttgggttgagttttgccactaacaactttgaggaactcaacaaaaacttgctgggcttaatttttctcaccctgaaagtaaggagatttggggccatacatgctttaaaggttcctgtagtcgatcctatggaaggactcagtatctatcccaactccttttggtgggccttcctgcaccgccgaagctagagaagtgaaaactacgcttccctgactcccttgccatgaggatttgggaagtaacttgggtttcaccagttacatgcactatcaggagatctgaattcagccccgagttaactgggcagaggcaggcaagaggcaattgttttacactttgccatggcagatgcagggacgggcagccatcgaggtggcagcttcctgattgggcagcagcttcagctcctaggtggcccagttctgctctgtggctctgagtcattcctgggagctcagcttggtccttctttagtccatttaatacctttctctgcttaaactagctatagtggattctgatgttcgtaactaagcctatgtagtcctttccaacaataaaaacctacttcacctatattcaagtttaacaccaggcaattaatacacattgttctcatattcctccttttcccccttttaattaatttaaccttcatcaagaatccattccaagcatttttccagtatcccttttcttcctgctttctgtgttttccttcaaatgctatcactcatgtctgggaactgttgacttcttcccctgcctaaattcttgttctgtgttcacttatgtccttctatgacccaggcactactgcactggttgctgggtaatacgagcccagtaggaagtgttccctggctctgatggatctagagtggaaaagagaagtcagttggccaaatgtgcagccaggaaaatgggcagcaggttacagtggagcagggggaggagtattcaagtctgtcttgggagacaaaaaaacaagaggaaaggagtcagggatggagcttatattcccttccaaatatcaaatgaattggtttttaaaaacggcttgaatccataattcacaacaaaatgaatgaaataacagattgagagccaggctcagcagcatgtgcctgtagtcctagcactttgggaggctgagataggaggatcgtttcagcccaggagtttgagaccagcctgggcaacatagtgaggccctgtctcaaaaggaaaaataaataaagagaaagaaaagaaagaactaattagccatcaatggagaattctggttaacaactgattatcttcatttacaaataaaggtaaataaagcgaatccagcattattctgcctttcataaatgaactgtgccactggaaaaccaagcagtagatgaggcaaagtgtatctctatagaaatacatcagttaataaacagaggacagaattagattattgctgttttagaacacctaataagccaaaatatttaggtcctgagcatcaacagctgctaacatcagaaaaagagagataaccaaatattcagtgcctctgatgaagacagatgccccacagtgtgacatattctagctgaaataaaatagagctgaccaagcagggagagttgcattatccaatagaactttttgtggtgacagaaaaattatattctgtactgtccagtacattagcctctggtcacacatggctactagcatttgaaatgtcgctagtaggactgaagaacttaactgttattttgagacagggtctcgctctgttgtccaggctggagtgcagtggtgcaatcttggctcactgcaatctccacctcctgggttcaagcgattctcctgcctcagcatcctgagtagcctgaattacaggtgcatgccaccaagccctactaattttttttgtatttttttttaatagagtcggggtttcaacatgttggccaggctggtcttgaactcctgacctcaggtgatccgcccgcctcggcctcccaaagtgctgggattacaggcatgagctatggcgcctggtctaattgttaattcttaattgactatggctgtgatagtcacatgtgatactggatgctgcagctgcagatccaactatccgtttagagaaaacctaggggactgagaaacattaggcacatggtgatgcgctcagcaaaatccagactgttggggactctacaaaacaaatcacccatttcttcaacaattaacttgatggagggaaaatgtatgaaattaaaagaggctcaaaagacatgccaatcaattacaatgtgtggacattatgtggacctgattaagcaaactggaggggaaaagtattaatttatgagacaattagtaatgtgaacacaattggtaatgtgggtgtgatcatgaattttggtctttatccactaaacgcacattctgaactatttatggttgaaatggtatgatgtcctagatttgcttcagaatcatgcatggggcaaggggtgggagtgtggctgggcaggactggccatgggttaatggttgttggggctgggtggcagatacgtatgactatgcctttgagattgtaaataatacaaagtgatgggggtatggggactactccgtagacacacatctgcaccactacaagactcgatagagagccgggtaaaaggccaagcatacttttgaaagaatctaaacttaatttattttgaagaacccatgggagaggacaaaaagaaagaacagaataggaaagggtgagaggacaaattcacttggtactccatacttggacctgggtcctaccagccagagaatcacgtatgaatactatcagccaacttcagagttacttactttctaataagcctccaaaggacaatggtgattagtatttcctgggtttctctaccccgcagctgaagacctgcagatggatccagcacaaaagggacctgccatgcacactctctggaatgtacatcatcttctcacccttatttgtttggcaaattacagaattctcagtagtaaagagacaatttcacaatctgccctgaggcacaccgtcaaaaggcaggtaggctgggaagggccagccacatttcctaatctgcacctcggactccttttccagatccacccatcaacacgatcaagttagtgaatcccatgtccttacagccaacaaaatgttgggcattaaaacttgctgtatgtcactgtcagctaacttcctcttgggcagtttacacatgcacagaaagctaaacactttacacccactatctcatttaatctatgcaactcttctaggaggctgattctttgagtcctccactttacagatcaaggaactgaggctcagaagagataatgatccatgaacacagccgttaagagggacccaaatggcagggcgcggtggctcacacctgtaatcccagcactttgggaggccaaggtgggcagatcacctgaggtcaggagttcaagaccagcctggacaacatggcgaaacttcgtctctattaaaaatacaaaaatcagccaggctttgtggtaggtgcctgtaatcccagctacttgggaggctgaggcaggagaatcacttgaacctgggaggcagagtttgcagtgagctgagattgcgcaactgtactccagctccaggcgacagagagagactctgtctcaaaaaaaaaaaaaaaaaagaggaacccgattgaggttttccttcttacatcatccagagcttctcctctgcccagcaggagcacccatatttcttggcttggccccttcaccatctcaccctgtcctggttacatttccagctctttaccgccaactctctccctgaccccagcaagccctgtttcctatcttcagccaccagagcttcatcctttctatgctccagctgcgggactcagcccacactgccctcaggcccacccgcctcccttctccccagccttcaaatccacatcaggacactttccccactcaaatcggtcacgtctttgtttggaattctggtttcacattcactgtcctgcagcagagttaataatgtttgtgtctccctattaacctgaatactatctatggttattgggcacataccatgttctaccctccactcatttatcctcacgatgctatcaagtaggtatcattatcatcttacagataaggaaaccgaggctcagaggggtgagccacttgctcaaggtccacagctaagaagtgacaaagccagagcttatatgattaaccgctactgccagatgattctggaaggaacaccagggtgggagcatttttacctcctgctgccttgcacaccccaggtgttagacgggcagagtgttgcttctctgtgccaggcaatagctcaaacctgcccttcttgtggtcctgggagcccactgcctaagaaactaattcttggctggatgcggtggctcacgcctgtaatcccagcactttgggaggctgaggcaggcggatcacctgaggtcgggagttcaagaccaggctgaccaacatggagaaaccctgtctctactaaaattacaaaattagccggcgatggtggcgtatgcctgtaatcccagctgctcggaaggctgaggcaggagaatcacttgaacccgggaggcagaggttgcagtgagctaagatccagccattgcactcagctaagatccagccattgcactccagcctgggcaacaacagcgaaactccatctcaaaaaaaaaaaaaaaagaaagaaaagaaaagaaaagaaaagaaactaattcttagagaaattgtgagttcagcatgccttggaaagaactttataattatacaacgtgctaagtcacaggcaatttggtcagtcatttgaaaactgccaatgccatggctgataataattctggaggcttggagcatattaacaccaaaatgtttcctttttgggggtagaggcagaaagagggaacctaaacatccccagtaaataaaaattcccctggaaactatggaaagaagactcttaacggttcaggagtgaactgtgcctcccgccccccttcccccagcacacaggcaactaatctaggaaataagattggtttacgtcttcctttaatccaggattccaacggccctgtgtgcctgaggcagaagagtttgcctaaaatatttgttaagagactggatgagaatctgtcactttctctccaggggaatctgggcaattgggggacagaggggcaaactagctgcagaggctcccaaaacaacgttgcaattgtccttccagcctggtgataaatatgcaagtggggcactttgtagaatctcccgaagggcagagctaccagcctcaggcaaatttttccctcccacttaaccccacctggcccggaagagcctcaggccagctgactttgaacctcaccctcacacttaccgctaagctgccggcccgcacggtttcggcagcttcttctttaaagaggtctttcctttggatcccagctgaagcctcaaacctcagttcaaaaccaaatgcgcctcagcccaccccggagtcaaaccctgggaatacgcaatgtgcataggggacctctcccaggaaaatgaggggtcctttctcaatccacagcaaagcccaggctctccctccccaccgccctctactcccggtctgggtggcaggagggcaccggagagccctggaattaccacctgcaccgggggtctagggggtgcacagtgtagcactgcggcccaccaggctagaaagaggggccaagtgatcataaaccaccacctcctagctccagctggctgagtcagtggaatgggattcctaaaccttggtgggtagcggatacctttgagcagaccatcatggaagttctgcccgaaagcgcaggtgggcgtccagaatgttcgagggggccccgaggcgcgaccatagatgggaggaaacactccaatccactggggtaggggcgctcgagaaatctgtagttgaacccttttacccatcaatttaattcaagattggaaagatgacagatctaaagtgccgtgcacaagcctcctgtctgacagacactgggaaccggttcatgttgggagaggcccactatgtgtcaagctgccgcccaggtccagaacataagcatggggggtgaactctcagaatcgcggcgccaggaactgcgtcccagagggtggaatttctgagagcgctgaggcttcctttccaacctcaggaactccgacggccttggttattctacaggcctagcgcacagaacgggctgctggcggaaggcagtgatgcctgtgccttttcggcagttccagaggcagcactcggcatcaggcggggccaccgggaggacggagcccactccgggaaccggccgcccctgcgcagcagctaccctgcgggcgggaggacgcgccgaggcgccctggccgccgcccaggggcaggtgcaggagcggcgcggcgggcgcgctcggggcgcgggtgccgggttgcgcaggcgggcgcggcagggaggggcgccggcctcgggagcccgacgccagggcgtggtgcaggtggcggcgggggcagagtcgacacagtaccttgattttcgatctggcgaccgggcgctgcttggtcgccaggtgtccatcggggccctcggcgtcgccgggctcgggggtttcgctctcgggggcgtgcggggacgagctgctctctgctcctccaggctcccccgcgctgctgctgccgctgccgctgctgctgccgccgtcgctgcggcagtcctcgggggggtcgtggagcaggcggcctaggcccactgtggagggaggggccgcgccccgacacacacactcggcgtcaacccgcacgcccgcggcagtttgacctgcgggcggtgctgccgccgccccgccccggacctgggcacctcgccaagtgggcaacgtcgcgggggaggccagtaagccccgaatcggcccacagagctagcttggggtgctcggagcctctttccggtcccagccaaggcgcccacgaggaaccgggcggccacgagcggcggaggaccccgcgcgccaagtttcctctcagggcgggggaggcggatctgacctctccccagctagccccagaagggttggcgagcctttgtgcacccccatgaggacgtgagattgggggtagcctctgctggctttcaatccctttcctgggccaccttggcccgcgctgcagccaacggtcccgccgccgggcaattagaggctcccactacggggaagggggcgcctagagtctggggcatcccagtccctcattgcctgccctaacccgcctagaagacccccgcgtgccccccggaagagggggatgaggtggggagcccgcccctgccgatgagcagagaagacccgccaccccttcccccaccccgggagcccagcgcccaggcccggcccccgcgcgcgctcacctgggatgtaggtgtctgcccttttctcatccgggagctcatcccagctgcggaccgagacccccaggctcctcctcttcaccaggaagactttgggcatggtggggtcccctctcccgactgcggccccctcctcccggctgctccccgctaggggcaacggcggcggctccgtccccggctcccggcggccagagcccaccttcccgcctcgcctgccctcttcctccaccccccgccgcggcgcggcccaggcctctcccccgcacgcctggcgactcccagcctcccggctcggcgacacctatgccttaaatcgcgagtgagaccacgccggggaaaa

SEQ ID NO: 420 - DNA, 32214 bp, Homo sapiens
  source 1..32214: mol_type = genomic DNA
tgcatgccaccagccatgggcttctttattgagcaccagattttcagtacaagttgccacagaaggagggtttcagattcaaccatgcccatgtgcaagggcgctggtccctggccagggcacataatcagagaagtgacgcggccatgccgaggtatacgtgtgtgcagaaatggacacatagggttcaggagcatcagtaactgactattgagatcatggtcttcttggaaggaataaatgtaaaaatgttgctcagccccacagagttggggtgactccacagggtgaaggcttggaggagtggcgtcttcagaggttctgccctgctcgttggttcagagaagcaaaaagatcaggcaacttgtagtacccaggatgttgtaaaaatcatagaacaccagaaccagaaaggaactccttcctatgatggcaagaagatgccttgccaagaccacataggaagaaaggagcagaacaggcctgggcccctctccctgcccttggctttgggcagccatggaggtgtccccaactgcccagacctttgggactgggcttcagaaagtctccccttagaacagcctctcaagaacttttatagaaaacaaaccgatctaatgagacgctgctcccagccagggcccagaaaccagggagtcatcacacattcatggcgctgcccaagaatggaagggcatcttgctagaagtcccacagaaagccacactggggccaggacagggcaactgcccagaagcccagacaggaacctacctgcagaggctgaaggtggcatcccataggctttatagagcaggtcgagaagctccctcttttcatcttctgggaggaaactagatttggccgcattgatgttctggaaaggccagaatggcagacaacatggaaccagagaacaaagaaggcagctcttagcaatgtagtgatagtccatcctcttcactcaacatgggcagatacgcttagagggggaaggatttgtccactgtcacacggcagcaagtgccagagtagagaccatgaggtcgtgttcttaatttgtcattacatgaaaaagggctgtgagaaggaagttggagaaacctttgagagacagggtggcatgtagggggccagagacacctcgcagacacgtgcaggaatggacttattcagcctgggatttaagaacaacctgaagagagtgtgcaagacttcatagctgctgcacacacctttctggggagagggttgacagctttcactggattctttaaaggcactcaacccaagcaaaggatcaaaaacctggtcctaggtcaggacgtcaacacaaagatgtcttctctgtggaaagtgtctaggttgggcttgtcttggactgttgaggcagactcactccctctctccaaagattccaggccccggactggacctgtagataccatactcccaaacccgagtcaaggccagtatggctcacacccactcaccagccttttaaactcctcttcagtaaagcccatgtcccgtttggtcatctggtaatcagtgtccagggtggacttgaagatgagcgggtcatctgtgttgagcgagtagttagcctggtcatttttgagcctgcagaagagggaggaggagagaatcagcctccttttactcttacataaatagtcagaacacattgacgttcacccgcctttgatcctcacagcagcctcaaacagatctgaaagatctgatccttgtgcagagggggaaataaattcagaacttaggtgacttgttcaagtctatgtaaccagaaagtccagaatccagcccatcctgaagaccagagctgggcaaaggcagcagaggggccagacatgggaaccaggcagaatggcagccggtgggggcgtgggggtgggagccaagaaagcaacatccccctccggctgccaccctctccagccttcccctctgcaccctaccctgcttgttcctcagtcccactgggagctggctactccaacataccatggaagctgttcttggcacgatccctgaccaccatcttgttgtatctaatggatctttcctagctctgaccataatcgacttgcatagcagaatttcacactgttgactgtttcttgaaaccttttccctggatttctgtgacaccacacttttgactttcctcctacttgtctcttttgctggtcccttaaataccattgtccttctgggttctatcctaggcccttcttgctccaccacctcctggggccactgcttctccttcagccaccatatctgtgcagatgactcctggatctttttccagcccatggtatacccacatgcctccaagaacctccacaggtgccacgtgtccctaaggcaagccccaagacccccttgtcatcagaacatcagagccgaagcccctccccttctcatatgcctggcagatggataagtgctggcctgaccatggtcaccctgagttcttgctgtccttgtcttggggaaggcggctttttcctaaggcctgatactgctcctgtggcttggcgacaggacggaaggagggccttgaccctggttagactccaggatgggagccaggcagggtggaacagaccctccggtggaaagcttcaagatggcgctcaggggaatgcccaggggtcccaagggccaggtgtcaggaagagagaacatgctggccagagggactcctgcttcctatgcgatgcccagggggcagagttgggagaattggaagtgtggaagcttccctcagagtaatggagcgttctgctccagctgatgagctgtagggccccagctctgctggttagcagctgggtaatcccagtcaagccacagcacatctgggcctcggattcctcatttgtaagatgaggacggcaatgcctgcttcccagggtgtcgaagagatttcatatctaaaagacgcggcatgggctgatgcccaatccctaaagtttcttccctctttggccttcctggaacaaaattgaacaggcccaggggaacagagctcaccgaatgactgcatgctccgtgtccggcttccaggcaccagtgaggtagctggaccaggggcagatctggaagagcaggtgtgtggctggcagggatggccccaggccatgctgattcctccccccatgtctgggcctggggccacccctcgagttcctgggacccgccctgctttctgcctctctatacaggaagttgggacagccggggatggttcctccccactccctggcccgcttacctcgaagtgcatgttttcctgccgcagcctgttataaagggcctggtcttccagggtgtggtagccgtgtcccagccgctctgtcttgagtatgtccacagcctgtagagaagcagaatagagccaagtatgggaggaggcagtgaggagggaccccatggccagcccaggccctcacctcttttactacttcggccgagcccacctccccggcgtggacagtacggtgaatgccgctcttcacagcctcctggaagggggagagccaggtcatgggtgccctagcgggagggccccggcaggccctgccttgaccatgctgtggagattgaaccatcctagtcatgctgcctgcttcaacagcatggggaaacctggtcttttaccctccaagtccttatctaagtggtagctgtcactcattagccagttaccatgtgtcaggtagtatatgaagtgacttgtatacattatctaatattcacaactattatcccacccattttatgatgaaggactgaagctcaggagattcaagtaatgtgaccaaggtcagacaggaagtgtggaaccaagctctgagcccgggcagtgggactccagagccctgacttctccaccatgctgcaccctccacaggaggcccattcatcatcacgctggaagcgacttttgagatgtcggctccaactcagtcatcccaatagaagaaacagaggcccagagaagacacagtgttgcccaggttcacacagcaaatcacagccagaagcaggctcagcacaggactcccaacaccaagtggaggcttttctttctctctcccttccttccttctttccttccttcctccctccctcccttcctctttttccttccttcctctctttctttctctttcttttctctttcttctttcttccttttttttttttttgagacagggtctccctctgtcacccaggctggagtgcagtcgcattatcacagctcactgcagctttgacttcctggactcaagcaattctcccacctcagcctcccaagtagctgggactacaggcatgcaccaccatgcctgactacttttttttgtatttgcagagatggatctcactatgttgccctggctggtctcaaactcctaggctcaagcaatcctcctgcctcgcctcccaaagtgctgggatcacaggcatgaaccaccacgcctggcccagggggattccagttccaagccttaagacccaacaaagacacacttcagaactcaggagacaccatggtccctggttcttgtgatttctcccaactatgggtgggagacaagctcacccagggccagcctctccattccttctcacaggacccacctggtaggcctggacatgtccaggcaagaggctgcttcctgggatggtctcatctccagccaggtcaatggctaccacggtctgctgctggtacttcttacacagctccaccaccttgggggaccagtctgtgggcgagatgcccacccaggctctgtcaccagcaccatggagagacctcccagcctacctgcctgctgtcccacccaaaccccccatgggaggccagcacaaaacagggctcagtgtcttcaaatcctaactgctatgtcctaaccacatggcctgcggaaaactgctctgcttatggcctcagtttccgcccttttcagaaagaaccctgccagctattgcacagggtcacggccaggctttgccgaggccatgtgtgtaaagcaccaaggacggggcctgagctcagtaaatgacacggacccttctctcacctggtgtttccaacaacactcatggtaggcttattcccatgcgcagatgaggaaacggaggaccgtttaacacgtcatctaaaatagaactcacactagtattgggaagtatctcgctaatgtattaggtactcttaaccaataaagttattctgaagtgtttaagaaagaatgaatgaacacaggctttggaactagatgtccccggatacaaatccagggtttgtgccttgcaagaggctgcacctcactccacctcagtttcctcatctgtcaaatgggactaagcaatggtagttctgctttgcaggctgctgcgaggattagaggaaatgcgtgcaggtagctctttggttcttactaatcctgagggtagaggaatgaagtaagtgtgatcatctccttgtgacagtgcacaactgaggtgtcttggtgcataaccagagcagcagtgtgacctgcccaatatcacacagtgaggctgtgcaccatgaggcacaaactctagagatctgatctgcgtcagtgacaagggagacccctcagaaatcttggaaatcagacctattcaggcccagacaggatggggcctggtccactgggtctcgagggaggactatgggctgatcagaatctagcctagatttttttttcaatagttacgttcctatttggtgttgagcttcctgcagggtggctataaaggcatggtgtccctggggagaacatctccagaagttctgagcctgcctaggaggtctccagttgtttcatgaagccccaagttcatgccagtgggctcaaggggacaccatggggctgtggggcacaggggagatcaggtacagccccactgctaggccaggaggtcagggccagggtgagacgggcggccctgggcagggcggtgatcctactcactgggctggtggcgcatgcagcacaggatggaccgggccttgaccccgaagtctcgctccccctcctgcaggccctggcccactagggccaccacctcgtctggggtgaggtcccctctgtgtgaggagaggagtagggatgggcctgaggcaaaaggaaggcctaaagggcagctctgggactgggacagaggaggaagaggaggctttggggaggaccctcctcccccactgacccactgcctcagaggaaagactggcagagatgcccccaggccctaacatgtccctctagctcttaaagcagctgggtgctcctagatcttagtgggaggtgtggggtgtcaacatggccctccccacccccagatggacagcattgctaagcttgggcctgccatgatgttcacattctatatgtatcagaatcatggctcagaaaatggggcagggtggttttgtgataccacttagagatccatgggggcccaggcagggggctagaaatgggccagactcacttcagttatgaagttagagcaggacctttagggcctttagagatctgatcagcatcagtgacaagggagacccctcagaaatcctgggtggctaagcaggttaacattcctggacagcaggcctgtggccagagcaagacacagccaaacacttgtgcccaaggtaagaacataacggcaaagggaggatgggaaccacgtctcttgtgacagagttaaacccatctttctgaggccatggaccagactgggggcaagaacaaggtcttgcttgggtcagggattcccagcagttcgcccttccagtctcagagctgagcctcccagccacaccctcagcatggccccttccaggcccatcactcactcagcctggttccaggggattggctccactttggagttggccagcaggtgcggactgtaccgcacctccacatacaccacgccctctttggccttcatctctacaaactcataggcgatccttttgatagcctcccggcagcccctgggaagggaagaaaggggttgggaacaaccttccccaagtcccttgggagctccaggagcaaatgacatccccaacccttggcagattaaacccacttcatcccccagacccaagctctgggcatccactggataagatcccagacactgggcaagtcctatcagctctactttggaactgcataccagttctcacccctccatcctggcctgaatcacgccatctctaactggcctccctgtctccatgcttgcccctgtcatcctgttctccacccagcagttggggcaatcttttaagaaggtaaatcaaagcatatcacttctcccctcgaagccccagtagcttcctgccacggagagtgacatcgcaactcccaggtcctgcccacaaggcctgcatcctccaggccttgccagcctccccagcaccttccttctccctcattccctgaggccaccggagaagacacaggcctgctcttccccgatactgtcctacactgcgtctctcccgctcccctggtttagagccagctgaagcttcacctcctcagagaggccttccctgaccaccttatcttttttttttttttttgagacagaatcttgctctgtcgcccaggctggagtgcagtggcgccatctcagctcactgcagcctctgcctcctgggttcaagtgattcgtctgcctcagcctcccaagtagctgggattacaggcgcatgccaccacgcccggctaattttttgtatttttagtagagacagcgtttcgctgtgttagccaggatggtctcgatctcctgacctcatgatccgcccacctcagcctcccaaagtgctggggatacaggcgtgagccactgtacctggcccagaccgccttatcttaaaacggcccctccaccattctcctgggctttctttttctcccaggtccttatcactactcaacattgtgtgtcatatggcttatcagccagtttgctgtattccctactagaatgcagtctccatgtggcaaggacccctctgtcttgggatggctgcgacctctcagctgaggaccatgcctaggacagagtagcccaatatttgttggtgatggagttaaggctggcagggaagagaaatgagagaaaaggacacagctggacaagtccagagggatgcctggatgtgggagacacgtgggatacagtcatggacttggatccttgtgcccacacttatctgctgtgtgacccctggttagtcaccctctgacacctaggtcaaggagttattgcggggacaaatgagtcaaacttcataaaccccacccgggtcagtgcttggagcagagcggacaaatgctcaaaacattttcgttgttattactgcatgtttgttccagaagcaaggcacaaattggcctgccagggccactgtgttgatcacgtaacggtggactgtgcttagctggaagttcccaccatgaagagtgaaaatgaagtggttactagaatgtgtgagggaaggcacacaagtgctgggagagcccagcgtgggaagaaagtgccctgcccaggggagatcaggccactctcaggagaaggggtcaccagaagttcttgcatcttcaggatgaggatggaggccaggcgcagtggctcacgcctgtaatcccagcattttgggaggccgaggcgggcagatcacctgaggtcaggaattcgagaccagcctggcaaacatagtaaaaccccatctctactaaaaatacaaaaccattagttgggtgtgatggtgggtgcctgtgatcccagctacttgggaggctaaagcaggagaatcccttaaactgggaggtggaggttgcagtgagctgagatcgcaccactgcacttcagcctgggcaacagagtgagactctgtctcaataaataaataaataaataaataaataaataaataaagcagtcatggaaatttctctctagtactcgcccataccccttctgggccttttcggtacctagtgctgttccctggcgactcaagacaagaaaaagaaaaagccttttggagaatcttccccacatctccccgcccccaccctatattcaggcctctcctcccctcacaacacgaagccctgaactaggagatagatggcccgggttcaagccctgcactgcctctgaccctgtgttcttagctcccatattctgccatttctctgtagaacttgaagcaatttcagtccatcacacccacatctcagaagggaaaactgaggcctaaaggcactggagagactcactaagtgtacacaatggtgagaaagacagctgtggtttcagagcaacttctctggcccccacaggctgagggacaggcctggtcctagtcatagggatcaatgctgccctaggacctgtgggttgggggcaactcacgcgatagcaggcatgtagtagtcaaacttggccaggaagtctggaagggtgagcggcttgtccatgccaatgacgttcagcagcccctctgctgtgttagctgggagggcgatccctctcctcctggaaacaaaacagtgagtggtggaccaacccggggcaggatccaggcaggcctgacaggccaggatggagcagactcaggagcgccagcctccttgcaggaccacagcaggagacatgggcgtctctcagtccagctgctcccactggacagatggggaaactgagaaccaggaccggaatttttccagcaccttctacccccaatgcacaagtcagcaaatctcaagggggataaacaggttgaagtgtgtgtgtgtgtgtgtgtgtatgtgtgcacacatgcacacaccccctccatatccttggttgactgatgcttggagacaaggaaagtgccaggtcaagttcatggcttcctcctcagccccaggagctggctcagccagctggtcctatgcccagtcaggggttatcaggggcagtaactgcagcatcacaattcccagggtaggggcaggcatcaggacttcaccctccatctggctggcacatcagaggcttgcccagcccagcgcactgggagagggccggtggaggctcaggggaggggcccagtgggccgccagccagctcagacctctctcccctccctgcccacagccgccacaccaagctggactacagcagcgctcagtaagagcgtgctggaaacagcccctctggcttggagcctccatttctccccaagcatctcggcctcccctcccagccacgggaagcagggtgcgagctcaggggggctccctctcttctgcacacgctcctgcctcctcatcccatcccggctctgctccagctcacaaggtcacctcgagcctcagtttccccccccttttttttttaagatacaacagccagagaacaccagacattaagaaatgcttctaggctgggcatggtggctcacgcctgtaatcccagcactttggcctcccaggccaaggtgcgaggatcatgaggtcaggagattgagactatcctggccaacatggtgaaaccccgtctctaccaaaaatacaaaaattagttgggtgtggtggtgtgtgcctgtaatcccagctactcaggaggctgaggcaggagaatcacttgaaccagggagtcagaggctgtggtgagccgagatcatgctactgcactccagcctggtgacagagcaagactctgtatcacaaaaaaaaaaagaaaaaaaaaagaaatgcttctaacatgagggacaaaacaacagaatagacaaaagcactccgaggaaacagcacagagaacagatgaaaacctaagaaccaaaacaaaaaagacatgaatatcctcaaagagatgagaagatccttgaaaggagggaacattcagaacccaagaacgagccctcggaaatttacaagagaatgcggcagcaactgtcacgatgtaagaaaagaactggaagctaaaagtgaagaaatcctccacaaagtagaacaaaaagacaagatgatgaaaaataggagtaaacagttaaggaaattagaagattaaatcaggaggtccaagcatccaattatccacaaagcagaagcagaaaaataggaggccgggtgcagtggctcatacctgtaatcacagtactttgggaagccaaggctggcggatcacttaagcccaggagtttgaaaccagcctgggcaacacagtgaaaccccttcaaaacaaaaattcaccaggcgtggtggcgtgcacctgtagtcccagctacttgggaggctaaggtgggaggaccacctgagcctggaagtcaaggctactgcgggccaagattgcaccactgcactccagcttgggtgacagagcaagaccctgtctcaaaaaaataaaaaagaataaaggaggaaagtgccaaagaaacagaagtttgaccaaatagtgttttagtgtatgtaagtaagtttgtaagtcctttaatagcttctgttactaaaatattaaaatgcttccctacataaatatgtttcctaagccccctgaatgtgctcccttccccatctgttagcccaagtccccatgagtgcccagagggtaccaccaaggggtcatgctggtgcccaccagcctgctagtcagcccctaatcactgctccttaccagcccctaatccctgtaagagcctgcaggggaacggtgccctggtgcggcattggcacctggaggtcggagctcagtgcctcaggtacccctgagactgcttcccctcccactgctggccagctgccccaaagtcaccctcacaaggccttgcccagtaactgtggccgctgaagagcctgtaccagttgtcaaacactgttggggatatcactctgggaactgctgggtagaaggcagggagatgacactagggctctggctcccatattgccaaacccagtggccacatttgcctgggacctgctgcgccagccatgtgcgattctcctaatggtctccctccagcccccagaactccacctgcgggggctctgccctctggtcgttctctctcagactctgccttttacacacctggccaggccaactcatctcctttggtggttttcagctccggatccagaggtccacagcttctaattctctatgcccatacaccaccactgagggcctgtgatgtgctgggcactgggcagatagcagtgaccaagacagacccatgtgtctggctacctgttgagaggcaggcatctcgcgccacctttcccctccctctagatcactcccttcctgggttccacatttccaaatacggctcctccatctacccagctgcccacaccagagacgggcgcctccccgtgcccagcaccagcccgtcccctagaacaaattattttgctttctatttctcctcttcgattcttcttctccagcctccctcctcaacaaccatcaagaaggaacttctcaacacagagtttagacagagcagccagggaaggcctctctgaggaggtgacatttcagcagaagccttggggtgggggcagttctgggcaggggaggggtctgtactaaagctgcaggcaggaagccgcgggcattggaagtgcagggtggctggaggtcagagagcaggcatttgtgcagatgatgcaccagggaggcagggccaggctgggcttaggaagggactggggctttggctgaaagcactgggaaggcactgtaggatttcaagcaggggactagcatgaaataatttacctttttgaaagctcctctggctgctgcgtgggaaacaaattggagggaagccagagctgaggccagagagctaatgtgggggcccgacaggagacaaagagcacaggggactcccagtgtctcccatgggacacagcttcccgaagctgctcagactgagctggaaagcgcccatctggagcccaaagttgaagcaggaaagagctgttcctagggccctggcacctcttgctgtccctggccacccacacaagcgaaggctcctcatagggccaccctctgttttttcttttgttttgtttttttgagacggagtcttgctcttgttgcccaggctggagtgcaatggcacgacctcgactcactgcaaccttcacctccctggttcaagtgattctcctgcctcagcctctcaagtagctgggattatagatgcccaccaccatgcctggctaattttttatatgtttagtagacacggggtttccccatgttggccacgctggtcttgaactcctgacctcaggtgatccacccgccttggcctcccaaagtgctgggattacaggcgtgagccaccatgcacgctctgttcttagatgatccctactccctggtcagccacagctgctgtgctggggcactgtctggtcctcttccggccttggtgggcaacacagtcacaagaagcccaccatcaggagcccagggagggagggaggatgagctcaggggttgcaggtcaagtccatctcccacccctatttaccacatcatcccaggcaggagcgctcccctctaaggcccttggtgcccttgtcagtaaaacataatattttccatgtaggggtgcacagaggaagaaatgaaactttgtgtgtcatgagaaagagcagactctgaagcccagtggtctgggtttgaatcccagctctgtgacttaaaggctgtgtgaccttgggcaagtaacccagactctctgtttcctaggtctggcatgtttgaaaaacatccagtgtggactaagcaaggagccttagagaggtcagagaggcaatgcaggctttgcagaactttaaggcccatgtgtggactttggctttgactctgagtgagatggggaagctggggaatgagctgggaagaccatgggttaaggctcttgctccaactacagcactgcagggcccgtagagaggaaggccagagtagatggctgagaccaatcaggaggccacagcaccagggaggggcagtggtggcccagaccagggcagtgatcggaggaaagagcagccagtttcagaatctctgtagaaatagttgacagggttataaacaagactgagaaagaggttggagaggcccctgaaaaggccagaatcctgggaactggaggaaggagaaatgggtgaggacagttaatgaggcaggcctgagtcccagagctggaaaaagggccactgaattgggcctagcagggctcaggccaggggctcccctcctccttccattcttagcccatatttgtgtgcatttacagacacccatatctgagtgtgacaaactccccagtcccctgcctgctgacttcaggccaagctccagctggcacctgccgcacgccatctccaaggcccagaggtggtgtgaggaatggacgatcagaccagtgcccctcccggcggctcctttcccctttctcttagccccacccggcgctcccagcccctggctgcagctgatgagccctccgtgaccccttaatgagtgcctgggttcgatctcatcttggtgccccactgaacgacctcattaggggccttgtggcaagttggcggcttgacatgggcaaaggccaggcagagataagccaagaggtttcaccccacttagagatataagctccaattaataagaatattatcattaagtgacatttatggagcacattaatgtgtgctaggccctgaactaagcattttacgggcgtcacttaccaaaacctctaactgacagggggtaatggccagggccatggactcgggggcagactatctgggttcaaacctccgccctgtgcttactgggcaccttactccacctaccacggctcagtctcctcatctgtaaatgacggcaatagagttcctatcttacaaattgttgtgaggcttcaataacttaacccgggtaacgcacttaaaggagtgtttggcacacaggaggtgctactgtgcttatgccttgcagttaaataggaattaaatcaatggcagcttcctggggcagaagaaggtccctggaagtgcgaaaagatggagaatagtggacttaccagaaatctctcagggagttggtggagatgctcccgagagttgggggcaaccccccgggatccctcattctctccatgagggcaggcctctgaataacaggattctggcttatggagcagaaatgttcaaatttgggtcccgagctgaatttcaagactgtgacagagaggctgagttctttcagctccaaacaaaatgagtgttgtgcaaacatccgaggaacacaggtctgcgggggcagggctgggtggacaaggagcccctagctcctaggtcatctctctagggagggcctgttcttagcctcagttgatagagaccaagttcgcagacaggagataatatgtccaaatttgaatccagatccactggcctttaaagtccctgcccttaaaagctggtcctaagagaggagctgctgtgagcccttgaggtctgggtaggaagggaagaaccttcctcgctggggaacagggggaccctctggccccctagcatctctgagagctgaggcaggaagtgtgttctcacttggaagatgcagagatttaggcccagagttggggagccacttttccgtgactcctagcaggttatgaccctgatgatgtagtaaagccttaggggtcagacagccttgggttcaactcttgatctgctattaatttgtgtgaccgtggacaactgtcttggctgagcccattccctcctcagtaaaatgcagagagcgtatcctcctcttccaagcgtggaggaattcaatgagctgataaagcccagcccagctctaggagatgctcaagaaattgtactggcatctcatgtgagcacatcacctgctatatataggctctcagttaagtcaaaagacaggagccaggcacagtggctcatgcctgtaatcccagcactgtgggaggccaagctgggtggatcacttgaggtcaggagttcgagaccagcctggccaacatgtgaaaccccatctccgctaaaaatacaaaaattagctggatgtggtggcatgtgcttgtaatcccagctactcaggaggctgaggcaggagaatcacttgaacccaggaggtggaggttgcagtgagccgagatcatgccactgcactccagcctgggcgacagagcaagactctatctcaaaagaaaaaaaaaaagacggattcagccctgggaactaccttcatgcacgtatgtgggtgggtggggagagcaggctcaggcctggctcacctgacaccaggaggacaagactcagaggcccagaaagctcaggagttggtctgcgggtctccagctcagtgctgaggcctccatgtcctcacagtcccacttctggcctggagctggcttgattcccacagggagacaggaaggaacagtgaccctggaattccccaggggcctctgggtggagctggggaccccactcaaatcccagggagagagggctcttctgtatggacttacctgccatagtataagatggtttcaggcttgatggatccgtctaggtggacatgcagttccacctgcaagggggcagggggaagagagagagaaagggagagagagaacaaatacctatgagttcacgaaggacctttcagagcttaatgttaacattaatcatgataaccattagccaccattttactggctggctgctgaccccatatacttcggtaaactctgtactgcactatctcatttaatccgctcctgggatgtgggttcagctgttatctcgatctctttcacaattgaggacactgaggttcggaggtgttaaatatctcatccaaggccacacagattgcaagtaatagaggcaggagcccaacccagtatctttgttcttaatcgcagctggtgagtggcagaggcggaattctaacccaagcccaattccaaagcttgtgctccaggtcacgtaggcagctcccgctctcagccaactaaataaactactttaacaaaagggattgacccagatgtcccaaactagggaagagtcacagcatatttcaaaattcaggatccattttcgttttcttttttttgagacggatggagtctcgctctgtctcccaggctggagtgcagtgacatgatctcctctcactgcaacctccacctcctgggttcaagcaattcttgtgcctcagcctccggagtagctgggactataggcaggtgccaccacgcccagttaatttttgtatttttagtagagacagggtttcaccatgttgctcaggctagtctcgaactcctgacctcaggtgtccacccacctcagcctcccaaagtgctgggattacaggtatgtgccaccgcaaccgacccaggctccattttcaaaagcagatgctactcaagcatagcctatcaggaatcaatattaggcaacggaagatctttctagtactctagagtttaagagtaggatccttggaggcagcccatctggcttgactcccagttctgctgtgtgacctcagacaagacacttgacctctctgagcctcagtttcctcaactgaaaaacaatggaatattatgcccccgtgtccaagaaaaattgtaaggattaaaaagggcagtgtaggtggacatggatagcccaaaggaaacagcccctgccgctcagtcagggtgtttaccatgagctgttaggagaagcacagcaggcagtgggagatggtggggaaagggactttgctgttcctgctgttcctgttccaaatgatggaagctttccccctagctaggggagatccagaaaactctcagctgacatctcatgctggggtggggagcatggagagctggataagaaagttggctgccctggctcagggaggaacagccaaggagctgctggcccaagggcgtctaggagcacatacatgagctgcctcctgcagaggaaacccaacccaggcccaggggaggccagcagggaacagagacaccagaggtcctatcagcaggacctcagagtcatcagatctctcctgaggtcatccagctggcaggggacagagcggtcttcacacccagtctcagggccaacttagttgttgaattccctgacaaaatgagttcagttcccacccagccaaacgtctgtttctcgggttctcaaaatatgctcagcattgggaatactgaagcttatagcccagggaacggccaaccagctgtgtgacctcaggcaagggacctcaactctctgagcctctgttttctatccttaaccctcacagggctatggagagggcccagccagagagccggagtcacactgtatagagcatcatgcggttagagctggaatctcggctcctccactcactccctgcttgaccctgagaaagtcacttcacttcctgtgcctcggcatcctcatctgttaagtggggagaatggcagtccttccttctaggcttcatgagggttaactgcattagtaggcagggagttcttggcacatagcaaatgctaaatagttgtcaactaaaagtcaatgaaggctgggcatgggggctcacgcctgtaatccagccactttgggaggccgaggtgggtggatcacctgaggccaggagtttgagaccagcctggccaacatggtgaaaccccatctctactaaaaatgcaaaaaattagccaggcgtggtggcgcacacctgtaatcccagctacttgggaggctgagacaggagaatcacctgaacctgggaggcagaggctgcagtgagccgagattacgccactgcactccagcctgggcgacaagagcgaaactgcatctcaaaaataaaaaataagaataaaataaaagtcaacgaaggcctgcgctcctgctggatgctagattgtagagttaaacaggagggtccaagtcctgttcctggggcttgtacaggccccagagtgggagaggcattaagcaaatgtcacatgggaaaatgtacagtcacaaaccaagacgactccttgggaagtacgaacacagtcctatgacagagggtaacaaacaagagaagtgaatacatctagagggccaacaatgagcctgagcgaaaagctagaggatagcgaggaacccacaacacaaggcaggggtgcggagggaggcaggaagaaaattccaggcagaaggaacagcatgtgcaaggccctatggcaggagaaaacggggtatatgaaatggattaaatagaggttcagagaagggagggttcatggtactggagaggctgcaggataggaccacccaggcagggctgtgcgggccacgaggagtcaggctttatctggaaagcacacagaggccattgcagggttggcagctggttagagaaagaggatggctcctccaaggccagttagaggctactgcagccatttgaaagatgacggtggcttggaccagggttgtgaggtgcatagaggaaaaacaggtggatagaaagagatgccaaggctcacacttcaggttaggcctgggtggggagcaattcccgcagtttgagacagagaactctggaagagaagaccaagtcctggagctccctccaggagggaggatgcgggggagggaggcatgattggtttggttttagttatgttacactagagacaccttttgttttttgtttttttaagacggagtttcactctgttgcccaggctggagtgcagtggctccagctcagctcacggaaacctccacctcccgggttcaagcgattctcctgcctcagcctcccgagtagttgggactacaggcacccaccaccatgcccagctaatttttgtatttttagtagagatggggtttcaccatattggccaggctggtcttgaactcctgacctcaagtgatctgcccacctcggcctcccaaagtgctggggttacaggtgtgaaccatcgtgcccagccaactggagatgcctttgagatatccaaaggtaagtggaagaacccagtgggatacaagagtctagagctggcctgagaagcccaagctgggaatgtaggtaggagtgtgggtaagcacagaagctgtgggcttgaaggagctcacctagggagaaaatatcaagggaggtaaggaaaaggcctaggatgaaactttgaccagcacaagcacttaatggccttacggaggaggctgagcctacagaactgtggccagagaggtgggagggtgtgtggtatgcagaaggccaggccgtcagatgtcaaggagaagcgagcaacggttcacagggttagcatagtgggctgaatggtggcccccacaaagctgtctacatgctaatcctaatccccagaacctgtaaatattaccttatatgggtcgggcgtggtggttcatgcctgtaatcccaacactttgggaggctgaggtgggtggatcacttgaggttaggagttcaacaccagcctggccaacatggtgaaatcccctctctattaaaaatacaaaaatcagccaggcatggtggcatgcacctgtagtcccagctactcaggagactgaggtaggagaatcatttgaacctgggaggcggaggttgcagtgagccgagattgagccactagcactccagcctgggcaacagagcaatactccctctcaaaaaaaaaatattaacttatggcgggtggatcacctgaggtcaggagttcgagaccagcctggccaacatggtgaaaccccatgtctactaaaaatacaaaagttagctgggcatggtggcaggtacctataatcccagctactcaggaggctgaggcaggagaattgcttgaacctgggggcagagattccagtgagccgagattaaatcactttactccagcctgggtgaaagtgcaaaactccacctcaaaaaaaaaaaaaaaattaccttatatggcaaagtgtgattattaaatgtcttgacaggaagagtttatcctggattatctggttgggccctagatgcaatcacatgtatccttataagacagaagcagagagttttaagagaaacacacacaagaggaagcagcaacgtgacctcagaggcagagactggaatgatgcagccacaagccaaggaatgcctagagccaccagcaaccagaagaggcaaggaatggattcccccgagagccttcagtgggcatgtggctctgatgatatcttgatgttggacttctggcccccagaactgccagggcacacgtttctgttggttgaagccatgcagggtgtggcaacttgtcacggcagccacagaaaactcacatggtcaggccctgctggaggtcacaggatggaagggcagaaacttgtccgtcgggctaaaagcgcaggcactgggggcttcagaggagtagttcttaaccccggctgcaagttaggagcacgggaagttctggccagttcccaaggcctcaaccccatctgaggtcaattaaagaaaaatccttggtggcaggcccaggtggaggactttttttaaaaaaacacgtagtcaagattgggaaccactgccgtagaggaaccgttctagaggcctgagtgagggtagaatccacatgggaataaggtaagaaagaagtggaggtaagaagaggaagaaggtttagactactctttcacaattttgcccctaaaggaactagcagccttggagggggcaggacgtgcatgtgggtcaagagaatggcaggctttttcaaaggggcatgtcttgggcaagtttaaacacccatggggatgattgaggctgagtgaaaggagttgcatgaggttactgggaaggtaggaggaagtcagaaagtcagaaggtcaaaccaggcctggccttggagcccctgagaacaggaggatcaggcagtgaatgggggcggtagtcacgtccgcttgtgggtgggactggtggggggaggtctgcatggctacttctggctaaagtatttattcatttatttatttgttgttgttgtttttttttttttgagatggagtctggctctgttgcccaggctggagtgcagtggcaagatctcagctcattgcagcctctgcctcccaggttcaagggattctcgtgcctcagcctcccaagtagctgggattacaggcgcccaccaccatgcccggctaatttttgtacttttagtagagacagggtttcaccatgttggccaggctggttttgaactcctgacctcaggtgatccacccacctaggcctcccaaagtgttatgattacaggcgtgagctgccttaccctgcctggcaaaagtatttaaatgccaattcaagagcccacctcccagctctgctttactctggcacaacaattggcaatgttcagagtggaatcttcccatctgcctggggccctgagtgatccaaggagccgaaacctcactggaggccctggagggacaagcagtatgaggtcaacctgggtctctgcagacccctcagacctgggggctgtttgttaccacagcagcacaaggtagcctctcctgcctcagaatgagcaaacacacctttctgaactcagccttgcaaactgtgataagaagcagaccaagtgctatgagataaagaaaaatcacactggggtgggggcaatttagaaagtgtgttgggaaaagatcacttaaagggggagttcgccagggagaagaaagaaggagagggagaatggctccaggcaggggagctgcgtgtgcttagtgtctgaatcaggaagcaggcggggagttggccagagtgcagagtgaggttagtggtgagaaatgaggccagggcaaagtggagagggggcagggagattgcagaggccgaagcaaagggttttccacccaagtgtgttaaatcggagagtcccctttaaaaaaacctttcccggctgctgtgtggaggacaggatggcaggaagccagaacagaagaccagctactgcgggagggaagatctgattgggatttgaataacatgcgggaagtactcaaggcagcgtcagagacagtgggtgctcagcggggcagaagccagacagtgccggggtgcagaagctaggggttcagggagctgggcaggaggcaggagcgcctctgggaagggggaaagcagagccagctgcccaccatgaccagtagcactcatcccttctcacggctgcctgagaagaggcccagacgcgtttcaggtgtggagcagaggcaggaagccacctccacaggtggctcaagctcaggcaggcctcctactgaattttctagaaaactgcaacacaccatgggaagtctgtcagcctattccagatgacaatgacaatggggtggcgaccccgctctcctgtctcctttcagggaaaagggtcagcagtggcctcaaacttttgagtatctactatgtgctagaccatctatatgcattatcttatttcatccttacaaccagcaaggtagagacttcactcccattttactgatgaagaaactgaggttcaaagaagtaccccaaaacagtcagtgatggagtcagaatttgaaccctagtctgattcttgagctcctaaccactctactgtactgcctctgtgggcctagcctcagacatcaataatacagaaataataataatgataaagcagctacctactgttttcagaccctttatctcatttaatccctaggcaatgtacatatcggcccatgttacagatggggaaatggacttgccaggctaagcccggagaagttcagtggcctgtccagagttacacaaaattgatggtggtagagctagggtggaactcaagtccctctgcctcagcccaagccctgcccacaggccacaccccctccctggcactcatgtcgagacagtgcctggcctcctgacctctccagaggggaatctcacgccccttcccactgcctttgctctctgcaaggctgactcacagccagcccagcatttgtctgaacagcaggaaatcctcccagcgctgatgtgaacaggaagcatcctcagttaccaacaaatatttactaagccccactatgtgccaggcaccgtggaggccctcgggaaatgcactaagtccctgctctcaagagatgcgtgccagagaggtccagggcggtgggttcacttacccaaggtcactcagtgtgtcggtggcagagctaccatgaggacccaggtcttggactcctgggacagatactcccagatctgactcatgtttccacgttcccaactgctggagggcgagcagggccgtctacctccaaggcaaacctagtcagattagttctccctggtgagccttggggacaactaatctgactgggtttaccttggaggtagacgccctgctcgcctccggcagttgggtttgcctcccaaacacatcgctctgttttgttttcgtctgactttttgggttcatgtatgtaacatgtctgtctccctcatgagccgtttgctgagaggggggaccttgtctgtgtcatcatgtcgtgtcctcagcacctcgcacagcacctagtgctctctgtgttcaatgaccacaccgttatttcctcgtttccctgtcccatgtcagcaatgctgggtgctctccctgcaacaaggaaggggctgacctgcccccatgggacctggcagaacccacacgggggcagaggagccagggctgcctggtcagctcacagaacctgagcaccgtggccagaacccagatgagccacaggtgcccactgccaatcgaatgtcccctccctccctagccctgcttttggtgatgagctgggcagtgccagggtcagtgacttatgccactatggcctctcaactgacttttagtgtgaggccaggagacagagcagccctgggctgagaaactgtttcagctccacttcctccaggaagccctctatgctcagcctcatctaggctccgccagctccgaggtacacagtggaagggactgagcagtccccacagtgtctcctgctgacggggcctgacagctctgctgctgagaggtttcacagaaggcaagatgtgtcttccacctggggaaattcctgtggagccacagcatagggactcagcacacttaaactcgttttaaaggcaacaagactgaggctcagagagtgggaggaccttgagttagaaagtctaatgcataccacagccaggaagctatttgactctaaacccggaggtctagcagcacgctccctgcatgccacatagcaaggtgctgggtcactgatgctaacatctaaacaggggccaggtgcggtggctcactcttgaaatcccagcactttgggaggctgaggtgggtggatcacttgaggccaggagtttgagacctcctcttcacagaggtggaagggaggaccagcgggggcaagtgtatcccaagtcccagctacttgggaggctgaggcaggaggatcgcatgaacccaggaggcagaggttgcagtgagccaaaatcgtgccactgcactccagcttgggtgacagaggaagactccagctcaaaaaaaaaaaaaaaaaaaaagtcactgaagtcacctggtacccaggactacttcaaggacagccattgttatggccaacatggtgaaaccctgtctctactaaaaacacaaaaattagccaggcatggtggcgcacacctgtaatcccaactacttgggagactgaggcagaagaatcacttgaacccgggaggcagaggttgtagtgagccgagattgcaccactgcactccagcctgggcgacagagtgagactctgtctcaaaagtcaaagtaggaccattaccaaccatgatgatgatgctgaccaatggcagctattgctgcagcacctgctctgagccaggcctgcacttggtgtttgagaggtgggtatgggtataattctcattttagagaggggaaactgaggcaccgtgaagttaaatgactcattcaagctcctctagctggaaagtgggaaatcaggactcagacccagagagcctgaccccagctggtgtccaagttcaaattccttgctgttctagctccctggtcactaggagtgcagaggttatcccccacaactgctcaggggcctgagaacattaagggctgagggcaagcctacccccaacaccttgggtaaatacagattccaacctcactctgcgcccacagcctgctcctctccacctccccagccagaccatggtcctactaccttgccccgccccagggggtaccacagggaccccttcaagacacctgagcaggtggacaagtctctcctggatcacagggcccccagccacccaggtcaagcccaccctgaggttgaatgcaggattgggaagctgcctggcctcccctgcctccctgtgtgaacacagaccacttcctctctctgatcctcccttcctcctccgaagcaaaaggcttcgatgaaactcagtctcctttgttcccctccaccaccaactgccatgtgagtcaaaatgggtaaggcaggctcttcctaggcacatttttgttttaacaggtggctctggtaactgaaagccactgcaagcccaaagaagtgcagctggtgggttttgtgtcaggaagacaaaaaggaggagggaggagggagattctgcagctggagaggcctcccagagtctactgcaacccccactccagtccccaggaaggaaacgcacccctgagggcctgctgttaccagccaggcactgtacaaaaaccaatcagcatgtcagtttccccaagaaccccaagatcttggttttgtcaccccattttacagagggggaagctgagtttcaggagttgtctacctgaggtaccctagctgctaagcggcaggcaggaattcaaccccagtacatctgaagcccagggctaatgcactggcccaccctgccaccctgattctaactcttccccccacactgccccctcttttttgcataaagtggaattggcaaatgagcaaagcaatgaacagcttctacttgagtgcaggcagatctgggttcaagtctagctctgctgcttgccagctgtgtgactttggcaagttccctcccctctctgagtctcagtttcctcataataagtgaagttaataataggacaggaccttcctcagagggctgacataaacattaaatgagtcactgtatgcaaagcaggacagcgcctcgtgcagagtagacattcaaatatgagacagaaaaggcacattgctgatttagccccaattcccctctgcatcagagagggacagtttagaaactgctgtcccttggccgggtgcggtggctcatgcctgtaatcccggcactttgggaggctgaggtgggcggatcacctgaagtcgggagttcgagaccagcctggccaacaaggagaaaccccgtctctactaaaaatacaaaaaattagccgggcatggtggtgcatgcctgtaattccagctacttgggaggctgaggcagaagaatcacttgaacctgggaggcgaaggttgcagtgagccgaggtcgtgccattgcactccagcctgggcaacaagagcgaaactctgtctaaaaaaagaaaaaaagaaagaaactgctgtcccagcctgtacctgttcacttgccagtctacagcttcaaggctctcagattttgtgtagccctggcaagtccctccactccctaagcttcagtttcttcatctgtaaatggggatgaagacccatgccttgtcaagtcgtccagaggattccgtgagataaaagttactagccgggcacagtggctcacacctgtaatcccagcgctttgggaagccaaggtgggaggatcacctgagatcaggagttcgagaccagctggctaacgtggtgaaaccctgtctctactaaaaatacaaaaattagccgggcgtggtggtggacgcctgtaatcccagctactccggaggctgaggcagaagaatggcttgaactcgggaggtggaggttgtagtgagccaggatcacaccactgcactccagcctgggcaacagagtgagactgcggcacacgcctgtagtcccagctacttgggaggctgaggcaggaggatcgcatgaacccaggaggcagaggttgcagggacccaaaatcttgccactgcactccagcttgggcgacagagtgagattctggcaaaaaagaaaaagtcactgaaggcacctggtacccaggactacttcaaggacagctattgttatgattattgtaacaggcatgtgatcagcactggcctccaggatgcagaatgcctgagtgcctggtgccacctgtgaacataggctgataagggccacccctgcaacccccctttccacttcttccagtgcccagcaggtgctaagtcaaaccaggtgggggtatgggaggcacacccgacagggcaaacttgacttgggcatcccctgacgatgaccctgcatggcaggcacacttgaatgggtgttcagagttctgagcgaaggaatccaagagtggccaacctggagatccagtcgttatctatgaggaacatctgagccccaccccattcccacgggacactgaccatacaggggtatagggaccgaggccctttgttttgggttaaatgaaggttactaggtggagatggttgggagaaggtgttaaatgaaaatgctacataaactgcatgatttgcaagtggttgcggttcttctgctcagtctgccgccactggactctcttccctgtgtctaagcccccagtaaaaccccgtatcttgtttgctacctcttccaaagaaggtagcctcttgaacctggtgctatatccattggagtcaataggggtcccgcacaacagaaggcagctgcctagggccttgctaagcaaagtgtgttcctggatcgttgacattagcatttcctgggagctggtcagcagtgcagcatcgcaggccccaacccgacccacacagaatcacagtgtgaacattaaaagtcaggccacttgagtgcagtttgaaaagcgctgccctgctctgctttcttctagctgaccaggtcccaggcctcagctggtggcaggtatgagaagctgaaggacacagcaaaggctcctgtctcaggaggtttgcacctggggcactggcacctctatccccaaaggcttctgcagaggtagtttaggaaagatggttagaggcatgggatttcgaagccagcctcccttggactcaaaccccagattggacatttcctagctgtgtgatcttgggcctagttaacctctctgtgcctggattaaataaaaaatgcagataatgtgtttagaacggtgcctggcacagaaacatcaacactccattagctgcagctagtaatgctaataattataactgtcatctgtccctcccacaagagggcagggagctggctctggtcacagtggctctgagattcacactccttcccacttctcctgccagctcacacaagttcctcctcacaatcatacaagatttgtcacgcctcaaacacatggcaggtaacattctaccttcactctcaagcatcaccttgtggccttgggactcaggacacgggacacccacataagcagctgatgttccatcctccaggtgtggacactgaggtcccaatagggaaaatgatctgccagcttgaatcagatgggaggactgagcaaggccaaaaaatggggataataatatgagcccctcccttgatgggctgttacagaagaactgcaaggatccaatgggtgtctgcaacaagtgctctagaagtgggccctgctgttctctccataactcccaacatgttcgcaatcaaggagcctttttttttttttttttttttttgagacagcgtctcactctgtcacccaggctggagtgcaatggcgagatctcggctcactgcaagctccacctcctgggtttatgccattctcctgcctcagccttctgcgtagctgggactacaggcgcccgccaccatgcccagctaattttttatatttttagtagaaatggggttttgccatgttggccaggctggtctcgaactcctggcctcatgatccacccacctttgcctcccaaagtgctgggattataggcgtgagccactgcaccccgccaatcaaagagctttgctattgccataggattcacatcagggtacagtgggtccccagcccaagggcagagggagcccagagcatttaataaaaagactgcaaaggggaggcgccaatcatgggccccagctccagtaagacgtgaaggaggcaggggtgggggtaggagggcttgtacagcacctcagtgcttccagcttctgacggggagtagctgagcattttccctgggctgggggcatcagtagtgggggccaggcctcaccctcctcagaaggtaggtgggctctccacagcctgtctccctcactgacacatgcacactcactggattctcaccggcacttttgtgatagctgtcatcatcattcacacctatttcttttcttttctttttcttctcttttttttgagacagggtctcgctctgtctcccaggctgaagtgcagtggcaccatcacacctcactgcagcctcaacctcctgggctcaagcgatcctcccgcctcagcctcctgagtagctgggactacgggagtgcaccaccacacacacttcccctaactttttttattttttggagagacggggtctagttttgttgtccaggctagtctcaaactcctggactcaaatgatcctcccgcctcagcctcacaaagtgctgggattacaggcgtgagccaacctcctgggccactcacacctatttcttagaagggtaagttgaggctgactgcagctgactccttccccaaccactctcacaccctactggctgactcaccctgcttggcagactcctgggcccctcctctcggactctgcgacaggccaagggggtccagaccctccctgaccccaacagtcccaagacgccacagctggtgggcggagaaacaaggggattctcccctggggccagtggccatggcttggcctcgagtgaaccctgctagggccccaaacccagggcctacctagctcctgttcttcccgcgcgggggaaggggggtgctctgctcccctccctcccctttctggcagggctcacggttcttccccggggcgcatccacaaacctgagctccttggcgctcaccaccataacgctggcgtacaaagctgcttccattcactgagcactcagtaggcgccgggcacagcactaggtgcctatccggcgtagacatcgggcctgatcatacagctgagcttcagagacctcaagtccctgcccaggcccacacagcgctcagcggtgctaggatgcccacttgacagacagcgaaactgagacccagaggggtcaagtcaggggcagaagcagactctggaggcctccgggttctggaccttctctgccccattgtccctgattagcccgcaagcaagccacggcctaagccgaaggaagaactcgcctgcaggagcccccgttcgttcccagggtttggacgccccgggctgggccccgctaagcccctcgggccgcccaggcgccggacccccgtccccggagcccccgcgcgcgctcactttgggcttgtcgaaggcgggcgtctgggccatggtgccctcgtgcgccccggcgctgctccctccgccgccgctcggtgggtctctgccggctcggtggccgctcggctttccctggggccagcggtggccgcggccggccacgctcttcttaacgggcc

SEQ ID NO: 421 - DNA, 103571 bp, Homo sapiens
  source 1..103571: mol_type = genomic DNA
gacaatgcattttttctcatttattcaaattcactgcaggaagtaaacactaaaagattaaaaaacaaaacaaaaaaattcacactgcagtatgtacagtttcatgacatcacatgaagaaattaaatttctaataaaaatggcaaattatattactgagcagatcgcatcaaatttggttgtgtaaacaccagaattcttactatgaatggtaatgtgcctatattccagtattgctaatactgggatactcttggaataatgtttgcaatgggattaaaaaattcatgaaagtagttgtgtgaattctttatgtttaaaagtggttgacgattaaaaaaattctttaagacccttcgaatcaaagcacattctttcacaaagcttaaaccacagacgtcatgtccagaaatggaatactgtcatgttaggatgaacatctgatctgatttgttaagacattttgccaaatgcacagatgcacagggtcccccatgcacttttcatgcagcaggtaatcacaacttaaataaaaggtttattctatacatttgtccagacttgcaactgtatacatacatgcacaacttttaaacctgtctgattatatttacacttatacatggaatatacaggaaccaaagagattaaaaggcttttctgttgcattagaacaatacaaaatatgtatttttcattaaggaaatcactatttacatcacctttaaaaaccgattttaacatcttcatgtaacaagtcaatatatatatatatacatattatatatatatatatatatatatatataaaatatatactctcaccagtttactcttctgtaagatgcagcagagaataaacaggtaatgaatgctaccttactgatgtcaataagctgtagtaccctttcacaaatgactttattagaagaaattgtctagatatctaaaatagtccttgaaaatgtgtatatgtgcatccttgtatctacatatgcataaacaaagtgaatctgtggatgtatgccctttctcactgttctttaaaatcaccctaaattcaaattgggaacattctctagtaaatcagaacagcattcttcgtggtcatgtttatttaagtattacatattctcattcctttgttaacaacaacgaaaacaaccagccaaccaaaaaaacaaaacaaaacccacacacacacacacaaaagtagcaatgctggcccttggtcttttccctgacctaaatttcactctcttgtaaaaaggtcatttccccctacccaagggagaataccaacatattttttctgacatacctctaaggctccaaaccttccacaacgatcaagaaaaatgacttgtttaaaagcttatttatatagtgttgacaataagattgtcatagtatggacatggaatagaatatattcaactggccagtggaattttatgtcagaataagcctatgccttcacttctccatgatgttgcataatacccactcctattactgtataatatttccagtagctatttacaaatcattctgaggaaaaataaccatttagggttttagatcatattaggaaatcacacctatttttaatataaaaatcttagaaaccacttcaagtagaacaattttaaatcaatatcctaactagtagtgattatagaataatttttgataggtcatttgctaacctggttcacaattaagaacaaaatatctggtgaatgaattgtggattgtacaaactgaacataaaaacagacctgtttcgcaactgaaaccccatgtggcttcactaatatattaatttcttctaagacagtatcaacatgtacttttcatcactactttaaagtaaaagatccaatggagtgattgtgtacaattctgtcacgtatatgtgccctttgtactttttatttagtcaatctgagtttagtgcccttcttgggtttaaactaaatgttgtaagctttgttggcattgttcttaggacaatggttttaataaaggttaaggatgcattcaggagaagtttccaaaccatcctggaatcacctgagtttggtaagtggccctgtttttccatccctaaggctaactaagtagatgttactcattagaacacacaaataatcacagattttcctgagatgttgagccagatatgaaagttatcccctccacccaatttttgtcataaaaagtgttctgaacccgatttccaaagacataacggtaatatatgaactacaatattgcaaattttgagctgatgtgtgactgtattggggaaaatagaggcatcacatagttttttgtttttgttttacagtctcatgttctgaggaaagtcataagtcatggttctcaaacacaagaaacacctagagagcatgttaagatgcagatggaagattccaggtccacttagcagagattcttgttctgtagatctgagatgctgcctatgaatctgcattttaaaacaagtgctccagatggttctaatgcaagtggtctgagttcaggtttaaggaatcctggtcataacactcgcaggtaccacaggaatggtgagaattaacttttacaagagatggtgaaaactgtccaaagaaaagccattttgcttctgttaaaaacaatttcttaaatattcaacttttcaggaaaccacctaaagataaatgttaacttttctaattctgtaaaaggaggagtattaatttagtaaagtagttaaaatacaaaaaatggaaatctgccttttttttaaaggatctatcaaacttccctcaattgtaatcaatttttactaagtagcacaaggtttaaagaaatatatattgaaaaggatcagggtgggacagacacattgggaaccacaaaacctcttccaagagttaaaaataaacaccttttttttttctttttagcaaaagtgaaaaatgtaagcatatatttttctaatttatttttgaattggataataagctgtgaatcagcactaggtttttttttattggataattatcctttaaagagttgtttaacagtttagactttaaaaatgtgttatgtaggctgacttctgaaaagcaaaataaagtaccctaataaaggcagcaaaatgcattaatccactatgaatggagttttacattttaatttatgcctaatatttataaaagaatttcattcataggctactcacagttgttatctgatgcatacagaagtgttaaacaaccaattgctagttcagtagtttcctcatgacatctaatgttaagcaaaaattagtatgcatatttcaacatcaccagtaaccaatacttttcaaaatgaaaaaagtttcaattataccatgctttttttcaaatcatgctcttatttatacagatctcaagttcatactcattagttttaaaaagatccaaaactggatggcaggtacattttattctgattctttctttatcgttagcacgcttcccagaagtccataaacttctccatttgcgctgtgtgggcgagaagcattatttcccatatggctattgtaagggcttcttaaattaaagaaagaagctttcgtttctgcagtaggaagtaactcttctttggctgtgacctgtgagacactttcagcagatgaagcctccctccaaatgtccttgtcttgtgtttctcgactggtaacagaattgcctcctttttgaagcatgtaatatagtattgggttggttttggtcaatcttggagagtctttttcatactcattcttctccgcatcagtgataacccacttaatgggtcctttctcactgggcatggaacacccattcaaaagcccagattctggtctagaccctgcacagcccaagtgctcagggaaagtaggactcacaggagtttttactacacctgggtatgaaaatgtcctgttatccatgcaactgctgggctgagtggaactgtacatcagtccatttaaagaagaaatgctaaattcaggtttgctgttggtcacattatttttgtgtcctttctttttactgtcagccacagagttacttctgtgcggggacaaatctcgcacacagttttctgagagaagcagctgtttcagaacattaaagcttttgctctctctggcccaactcctgtgttcactttcgctggctgagccatgaccagcaggatatttaaattcaagatcatttctgctaaatttcagctcttcctggttaagcaaggacccatacagtacttctggggcactgtgattgtttgcagcatcaacaatgttgtttttcatctttttaaatggattttctaatggctcagtataaagcttccttttcttagggaccatgcaaagattctttgattctagaagtgccatttcattatttctgtgactcctgtctgaatcatctgccaggtaactatcttgattttgtcttagcaatcgacttagcagaccattcttggagaaagaaaaatcctgaggtgaaacaggctccgatttaaagtcttcggacactggtaaggcaggtgcgcttctctgcacagcaggagccatacccaagaatggggcactcttagcatcatggctcaagtgcacatttgtgttaggaatttgtaagtcatcacaaggctcagattttattttcaccatcagtatttgttcacttaaagctctctctgagtgttcctgagtactttcatctcttaagggagttttctcttttttttcactcttccctttgttggggttccccaggagcaactggaggacagtacgtctttcaagcagattttctatttcagaaccagaaagccctggttcaggacctgttggttgactactaaatgctttattttcttcaactgcatttgttttatttgagagcaaagggctatttaatctatcaatcatacctatcggtttatctgtgtttccagttaacagctgtttgctgggtctctgctcttccactgacatggatgactgcattccacattgtgctaaattttgtaacagcttactggcactaaacgttgcagagttctgtgcaccttcattttgggctggtttctctcctggtgggtctttgctttttgtaaggtccattgagtggttagatgcagtatttgttagcttttcagactgagtactgcagacatatggtggggaattccatttgatgaccagagagtgttgagagagattgatgggagaccctgctttgcttgatgtaagtaaaggtggagtgctcactggagtagtccgatttgtactggggctttctatcacagaagtccttgcataattttgtgtattgaacttgctcacatcattgtgtactccctgagggctggtgtttttttctacattttcttcattcttatggccaagtagcaattgaagaagtgttactttctggtgtgagtttagcttagaattctttgaggtatcttgatcttctttgatatctacatctgggacttttggatcccaagtgtttagcaaggattgagtgaagttatccagggaaacaggttggtcagattctgatttttcagttcggtgtttgcaagacaagtctatgggaacacagttggaataagaactttcatcaccactgctgtcatctgtaaaactaggattgttatctgaatattcatcaatagttgtaggtgtactactttcctcaaaaatgcttcctctctcactgtgactgtgtccattcattggcttaggtatagtctggcttttaagaagatgtaaaagcaaactattgttagcagcttgttttatattgtttctttccagtgagttcttataacctgcatttttaggggaagaaggaatgatacccattggattttgaaacactgtagcactacttttgctagccatcagtttgcttgatgatgttcttgcctgaccattaagatggcttgacattccttttgggagctggtaactgccaacatccttctggccattttcttgcaatctggccatagcagcaagtctttcacttgctgcttgatttgcattttgcgtttttaaagcgtgttctcgagaatactgctgcaaatgggcttcgcttgacagaagtaatgctaactggctacaagcaacactaggtttaggtgaggtggcaggactagcccttttttccaccatgcttgcaacagcctgtaatcttgcagcacatgacaacggttcactcatgacctttgttccactttgtccaacatgatgaggagactctgcaaacctatctctgatgaggtttttagtcacatcaggaagattcgtatcaggcttttgatctttaactttacttttcttcaacaaagtttttaagtgacttgatgcaacaccatagcaccttaaatccttctccacttttaaagaatcatgactgagggcatatccttgctccttgaggctctgcctgatttgttgtgacagagcaacagtctgcagcctagagctgaatgactgaagcaaagaggccagtaatgtgctatcctgtttgcctttaggcacactgtcaaccatgccagctagcaaagcttccttctttacgtttaaattcatgatagaatcagacagcctcttccgctttgctgcattccagtcctcagaagactgcaacagtctggcttttttgaggtgcagcatgccagacccctgatatgtatgtgtattgagaactggaccattactttgacaggtgggaaatgcactgccagaaatgttaaagttctgatcctcttcattatgcccagcagactttttgtcaacggcagtacctgatccccctgctgcctgatgcattagtaatccttctaggtaagttaaaacaatagaatcctggtgcacatcagagccaagctcttctccatgagtcatgttcaatagaagtgttcacaagggcttggtttctattcactttaaagaatggttttctgtggtgagtgcgatgtaactttaataaaggagtatcagtttatcaccttccatcgcaatcagagagagacgtactgttacattctgtccaagatttcttctggcaatgacaagataaatgcagtctgaccacagtgctgatcaacttctacgcaaggaggaggagaagaattccttaacacataggtctgtagcagtaagcagatagaatccttagtgaatatattccttttccttcttcatcttttgttccccattaaatgcaaatatcagtgttctaaaaaaaataaaaataagaatagttaaggaggcagaactagaatcacgttatgatacctacaagcaaaataatatagcatctgtaaatgtatatatatattacatataaataatagacatataaatggattatagtcactttagtaatttgttttattgccgttcctattcaattgaaaatgtctactggaaatcctgtgggttaatgcatactgttaaaatgatcaaatcattagagaagagaacatactttaatgttacatagccatcttccaaagccgccaagtctctgaattttcataagcacctttctgcaaagtaatgtgaatgttcagtctcctttatagctttatagctctacaggggaactagaacttgcttccttacattactgggcacttaggaagaaacaaaagtagatgtgcagaaaaaggaaaagagatgcagactctgatgagtctgatgtggggttgaggccaacagaacagattcatttctgacatcatcccccaaacaccagacattccataagtaatttttagaatttccgttttcaaaaaaatgaaaccactaacaagttgaagattattttgtgagtctgttcaaagtgtgaccatcttaatcatattcataaacattaaaatacagtcataaacttacctacccatactttttaccatgacttattaaagacagagaggagtgattctttagatgcttgttcagggctatcaagggtttaatgtagttcgttagtaaatccttactcatgtgctctatggagaagtcttaatgtcaggtccattccttacagatacagaagacagggagggcataaacatatataaaaagtacaatggagaatgccaaagacattttagtcacagtttgaaaaatattccaatgatatttattatctaagaagagaccaaaaaatttcctatcactaacacatacacaacagaagaagcaagaactcattgcatttctgaaaacttgataggtaagtgtcaaaattgacctaaggaaggggggccatgacacctttggaagagaagctggaataaattccatgcagtttgtttttcaagatgccagaacattttgtttaagttatcagacctgaagctatcaacaaataccttggtccctatggaatttaaaagataaattttaattgaaagactaccctgtagctttttaagtacaatgcttaactctaagtcaaactttaggaaataattatctgattgtatcaaattgttgaatttattgattaaaaggataagaaatgatagccaaagaaaaagatacagaaaggaggcagcaacaattaatttcaactgtgtaaggagtaggatgagaagagactttcttgagattccaatgccaccattttaagaagctttgccataatgtacttaagatggatattttaagaggttaataatgatatagaaatgaaatggttatcatgactgccaccaaatatccattctcccattttcatttactaataaaaccctgacttgtttttcagggagtagggaggtatcccagctaaacactacttttctcccccctctggttatattttacaattgatggcatgttgcttaattggaggcttatttttctttcttagtggtataaaacatacgggtacattttacaactgataacatcttggagttgaggaaacccagttttctaattctctcaaaaaacttaatatggccaggtacggtggctcacacctgtaatcccagcaatttaggaggccgaggtgggtggatcgcctgaggtcaggagtttgagaccaacctgaccaaaatggtgaaaccccatctctagtaaaaatacaaaaattagccgggtatggtggcatgcgcctgtagtcccagctactcaggaggctgaggcagaagaattgcttgaacctggtaggcagaggttgcagtgagccgagatcgtgccactgcactccagcctgggtgacagaatgacactctatctcaaaacaaacaaaacaaaaataacaactgctaatatacaattaattctcaactagttaagacatttaacaaccatttaatgggatatgcaagtccactgtatttctctccacaccactgccaacctttttgctcttgggtagactcaagaaagtcaaaatcataccagtcatttgaaaactggtttgtaaacagccataaaacatactttatttaagaataagaatgaaataaggagcatctttgagttcatattactcctgttattgctttctactttttactgtgcatgatataatttgcaaagtattattcattgctttaaaaagactgaatttacacatttctgaatttacaaagcagatttggaagttgatttaaaaaggaattatcacagtttccttgtaaaggagctctaacactgtattttaccatttatttacctctctaccatttatttcctatcttcacagagaaagtagatgacagatattaagaataatcatctcttaataatccattttttggcaatcagctttctcaggttgaaaatcatttcttacatatgaaaacaatttttaacttcaagaacgaaaatgacatatacaaataattttattaagctccttgggtctgaggactgtgctaattataattactacagtgcaacacagtcaacagataactgaaccttgggatacattaagttattcaatgaccaaattcccagtaggaaggaagggaatttgacattcaaacacacacattctctcactctcaaaaaatatatagatgagatactaaaataattcgaatcacaaatttgaaaccacacactgtagttcatcacttgaaggaatcacgaggagaaggtcattctaaatattcaattgtttatttcatttaaatcaatacaacatattcttactgaactcccaatctgcttcaagatctgtcttaggattggtgaattatgttcatttttaaaaagggatgtgatagacaacatctagagaaacaggcaaggtgaacatccacctttaagtttctagaacatctctaataataaaaatatcttctcctcatgctacttcttttcacattttcacatgactcttatatcaccaagcacaaaaaaattaaaaaatgtgatatgaaaaatcttccaaagattgttttaagatttttaaatgaaaactataaaacaaacatttttagttcagaaaatgtggttaccatagtatggataaaagtcactatgtgtatgcactaagctttcacactttcttctagagaagtggaccagtaacacatttagaatagatttaaaaggaagatgaataattgcttccaaaatattctaagtcaaggcagttatttttcattaatttctttgaaaaaaatcctataaaacgtaccaattacatgaagtagtggagaaaaaggattttcttatggagacctgttttttaaatgagataaatctgtaaatcaaagattgtggtcacgtggagaggctgcctcaggtgacacagcagcaacacctaccactgttctagcagaaaatgaagtgtctatcctaggaaagcaggaattcttacaccccttaaggcctgaacgcacttagctccttctattgaaagctcttcagggagcagagtgagccaaatttctttagatatcttccttttctatctcttaaactagagagggagaaatcactaacaatccttctcacctttcccaatccttgccttttcatttctatagtatagaatataattgagaaatatagcaaaaaaagaaaatgaggcacgatactaaatagtacagcttgttgggacctatggatttagggtattaaggtaaaatatgaccactacctaataaatagacgttttaaggttaaaatgttattttaagttattcaatattagcttaactcattttcttttagtgaaagacaaccacattattcatgaaattccaacatatagttctcttgcctggttttatataaatataacttaagaatgttgccaggtgtattcttgagtatatttagttaccaatacctaaaagtcaacacacatttaataattaggtttctttagagcagcagtccccaacctttttggcaccagagactggtttcatggaagataatttttgcatggagtagcggggtggagatggtttcaagatgaaactgttccacctcagatcatcaggcattagattcttataaacagtggggaacctagatccctcacatgtgcagtttacactagggttcgcacttctatgagaatctaatgctgccaccgatgtgacaggaggcggagctcaggcggtaatgcttgctggcccactgctcaccgcctgctgtgtggcccagttcctaacaggcttggcctgggggttgggaacccctgcttcagagaattgcaattaatgtatattttgaaactggaattgtttataaaatattgaatcctctggtttgttattttcttaattttgatggtgatttcattagagcttgtgcatgtgtctatttaaagttattaaacatttgcatcacagtaagggagagactttacttgtatggtatatacttgttaaataacttctaagtaaagaaaacagaacttttctagaatttggcttatggcggatgagaagaaccaaaggaagtaaaaatactaaagggacagaaaaagaaaaaaaaaagggaaaaatactaagaacaaataaaggcatcatgaattctgcaactctcatgaggtgccagaaggaaaaacttagtttacaaactaagtagattatattactagcctgcctttaaacattaggttggtagatatgacatgcaaagtgaagaaacatcttttatgaacactaaaaatgcatatatacaacgagaaaaaagtaaaacctacacaataatagaataaaagctaactcagtgatgtttgtttcaacttggctgtcatttttatagagtggttccataaaattttgaggaaaaaatggttaattttaacaaaaaatttagtataacattcaggataccaagaagtactaaattttgatttcagtattatcgtcttaagtgaaaatcagctcgcataattttttttttttttttgagacaagttctcattctgttgcccaggctggactgcagtggtgagatcacagctcactgcagcctcagcctcctggactcaagggattctcccacctcagtctcccaagcagccgggaatacaggtgtgtgccaccatgcagagctgattttttttttttttttttcctgtggagatggggatctcacaatgttgccaaggctcatcttgaactcttagcctcaagtggtcctcctgccttagcctctcaaagtgctgggattacaggcgtgaaccaccacacctggctcttttacaattttagttcattttaaccctcagtacaccaagaaaaacagtcatcatcatttatcatctgggtccaaaagacattttattaatatttaagttaattcatgaataatttacacaataagaataaagaaatgacacaaaacaacttcactgattttttttcataagaatttaaacataacattgtaattcaattcttcattccctgttttcctggttttgaaggagtatatatctgaaaaggacaaggcgctttgaaactgacagctcatcaacaggttcatggatgaacctggaaatatttataaatattgattccagatttcaggtatgtgtttaaaaggactcttgggtcttcttcttgtacttgaagaattcaaaatgtgttacttttgataattttaatagctcataatgatgttgaaaagatgacagaaatttctgcttcgtaattgcccaatatatttcatttttagactaacagcaattacaatgatcaatccaatgaattacttcatttctgtatcatctctttctttacaatctcctctatcaaacacctgccttaagtatctgtccacttacgaacagtgtcaaataaatttggtgttccaaaaatcataaaagatgaaagaatactgtcacacaccctttgaagaaaacagagccattgaagtttttgccacaaaacacttgagtgttgaataccgagcaatgcagtctttcctaatgaataactaactgtatgaaaatactatacttactttttgtcctgagaactgtatttttgaactatattgttactcattgctccctgtgtttgagaaaattcacctggctgggcgcagtggctcatgcctgtaacttcagcactttcagaggctgaggcaggatgaatgcttgagcccaggagttcgagaccagcctgggcaacatggcgagaccccatctttacaaaaacattaaaaaaaaaatagctgggtgtgatgttatcagcctgcagtttcagctacttgggaggctgaggtgggaggatcacctgagtctggggaagtcaaggctgcagtaagccatgatagcacctgtgcactttagcctgggtgacagagcaagaccctgtggaaagaaagaacaggaaggacgaatggatggaaggaaggaaacattcatctaggatgtatctgaagacaacagtcagtggtattgcttatataatcaatagcaccataatcattcacatgtaaagtattagcatcagtttttttccattcatcttctggtttatctaagtgaaatatcttcgtttgtcaactttcctctttgacattacagacagaaaaatactgaatcatcaatttttaataaaaacttaaaacaaaagggaaagactataaagacagtgtctccagatgttttatttttatttttttacattcttgaaagataatgtagtataatgggctctaagaaaactgaagatggggctgggtacggtggctagcctgtaatcctagcactttggaaggctgaggtgggaggatcactggagcccaggagtttgaggttacagtgagctatgactgagttactgtacaccgcattctagcctgcgtgacagaataagacactatttctttaaaaaaaaaaaaaaaaaaggaaggaaggaagggagagagagagagaaagaaagaaagggaggggaggggaggaatagaatgacggtaaaacagtgatgatttcagtattgcctcatccttctagacacttccgttatttttactttttattattttagccttttttttaaaggacagttgggaataaataataaattcattgccaaaatggtaaaatgccaaaatacttaaagatacagaaaaaataagatcactaagattccatatgtacttttgacttctaaaaggttccaatggacatatatagtaacagcaaggtactatgtttgagtctattaaggacacattcattaaaacttcaaaaatgtggtattatccttcctaccacttacaaatatattttttaaaaaagcatttgaaaactaaaactgagtccaaagaaccctgatagtataccaaaggttaatgtatttcatgataataaaattcatgtccaactacttaacaatgttaaaattataaacagaatcttccttttattaatttaaaattgtttataagcataaaaatcctttaaagtttataaagttaagattttactgatctacatcatgtggtggaaaaaatcattgtggtgaaaaagaattattttagaaagtaataaaatcaaactaaaccatgaaaaaattccatggaatcttcaccatatgcgtagattgatttggggaaagatctaagtttcaacacaaactagtttaatgaaatatctaataaaatgcttgaattacacagtatattttaaaaagagctacatttacttttttttataagtatctgaaaagtacagaactaagtgataggtaatttttttagagctttttaaataaaagacagtagtaaatactgtgcatactaacagttcacaaatgggtgctatattgattctctaaaatagctaaactattttcattgcaatatgttttacattttctgtttggaaatggtttattaaacaaagggaaactttgtggaacttctacacactttaaaatgataaaatccaagtgataaaattttacttagttaaatgaagaatgcatctggcagaattcttacatgtaggactatttttggttgagaatagagaaataatgacaacggtctttctccagctgtttttaaggattcagtatcttacttgcaattaaatactccattaaaaacacatttaaatgattaaacatctacgagttcacttggtatgccatttaaattatatctaaggactacctcatgacttccaattgtgtccatgagatctcccccaatttgttctgcaatatcaagtaatacctatttgagtactgaatttaaagggatttctacaatgcagctttgaccattaggacacttggctttgcctggttcctcaaaatgcgtaagtaatcaaagggctacttaattatgtcattcaagaataactcctaatggacaatattattatctatattccactgtggataatttcaggggtatttttatacaaatggtaagaaaaacattaatatgtttcattaaacattagaagaaaaatatctaagtacatactaagaagattccaaagtcctaattattgactcttttatttaaaaaaaatacagatccaggtattcggagaactctcgttgttctccaaagcagggctttgaaaggaagttttaaaagctgaatgagaaacactaagccaaaaacaatttaccaacaggatgtaactccaaacattttatccgaagggatgaaagtagctttccaaaccaagggccaatgaaaagttaaaatacgtaaaacccaacacttaatttcacataaaaagaaaggaaaagtaacattttaggtatgggtcccgaagtttcatttaagaagacaacagtgaatcctctattatcaattaaaaagtcactggaaaaaacatttaaaaaggaataaaagaaacattcaagtgttgacatttcacagcagggaataataagacaataaaagaatatgcctgaagtttcatttcttaaaatatatttctaattacttgaaaaaaatgaatcaaaattaatatatgtcttttaagggaatctgaattccaagataataactttctttgaagtattatctttatgaaaaggtagatgtgtggtcatacaatttaacagatgccaaaaataattatctaaatacattttgctcaactgagggcctcaacatttgaaatgagaactgaggagtttcttgctctctcccaggggttctcattttaggtgcagatactcctcagagacaggtggcatggacaccagagacaccggtgacgaaaacagctgcccaggctgctctccactgcaacctgaaggacttaattttttggcccaaggccaaatttgctcctaacttctaggtccattggctttaacttgctcgtcagctgcttccataggagtaaaatagtgtcattcacattcccaactaaaaaagactcattagagacactcctgcgggagtaactcaagcattcaacgcaaggacacatgtatatgaggacccctctaaatctaaaattttattcctatgattccaagtaatttgtcaaattatagctgatgaaaatgacaagcattttaacgagaaagatgatatgctgtcataaagttgtggaaatagccctgaccaatatgttttactgtcttttcaataaattccgggggaaggaaatggttttgaaatagccacacactcaacccacctaatgccccaaaaggtatctatgttcacaactttcttctgtagggtcacagaattgcaaacagatgtttatttaaaagctaaatatgagcttatattcaaattggaacttttgcttatctcataacagctatatactgaataaaatggaggataatcacaaagatttaagatctttgatgacacaaataaaagagacagatgaaataaccgttctggtgacagaaagaaacaccccataattgatacggcaaaataaagaagggcttctttgttttgaattctcctcagaaggcctaggtatatgaatcggattcaataaatttgctattcattttacactgcctctatagttaatcttaaaaacatttaatttttaaacaaaattaagatgaaaaagttggagattttaagttaaaaatcaaagatctagacaaaggagctagagaaagagctaaactgccaaacaatttctatttcaaaaacacaatacatttctggatgctgtacttcactctgtcttgaaaatactgacactggaaaattgttaaataaagttaattttacctacaatttttaaagctccagaaaactattacatgacagacagtacatacctatttatgattagtactaatgtctattcactaccttctactgttatcaaagaaacaatagtttttcttaatgaacacaaaataatcattaacaaattattttggcagcacataagtataagaaaagagtgtaaatacaaaattaacagagagtgtttgcttctcacctttctcaacagctctttggagtaactggtgctttctatcagttttcaagagcataatattttccaatctctatcaaaataagaaatgtaatggaaaatggatctttcttcttctggaattgcttgagtgtttatagtatatatgcagggatatcctttgagatgggagcatcaatcctactaaactcaactatggtttccccatccctaaaatagatttgacatacagacacaagcacaaggtcaaggtcacagatcagcaagaaagattaccaacagaactgatgtaaccagctggcttttgatcaaagctcctagggtttttagtacacttagacactctgcacttacccacatagtatatactctgttttaaaaatgttccccatctttgaagtcaagatcttcatgcacttcttattataaagtatgttttgttaaatatattgcattggatcaagaataagaggagaaaccagtatgtttgttttttttaatagcgacggggttttaccttcttggccaggcttgtcttgaactcctgacctcgtgatccacctgccttggcctcccaaagtgctgggattacaggtgtgagccactgcacccggccagaattgtgaatttttatgtgtttgtgtgcctgtatatatatatgcttgcacttttatttgtttgcttgttataactgatcattgccatgtgacaattttaaaattaacttaacttgcagttccctgaatagataatgctctctcataattccaagcttttgacccatctgaaactgaaattagtagtatgctctgcaatgccttgggtcacttgttcccaaaaacacagacttaacttgtaagtcactgcttcaacaaaagaagttttataatttatccatagtcttccacaacaattttcaaatcacagggatcaaaagaaactttagttatcaacaatgacaaaaacaaaaagtgattcttaaaggaatatattattaaatatattagtgcaggctagatgtggtggctcaacctgtaatcccagcactctgggaggctgaggcgggaggagttcaagaccagcctggccaacatggtgaaatcctgtctctactaaaaatacaaaaattaggtggacacagtggcatgagcctgtaatcccagctactcaggaggctgaggcacgagaatcgcttaaacctggaaggcggaggttgcagtgagccaagatcgcactattgcactccagctgggtgacagagcgagactccgtatcaaaataaaataaaataaaataaaaataaaataaatacatacatatatgcaattatctaacaaaatcatgccttttgttttagctgtttaaacaagatgttaaatttattttaagttacatttatgaaaccaagagttatgtgatcaatgttcttactgaagcattctggtcaagaaatcattttgaaggatgcataaagctgttggggtaaatttacactataaaagctttccttgctaaatcaagtaccacctgctgtagctttatacaatttgcaaactacttatgctatatgtacatgtaaatgttctcaattagtggtttttcatatttttgataaattaaatacctttgcatgaaaataacccaaaatttactatcctagaaagattgctagtttttcaaaaataaagtaaaaaagaaaaattatgtcaaattatcaaattaaatactattgaaatgacttatatgacatcactctagtcattacaggctccaaacacaaagatatctagatagaagtttccagtcaagctgtggaagagaaatatcactacagacacaattcatgagcacccagacatggtggtgatacctgtgaagagtcaataaatctgactaggtcccatcctacaggattaaggaatcaaaaccaaaaatactacatgcacaatgtacctgcagaaattctatgtctttaaattttcacaggtaacattaaagtatgtctgtcaacttggaaaatgaagctaccagcacaccatcagcaggccacttacttactttaaatggttttatttatttttattgaagaaactgcggtgcgtgctttaccctgatctcttatttgcccatctatccatacaaccaagtgtttgaagtactaatctcaggaacaatagccagtaaatgctaatctgagaaccagttctgctgttgtccaggtttagggcacgttctgcctgtgcagcagggacagtgacacatgctccttggcatggcacctgccactcatagtcagatacagacccaggttggggagactcaggaggctttagaggatgactccggtgtgctgaggagacagaggcagattagcggtctagggaatgtgggtcagggcttttgtgatttcaattgttggaccaaaaatgtttcagaacaacttttctcttaacaataaagaacattaaaaacaactacttacttcctactattagcatcatttaataaaattaaatcactttaacactgaaaactaaaatctttaatgaaaatctctcatcatttttctgttgctttttgtcttgagatagaatgatgtgtggaatagtacatatatactatattgatctcttcactatttagtagttcatttgatttttttttttttttttgagacagagtcttgctctgtcacccaggttggaatgcagcagcgccatctcagctcagcacaacctccgactccccaggatcaagcgatcctcctacctcagcatcctgagcagctgggaccacaggcacacaccaccatgcctgactaacttttgatttttgtagggacgggttttaccatattgcccagggtggtctcaagctcctgggctcaagagatcctcctgccttggcctcccaaagtgttgagattacaggcatgagccacgatgctcggtcctagttcattcaactcttaagttacttaaatctttacatcagaatttcccactgtttatattttgctttgtgttttggtctttcccttgatttcaattatcacatttatataaaatatataatttgttctatagaaattcttgtcattaaacaagaggttataaataagacagcaggggagaaacagggcagtaagaagaataaagaaccttctgcttagtgcccttccccccatatcatccttaccatcctcatcttttgaggaaaaatacatcagacttaaaaatgcatacagaatcctgtaataagccccatttgtttacagtcaagctaaacaactaggacatttctttcattctgtaagtctcagctgacaactcatcctctctttaggcagccttcactgaactccatagcctgagggtagttgttcctctctgtgactccacggcactcagtagatctttcaatcatcttgcttacaaaactgtacggtcacacgtcattttattgtgctttgcttcattgtactttgccattattgtggggtttttttttgttttttttttgttttttttttttacaatctaaggatttgtggcaattctgttgaggaagtctattggtaccacttttccaacagcatgtgcccactttgtagctctatgtctcatttaggtatttctcacaatatttcaagctttttcattattattctatctgctacggtgatgtgtgatctttggtgttactattataattgttttggggtgccatgaactgtgcccatatcacagcatacttaataaatatgtatgttctgattgctccaccacttagctgttcccatctctctccctctcctcagtcctttttattgcctgagacacaacaatattgaaattagatcaattaataaccctacaatggcctctgtgtgttttgcatgtctcacactttaaatcaaaagctagaaatgattaagcttagtgaggaaggatgttgaaagccaagacaggccaaaagctcagcctcttgcaccagttaaccaaattgcaaatacaaaaaaaaaaaacaattattgtaggaaattaaaaatgtcactccagtgaacacatgaatgataagaaaacaaaacaaccttattgctgacatacagaaagcttttgtggtctggatttaagatcaaaccagctattacattcccttaaaccaaagcctaatccagagcaaggccctaactctcttcaattctatgaagactgagagaggtgaggaagcggcagaggtggctcatacgatttaagggagaaaacaataaaactgcaaagggaagcagcaaatgctgacagaaaagctcagcaagaaaagccagaagatccagctgagtgagataaatgatgaaggtggttacactaaacaacagattttcaatagagacaaaacagccttaaattggaagaagattccatctagaaatttcatagctagagagaggtcaatatctggcttcaaagcttcaaaggaaagactgactctcttggtaaaggctgatgaagctggaacttgaggttgaagccaatgctcatataccattccaaaaatcctaaacccttaaaaatgacgataaatctactctgcctttgctacataaatggaacaacaaagcctggaggaaagcacatctgtttacaccatgatttgctgaatattttaagcccgctgttgggacctactggacaaaaacaaaaattcctttcaaaatattacaggccatgtacctgtacactaagagctctgctgcagttgtacaaggagattaatgttgtttttatgcctgctaacacaacatccattctgcagctcatggatcaaagagtaattttgacttcatatcttattggaaaaacacattttctaaggctttagctgtcatcaaaagtgattcctctgattggatctgggcagagtcaactgaaaagcttctgaaaaggattcaccattctagatgtcattaagaacattcatgattcatgaggggaggtcaaatatcaacatttgcaacttcatggatgactttgaggaattcaagacttcagtggaagaagcaactgcagatgtggtagaaaaagcaaaagaactagaagtgagcctaaagatgtgggtaaatttctgtaacctcataataaaacataaatgaatgaggagttgttgcgggtttttttttttttttcaactcctgagctcaagtgatcctcccacatcggcctcccaaagtgcagggattacaggcatgagccactacaccgagcctgaggagttgcttcttacacatgtgtaaagaaagcagtttcttgagatggaatctactctggtgaagagactgtgaacactgttgaaaaaacaacaaaggatttagaatattctgtaaatataaacttagtagataaagcagtaggaggtttgagaggattgactctttttgaaagaagttctcctgtgggtaaaatgctatcatcaaacagcaacacatgctacagagaaatattccatgaaaggatgtcagtcaacgtggcgaatttcattgttgtcttattttaagaaatcattacagagaccccaaccttcagcaacctccccctgattcttcggcagccatcaacatggaggcaaggcctctaccagaagaaagattatagttctctgaaggttcagaggatcattagtatttttttagctataaggtatttttaagttaaggtatgcacattatttttagacataatgctatggcacacttaacagactacagtatagtgtaaacgtaacttttatatggactgaaaaaccaaaaaatgtgcttgctttactgaggtattcatttcactgcagtgtctggaattgaacctgcaatatctctgaggtatgcttgtgttttggttcgttaaggcctggttccccatgagagtataaactccttatgggcaagaattatgtctttttcatctttacatcttagcacctagcagaggcagcattcctagtagaacatgctgtaaacagcaagtaaaccttttggagccttggtctgcaaaataaggagtgggctgtcataattctatggaaataggagaattaaaatgatatgacaatgttatttaaaatgatggtttcagatccaatatatctttttccctggaatataaattaataaaaaggcacaaaattaaagaataaaaaagtattttatcctacagagagttctgtgggtttagaaaacatgcgtgactaatattatggtagaaaacccacaagatttaagccagctatctatcatctatcatctggttttaaactcctgacctcaagtgatccacccgcctcggccccccaaagtgctggaattaccagtgtgagccaccatgcctggcaaagtattttaaaaatatacatatttttagagtattttaaagtttttgtaagatgatctttattttaccacttgtttatgaagaactgatcatactaatttggtttcttttagttgctgtttcccatgtcaaggttagtaagatctggtatggatttaggttatatcaagaatgagtatatgcttcaaaataccagttccatcaagcttttcatcatttttccttttcaaattacctcccctagataaagatgaaaacccagttaacattaaaatactactttgttacattttcttttgatggagatattaagaaatgaagtatcacatcaaaagatttagtctctaaaaccagacattcattctaaaaaataagttacaatgaaataggcaaagtaagcctttatgcaagaaaggctttttatttatttatttttttacagtatcaaccacaattaaactatttctctgtgcccattttaaaaatcaatcattgaagcagataataattatatgccaaagaatttgagccctttaaatgtgtgataaagattaaatcaaattggtcaaagctattcttggaatgatctttttaatttgaatctgtatttgttgaagagcttcaagtatgaatgttcaatgaatatggctaaataaaaacagtatcttaactaaagtgattaattatgaaaaaagtagtgaaattcccttttaaataactgaaacctgaaaaactaaaaaccaattcaacaacaacaaccattacccaaataagtcttgaatactgatgcaagacgactcacgtgtcattgccacggctttcaactttttaccatattagcatgttaccattagtagaaacataaaatcaagacaaatcactcctttgacctctttcaaagagtttcagatccactctcgccttatggcataatattaaactttaataacatttctcaggtctgagaaggctaaaaagtcatgtgggtccagaaaagatctcactttgctgtgaatgggtaagatttagaaacctagtgttctaaaatgcatagttaagacactcttttatttaggcaattgtttaggtatttgttttaaatatatgacacatcaaatcaaatttccttgtctataattagaaaacggagatttttggcatatattttattcatttgaactaacgacttaaactaaacttacaaacatcttatccttcataataccagattacacaaatttaaagaacttgtatccaattggaagggcagctaatttttatgaggtgaaatctattttcctctaataattttgccactggctactgttttcataatagcatggcatgtaaagtaattctccaaacatgacagaatcataatttaaaggttgggaggcagttgaaaagtcatctgcctaatcaatcatcctgtctgatgcttaatcccctttataacccatttgctatctctggatatctagcttatttctaaaaacctctagtgaccatgaactatcttccaaggtggtcttttggagacggatggctctgggttcaatttattccggctctaccatttaccaactctttgatcataggaaagttggctactcttgaaagtttatcattattaaacgtgcaaaagcactaatacctgtttcatagagcccctgggctgaacaaatgtggtaatgctcacatagcctagccacagagtcgctgctcagtaagagttccttgcgtaactccaacagtatgaaattctgccttgcactgagctataatctgttgagttttagtctgactattggtctttttggggacacaaaaaacaaggctaatccatcagttacctttcaaacattagaaacctgctgccaggttccactgaccaggtctgtcaccttgttaaggccaagataagatagtgaaaacccattgttgacaggggcttagcaaagggcaatcaaaggaagacaaatgttcctggggccagtctgtggtgggtgctgcagagatgcaattctttacaaattcttgactggccaaaacagtgtataaaacctcctgggagctcttgtcactgaccgttgattcctacaaagtgtattttacattttaaaagccctgctttatcacaggtgctttaagccatactcacccttcctcgaatgaaatactaggatagagttgtctttgattctcctcacggggttggttaatacattatttatcctcattcccatgttaccagggcactaaagctcagaacaactgagtggttggttaattatccagtaaatgcctgatccaaaaccacgtcaaggtcttctggaacacagtctttcctatcatattcaattgccacagactgtaacaaatgtggatttgaaaacttttcgtaaagcaaaatttatgcagcactctgagaattctggattacttttcccactctaaaatcttgtctctgccagtgtcagtctcttgcttttattaggaaggccacaaagcattgtggtgaaaagaacagtctctggattcctgactctgctattcagtagtgggtcactttggtggatttacttaactgttccgaggctcagttttttcagctgtaaaaggaataataatagtatttaccttataaaactgttgtattaaataaaaggtacatgtaaaacagtataatatctcacattttctaagcactcaatgaatgttaattgttttactattcacagacaaagcttcagcccagagaactttctcaaacaaaattttttttgacttactagtcaccctatataaagctccttgaggcttaggattgtcttttgtctttagatagatagatagatagatagatagatagatagacagacagatagatagataatatagatagatagtatatatatatgtgtgtgtgtgtgtgtgtatatatatatatatatcctgaaaaactaaagaaaaagcatttggatctgtaaaataatttaataatctaggtaattaattctttcactcataattttgtgtgacaggtttacttaaagcaaaaagtaatttcatatacaaaagatgcatataatttcttccttacctaaacctttttcttaagaacctatacccaaaccacagacctcaggagaatggaacaacactgggaacctaactaatggaccaatcatttcctctcttgacatctggaattcagagggagacagaaagcttcattttggagtggacttcatgaggccacatttcagattagtgcctagaggagtcagtattctgagagaaaagattgaagtaagcacacagagagaagcagagatgagggaggcaaaacgaggagaggagaggagaggagagggaagggacagcagggaggtgctgaatgaatggctttccagcttcaggaggggcaaagtactccgatcaccaggttcctgaagagttcgctgcatgcctctaacaagtcctcctgtacctgagctttgttgaggggcttctgttccctgtaatcacaccacccctaagatactgcagtaacattatgtaagacaaactgcacattttaatccatggtcctgaagaactctgcaaacgctcttttttctcacttttcctatggtgcctttacctcacgtatggtcaaagagcaacatgtggctctgaatttcaaatggggaaagctaacagcacaaagaggtaaataagatgtccaaggtcatacttacagtttgtaggggcggaaccaacaacagaatttcatatttcttattccgaggggcctgcactaaccaataaaccaactgcctcccttgatgaaactaaagtatgccaattatccaaactgtgtaggaaacgttgaccaaaacaggggttaattggacattggttgttttaattccataatcagctccttccctgagctaccctgggagtgaataacatatctttcacaggaatgggaaggaagccagcataggccatctggctgaacatgtcctttcctcaagttatccctgcagctgtgtgaaacttaactgatgttgaagaactttacagtttaatttgctttatcatgttccctctattccattaaaattaaaagtagacaaatctttatgttcatattagccaagcagtttccctgactccaaagtcatggaatatacatgaacatatatagtctatgtgtgtgtggaggtgaggaggaggggagcctgaaatttttggatatcaagaaacacgtttcatattcaaaaagaacaattcatttagactagggccactagaaaataaacaaaaacttgtcattttcacatgaaaatgaaactaaaatactggtcttattaatcatgaaaaaaaaagaaacatgaaagagaataggtagcttatttccttgcccattttccccacttctcctactttgtaaatttgtaaatatgacaataaatctagactattaagtggaagagtatttcctaatgaatactctagaatcagatgtgcatccgtcaagtgggttcagtcacgattctagcgccactagcctaagagctgctccagaaggtgagcatgtactctttccctctcaacaattctctcttcctgcctccctccacccctcctcttacatggtttattttcttcttttctccatcttttatttctcaagtttgaatgtatttctacctgtcttactcatgaacattgctggcattcagatactgatataatgccaccatattccttatgctgggaactgtgtactagggagggccggggtgggttacttttaagcaatgcaaatactaatgcccaagtttgggtcagactagggctgtccaagccctagatgatgagccttgagcaaggttgaagagacttgagtaaggatgagaattaatgaggcagtgtagagggaatgtcttttcccaatacaaaatttaggtactatgactattaactagaagaaggtaagagccagagggcaacagtaagaaacagccaagaggtaatgaaatcttaaaagagatgctggtgttcaagctatatgtgtgaacagacatggaaaatgaattcctaaagtgaaactctaatgcaaagactgggtggatggttatgttgaagttggccagcaaacaaagaccagatggttctccctcagagggctagatggcaaaatattagataaagggaccctgatacagctaacttctatcatttctagcatcatatgcctgtatttataataataaatggacatagcatctaataataagtagccatcacactgcctgcaaagttcattagtgaagttgagtgggaagaagggttaccctaggtcaggtaaggccagttgtacctaagggctctacgtgcttctcgtttcatttgctgctgtcaactattaggttgccgcatgtctctacttcttcttaaataaactctgatggctcctggtcctagattacagccctggcccaaaatgtcttgacaacaattgcctaaaggaaggagtcaggaacaacaattattccatggtgtgatggctaagaaaaagaggcaaaagattccactgctgtagttctaactacttctcacttactttctttgtgcgtatcatgtaacatgcctcttcttattaacaggacctgggctctgtgggactgctctgaatctgtccatgcaaaccaacttttggaactctggggctacgagataaaggagaagaaaaaatgttctaggtgttattttctctttgtgcctcactctattcatttaaaaaaagaaagctcaacaagatcctctttgagattctactgcattttcctgggcttcagttattttacctccttattttaaaggcctttttgagaatgttgttagttcagctaaacatgatgactctgcctttcttcctctgctctatcttgtaggactgatgttcctttcaggcagaagcatgcatttccactcctgacagaataagatgccttatttcacctcccctattacccacaaaaagggagacttgtaagtgtcactccagaatttttgccattgagttttagagaatatcatggccataaaaaggaaataaaattatttgcataaataatgtcaaattttcaaaaagtaaatggaataaaatactcttgtatagaaaggaagaaataaaaggaagcaaggtcactgttccattcattttccccacaatattattaacacccaggcatatgataaagatttgtcaaaagacttcctaatattaaattggaagatgactaaaaatgttgtctatttacatctgagatagcaagaaacctcatccagaattaaaaagctgcgttcctttcatcttttttttccttttcccctttctctgaccaacattttctcctctattctaaatattgtacacagcccaaaggaagtcagtcttgttttgttttgtatgctttcagacaggtctcactctgttgcccaggcctgagtgtggtggtgtgaccatgactcactgcagcctgaaactcctgggctcaagcaatcctcccacctcagcctccggaatagacggggactatagttgcgtgccaccatgcttggctaattttacatgtttgtttgtttgtttatagagacggggtttcgaaatgttgcccaggttggtctagaactcccggactcaagtgatcccccgaccaggcctcccaaagtgctgggattatcggtgtgagccaccaacccctgcagagtctacatctgaaataaaccacagaagcaaggatatcacttaaacaatgtaacttaccaattcagtctgagtgagttttgtagtttataacatattgatgaaaacagttaagtgtccacattccgtttacataagagaatgctattcaagcttttaaaataaaaaacttaaactattcccctcaccccccaaaaagtctaactataaagatgggtttgctacaaaataattagcaaaactgatttaccaagtaagatgtcctcccgctcactgccccccagaaatacgtatactgtaggaatactcctaggaagtgacacaagtgaaagaaagaatattctttcaatatgctaaaaacatctacagtgcactaaaaaaaagtccctaaatttggcaatacatttcttccaaaaatgttattcaataacataaacattatgaagtagaactggctgtcccatatgttcagaataaaagggttaagtggagtcctgcataactagcaaagtggaagaataaatggtaagattaagacatacacatacaaacattaaaatctaaatatcagaacaactaaataaaaatttaccttgcatctctacttttaactatataataaaaaatggtcattggatagctgatacttgtcaaatctcagcaaacttatgagagagaagggataaaaatggttaaaccttaaaatacctgttcaataatcagtttttaattatcaaaaaaatgttgacatgaaaggcacttctacaattgcaaagggaaaccttgtattttgcatggctatgtagttatacctttgtgttatcagtggtgagtctggagataaaagatgatcacacataaccaactaaaatcgagaccagtaatgaccaaaaaaaaaaaaaaatcagggctgagaagcttcctatacttgacttcataaactattttactgtattggttactcagaggactagataccactccaatccacaaattgtcaacctcaacaatttaaatgtacgagtcagattttccacagttcacttctgaaagatcttcatttatacaaatatcccttctatattcatatctaaaagataccatgagccttaaaaacagtaacactgagggtcaaccatttgctctgtaaccccagcttaaatgtgtctgagcctcagtttaacatgtataacaatgtatttaatggagcagttatgaaaattaaagatgacaacgtcagcctgggcaacacagcgagaccccatctctaaaaaaataaaaataaaaaaatagctgggtgtggtggcacgtgcctgttgtcccagcttcttgggaggctgacacggaaggatcgcttgatcccaggaagttgaggctgcagtgaggtgagatcatgccactgtgctccagcctgggcaacagagagagatatgtctcaaaaaaaaaaatgacagtgtatatacaacgtccaatccaacacaggaggtcctcaagaaatgttaattcacctttttccttctttgtattacttactactttgaaaatgtttttatactcaagtatcttgaacaattttcggtataatactcataccaagtatctggtatttccaattcctgacagattctgacatctacagttggatcatgtatttatatattttactatgccttggtactttcaatcatatgacactgcttagtcacaataagcgtattgattcctctatcctattgtttataaaaccatccattaaaggcaaattgcaagatttttttgggggtggggtgggggcgcagactgagtcttgctctatcgcccaggctggagtgcagtggtacgatctcagctcactgcaacctccgcctcccgagttcaagtgattctcatgcctcagactcttgagtagctgggattacaggggtgcaccaccatgcctggctaatttttgtatttttagtagagacgaggtttcgccatgttggccaggctggtctcgaacgcctgacctcaagtgatccgcctacctcagcctcccagaatgctgggattacatgcaaattgcaagatttttatgctatacagagagttttcttgagtgctatctaacttttttattattttcatttgactagagaaaataaaactattagcttactgaaaaggatcagccttctgagtgatatgacatggatcaactttaatttcactcaagaaacaattttttaaaaatagaaattttcattggaatttcaaatgaactttgctttttacagtgaaaaacattgttgtcaactgcaaacgatatacaacaggcattttgtgaagacatttcatttcaaagataccttaaaaaagtagacagcacactgaagctaagagaaccagccttaaagtcaggtggccaggctttgaatcttaggttcaggcagtaacttttctgagattctagggataatattaactatttaacagggctgtaaaaaaaatgaaagcacttaacattgtgtctgctatcctctaagtactcaacaagttcaagtattctagagcaaacaaattttatttttccctctgaagtaaaagcaaaaacctacactcacctgccttgtattttatcagtactacaaaataaatccaaaaccttttgccatcactcagtagtataagtaacaataaaaacccaaagggtaataattattccaatttcatacacattaaatgatggtattgcaaatacagcttctgatccaaataaaacaaatggaaaatgtaactcacattcatgcagacagacaaccacatacatactaaataaaaggagtaactagataagcagaaatcacaagacatatgtcaaagatctgagttttagcctagagactgtcatttgcttaccagtattaaccttggcagcttgcatttaattaagtctcagtttcttcatttacaaaagagggagaaggagtcctactgcagagaatagttgggaagattacaggctggactgtatgaggaggtttcttaaacctgggatacaaggccttctgagaaatgcacatgtaggcctatgggatctgagattgtcagtagcttccaataaatcatcagttacttgaaccacaaaatattatgaaatgtaggtttgtcaaaacgcttcagaatctttaaagctataaatgattttaaagtcgtgttaaacttgcatgaattacagtgttctgggagagtgagagatttaattttgtaagaattttaatatttcataaatatgaaagaaagagaattcttatatatgtaaaactatagcctaggaaattctgtcaaataagactgagaaactcactggtgattagagagactatttttaatgtaaatttgtctgacaactgttgtgataactggtttagctgtgtgtgcgtgtgtgtgtgtgtgtgtgtgtattactgtactcacttcctaactggccctcctccaacacattttccacactacagccaatgctctttgtaaaaggtaaatctcttggctaaaaactcataatagtttctatttcacttaagaataaagtctgaattcctttctatggtttggaaggctctgcatcaactggctccagtgcatctgaccaaccttatctcgcatcatttagtcctttgctcattcattacgctccagccaggcgatgtccaacagaaatgtaatgggagccaccaatacaactttaaattttgtagtagccacactttttcaaagttgaaaaaaagtaaaattaatttgagtatattttatttaacaaaacataccatggtatcaatatgaaatcactataaaattcttaagatacttcacattctttttgtagtactaagtccttcctccaagttggtgtgtattttacacctacagactacctccattccggaaagctgcatgtggcttgtggctcgtagcttcttcattggacagtacagctctccagctacacagacttctctggatcccagaacaccaacagtgctctccggtctttgggcgtctgtgtgagtggttctctcttttgagaaagttctttctggctttcttatggctgcctcctttgcctccttccccaaactcagcttaaatatcacccgctaagatacgtctttcccaatgactttaggcaaacagtctccccattttattccctagcagagcacctcggagatcacagttgtcttaggacttctctcattctgtcattttttgtgcttgctttccttgcttttcaaatatttgtttatgtcctgttttccaccactagactataactattgctccatgagaacaaggaccacttttattctgttcaccatgggcacatctgagataccgaatttttgctaaatataataaatgcacgtcattactcttagttgctccctggccacttctaacataatattcagaaacaactgggagcataatatacgcacaagaaaacaataaataaatatatataattatttaaattataaaccaaataaagatgcttacatgatataatttttgaaaaatccttattttcaagacacttgtataaagataaataaatcactttattaaaaattataagtactatccagttaaaaaataaaacttcacttaaactcaaatcaaatcataaggcatttcggatatttctccctttcctgccttcctgagaaaagcactgtgttaactgctcttcattcggcattcagacttttaaagtcagatcaccccagtctcctacagatctacaaaaaatctctaaatgccaataaatttttacaattaaagggagaaaaaaggaaactatgagtgatatttgaagaaagataaaggtttagttaagatttaaacaaactaaattttaccttttctgctcttaactctcattttccaaatcatttattgtaattctaaactgagattcacagctccttcagacatattatacttttaagtggaaaggtgatcactgacaagtatgcagtttttgatacatattttaataaattcggtacaaataaaaatcacataactgatcatgacaaagaatatatactttgggagaggaaaaaatatgactaaagtgacagaccattatctaggttaaaaactgagaataaattaataggtaaaaaatagacataaatggttggatacagctcccatattatggttacctagtcaagtcgtctgttattaacagcaggataaaaaaatacgtcagtagaagacatggtaatcttacacgtagacacacaaacccacaaaaataatcattatatatatcatttatattatccttgaatatatatgaaaaaatatatttttatatttatatatatacacataaatatatttatatatacaatttatatataatttgtatatactccaggtattatacatttgtcttctcatttaatcctcataacctaaagaggaagacactaaaataatccccattttgcagatggggaaactgtggtgtaaagaggtgaaataatttgcttgcacactttgcccaactgttgaactaaagaaccaggcctggagatttattttccagtaattggaaggaaagggttagaaacactttaccaccatccctatgacttgtaagcttataaacttaattttgagcatgagacagccacgtctccaaaccacactgctactgtctagcagcttctccagtatctctgtgtttggtcaatttggctttctgatcatttctctagttccttgttcatttctctactggaaataaaaccaagtcatgagtagcccatgtggttgaaggcctgacccacctacagctaagtctgtcagcaccctgaactaggcatgtgaattttggatggaccttctcagtctttaacctgaatatttatctgacatgtaccgctgggacctatctgcaaaccacagctccaatcccaggagtctaatctctccatgaacaatctgaattagaatatttcttgaatttcttgaaaagtcagcatttaattatcactgaaggaggcaagcattgccccttggtggtccccacatggcaagagactcaattggctgccttcctctgcaaagccatgactatattattaaagaaaacactgccacagataccaaatgtcaacagactatataacgtgtttgtgatgtgctacagttgacccttgaacaacgctggcttgcaccgtgtgggtccacttataagcaaattttcttccatttctgccaatcctgagacagcaacaccaactccttagcctacttaatgtgaagatgatgaggataaaacctttattatgatctacttccacttagcaaagagtgaatatattttctcttccttatagttttcttcagacatctttcctctagctaactttatcataagaatacagtatataatacctataacatataaaatacatgtcaatcaactgttttaatgttattggtgaggcttctggtcaacagtaggctatcagtagttaagttttgagggagtcaaaagttatatgcaaatgttttaactgcacagtggctgggactcctaatccccacattgtccaagggtcaactgtattcacaagtttattccagtgtgaactctcgtagaaagagagagagagaggcaggctcgtgctctgttgtccaggctggagtgcagtaattcaatcacagctccccataaccttgaactcttgggctcaagcaatcctctcgcctcaacctcccaagtagctagttaattttttaatttttagtagcgatagggtcttactatggtgcccagactgatcttgaactcctgggctcaagcaatcctcctacctcggcctcccaaactgctgggcttacaggggtgaaccactatgcctggccactgtaattttatgtaaagttttcttctcaaattttaatacctttcttcataatactaaatatgttgtcacccattcttggcatggaagtctactgagtccacatccatagggagcaattgaaaattctgtgtgtatgagtttgctttgatttatgttctatttggttataaactttactgcagctacaggaataaaatttggctaatataaacgtaacaattattatttcagaagcataaaattgaacaaagagttgataccaggttaaaaaaaaaatcacttttttaaaagctagatgatttgtgttttagccctggctcaggtcctaagcagttttataacagtggctaagtaggaacttgcctaaagcccagtgttctcatcagttaaacgaactctttataataattcctaaggttcctactgctcaagaactccagtccaagcctagctaacactggataccaagtaacactgcatgctcatttactgaacttagggaagtatcacccacataaagttgttctcatgaatgtcttccatttcatggcttaaattaatagccataataacatgtcaaatgtttgttttctctatagtttaatgtacctagatatatctgactaaaattaactggtgattttcttggatgtttaaaataatttgttgatattggttaataagcataatgtacctaaactgacaagatgaaactctaagaattagatttcacagcttaacaaaattcaacaacacagtagatctgcatatgaggggaaagaatagaggcaatttgaagggaagaagaactcaaagcacacatttggaagaagtacactttaagactcagtcatttgaactactctgactggaaaacaattccataaacaccattcagagagattcctgtttcttcaatacctagagtactttcaaaagagcaactcatgtaaaaactcactaccatgaacactgcacagattgaaaccacaaatagccaagagagaagaaaggaatgtatcggggtgggtgagaggggaaggtggttgaggattccttattcatgtgttcaacaaatgtttattaagcagttattatatgccaggtacagtgttaagcactgtggatactttggtaaacaaaatatagtcctttcctgttaaaacaatcttccactccatcaaaaaataaataaataagaaaaaaaaaggaaaatatcaattttctctacttggtaacctattttaacttccccatcttacttggctaattattaaccatgtgcatgccatgtatttcttttgagaaagtgaaagattctaaaatcttcaaaatttgtaaagtaattacaaaatcaaaaactgtaagtaaaaagagtttaaagaacatgtttaattctgaaaaataaaatattctgatttttagttccatagtttacttttcctctacaatttctgatatgttttttcaatagagaaaaacccacaaaactaggtgtacaaaaatacagtacaaataattttgatgcctatatccaattgaaacaaaatttaatagtctgaattttgtaagggagttccaaagttctttgaaaacatcccctttatagacaatatgacctcaaatagttcattttaatcaatgtttttatgtcacagagtgatatatttattattaacaggtgcttaaaaatgcttcttcacttggtcattttctataaaagtatctgcaagccagtctagaccaatgtctatagcttgtgattatacagatctccggaatgtcttcaggatgtataattactacatacagaacacttattcacacatttaaatggaagtgaaatgtaatctaaaaaatgtaaagctatatactagtttcaagaatacaaaagtaaacaataggaaacaactttcatttcatcagtgtattagtatgaggtattttgcttcctctctctcctaaatcaagtgttctgattgtaatcgaaggatcaggatggggacagaagagggaaaagggcacctgcagttcacatgtggcaagaggcttggacaagaggaatttcttttctccccttgcagtacagatttatacacaaccgaaaaagtgcagctatgaccacattttaagaatgcctaaaaatgcccaggagtctaatccctatcacagatattttaatcactttataaaatcttaaagcatttattcctttcatattaagtaacctcaaataacccaaattgtacactacaagtctctatttgagtaacaatcacagaattaaaaaaaattataagaaatatgcaatttccttttctacaaccgaataaaacagtataatgtttatgcaaatcaagctagcagaagaataaagtaaacaacacatttcttaatttcttaatatagttcaaggtggtgtagtggccacctcttttctttttttcatgaaaatctctttcctttgcaccatgttatataggatctttaagaatataatgtactgaagataatttaaaataattttctaaactatgtccataaccacctccatgactgctcccatctgatggttaaaatcttacagtactagcttgaatttcatctctgcctcacatgtttcaagcagggaagcagatttagtgcctcagaacactttacagggtttcattatcaatcaggttatgttcccggtgacgctttcagtaaaattatcttattcaaatgaactctcttggactgaagtaaacaaagctgtagcccattgctctcacatactctccattcatttatttcctttttctttacttagacttacagcacgtgccctagaaagagcgcatgttgaatattcctggagtgtcacaatatgcaatacaataaaacagattacggccctacctttctctcacagcagtggtgccaagcacaggtacaccggagtaatcaatttgttctgcagaccgtaaggctttcatagaatactaatgtaaaatctcttttctttctcctttgccttgactccctaatgcccaggtcccgaccaatacaaggaggagggcggtatgtcttctgctgagataaccacaactactaatcaagtatacgtgtacaagggcacaggattaaacctccaccaagcttgagtcagggtttgagagcagctaaacacatgcacagcatggtcaaaattaaacacacacacacacacgcacccacgcacacacacgtgccatgaaaatacagatgtgtctacttcggtgaactaattcatcacactttaccatgcctcgtttttttaatctcaggggcataaaattacctcctgttgaactgaggacttagattcaacagtgcccaacaattgtttttccagaaacgagaatcatgatcagtcttctttgtactcaactgttaaccatttttaaaactaggcatttttcttaattgtactatccagcgcagttttacatgaatttatcatttcaggtattaacatagggttaatagactctgcatggattcttcagattttacacttaaaaatatattgtaatagctcaagtctactttaccaagaaaagtatgtgcattaccagtaataagacatacaaaagattttcatgtatcttgaagtatttacattatgaataatcccaagctatttgaaaaatattttcaggtctcaacaattatttaaaaagcacctttaacacttcataattatggcatcacggtggtatggttaatcttataaatctagagttctggtgttcttttcaattagacattttcacttggcttatttttcttttattcaaaatatgaaaaggtatgccagtcattgagtaggcgaatgacagaagttgttaaatattttttaacaacatacattgccacattttaatttgcctgccttaattttcaaataactcttgaaaagtattgatagttaaggggctgcaaactaggcaaaaattaagaacaaaatactcaaaataactgaagaaacttattaggaggcatcctaagccgttctgttttcatgtaaacaactgctttaacactgctaaaatacatgtgtctcattttgcactttttctatttcttaaaaaaaatcagtaggaacaattaagaaatactagggactcaatgaagtattgcaataatgtttaatcgatactgatgcatttgtccttgacacactgaccatgtcatcaggctactgtcatcttatatcatgtcatttctccacctggctcatgaccttgtcctctaaatgacctaaagcttccctcaagtagcaggaggcccctccccgctgtctcagcaaggtcgaacgggtcagcgtgtcctcatctataatccaccaccatttgtcagcagggaggctggaggaggcaggcttgctacaaggggagaatgcccaattaggcagctgtcacacaaagcataggctgcaaaattatcccctgtcaaaagaaagagcagctgcgggtgccaattacagcaacctttcaaccctttaggtactggaaactacacagaagtaaatgaagaacaattagtgataacaaatcgatgaattaggacagtaaattagaaattactagcaggtgagcttgggtcatacatgacatttagggcacaccagactccaggcaagggcaggatgcaatgaatcacactaaccatttcctcacatatagatttcccctccaatattttctttttgcaaacctgagatctttaaaatacccatacctaaaaatatgtatcttaatatacacaccttttcatttcatggacccccaaaattgtttctcaataggagaaaaatccttcagaataataagtctagttcattctaacttgttttcacacagtccaacatgttatcccctcaaacaaatttcttaagtgtcgcccacaaaatccaaaatatcagtttaaatcatcacacttaaaatattgtacttgtcctgattctacttcagtcaaaaagcaactgggtataaattctgagaaaactgctttgctaatatcataatgttgaaggtaactttctctacacaatgtcattttgtggataaaaaaataactgccatgtgtgcttctatacataatacacataaagaaaatatcaaccacaaaattactctcttagattgttctgctccaatcctgcagaggtgatatacattaagtctcaagcacagaaagccaatgcacttggactttgtccaactaatttatttggtagttaacattcgcaggcagtgaaggaggaacatggggaaacaagccccaccaaggggagcagatccaatatggctaccgagtgttcatggacatggtttcattgtgccttaaaatgtcatgcatgttcagaaacaactttcttaaagtccatttttaactaagattaattttttttccatagaaaaaagatggtcttcctacatcagttctttgaaagttgagaaacctgaatgatacgtgctgttatttctaaagaggcaggagaaaattgcttaactagacttctaaatcacaaatggataaaagtgaggaagagagaaggtgaggcaataaagaagcactttactcacccacctccaacacattataaataaatcacagttgccagagggaaaagtgtgtaactcctagttcctaagtccagccatgtgataatgtttctaggagatagatgtcatggggagaaaacttctccatgaaaagtttatctgagaatttgatttataaattatatttcatcatttaaaaactgggcatttataaattctcttaagtttagaatgcaaccctctaaagtcagacataaggaattcaaagcaatgacaaatagataggaatgaaggagttaatgcctttagaattcagcttccatcatacatgggtgactatctctttaaataatttaaatcctctccatcaactacaaagctgttttgaagccatttagctttgttctttacatgtgttctaattaagagatgaccttgtcatcacacacaccagaaatccgggattatttcctacagcaaaaattcacagagccccccaaagaagaaaaaggggggtaaaaaagtcttcttcctcagttcctcactaaaggaagttgttggttggttgaacgctgaggcagtttcaccgcataatttttttgttgttgttgaatgtcacagggcgggttagtgtgaccttgagctgcatcagcagcacagcaagggtcgagatgcctgcaggcgcccttgtactggatttgcaagacaaaaaccttcaaactggctgaaggacatcttaaatctcttcaaaggttttccgaactaatctgggctgctcttagcaggatctgtgccagtgtgagaagcaaaattaaaaacaaggtctttgacaggatgttgtctcctcttaacccttcccaagcagaatagaacaaaccaccagcattctggagagagggtttacctagaagcattcttttataacaaattatgtaagcagacaatcacaaagaatggggcagttattagttctcaaaagtaaacaacccttccattgtgcttattaaagaattcaggtcgaattctttcttgactatatttcagtgtagtgaatgtaaaacttaaagctctatttgtatctttcagatttgtagcacagtcacaggttaagactaaaaaatatttccatcaatatttatctctagaattttcatttttaaaaaaaaatacatggttttagttggttaagtcacaaacttcacgcatactgcatatagcttactaaaattacaggtaaggaaaattacattatagcatgtttactaaatttcttattcccaacatgatgaatacattcttaagacggaaaaaaaaaatcattagaatagtgagtaacacaagtaaaacaaggtaaagcaatctcggtcttgttataaaaacatcagcatgacatttgatgttttagcattaccagtgcatgggccaaaagagaaagtattaatgccagtagagggtgtttgattcttccctggcaatgctctcaaaatttaatttagtagctaaagtaggcaaatgtttaaatcattactctagaacaacaaaaggaaaaaggtgaataaaatagtcctggctttcaagaaataaatagtctggtggaacaaacagctgtaatgcttaaatcacaatatatgctaaaatcagtgtgtctccatctataacatgctggtttgtcatcatcagatataaggtatgtcatgattagttctaaagagtatttagtgtaagtatttagtgttaagtacagaatttaataaggtctaagaggttgcaaattattcccttttaaaaaaacagactaaataaattcaagataacttgggtgataaccacactttcactcacttggattcaggtatgttttcctgaacaggacaggaaaaggacagagtaataacacctagtgagtaaataagacccgagagtgcacagtgccggtgattttcttccttagtctctgtgccaaaggagagagagtatatactgtgctaaatgcaatgactgaaatatgtaaaaagtgctctaggaacacagataggctgtaaccaggtttttagttcatatgtacacatgcaggtggtagtcagtgatggttaaaaaatgagtaagggctagccaggcagaagagaatggcagccattctagggtccagaaatagcactcaaaggcaaggaagagctgagtgtgacacaggaagtgtggtagtccaatgggagtggagattaggctggaaatgcaactgggaccaaggactttgaatcaaggccatgccaagaagctggcctttatctggtgggtttccttacaagcaatggtattattaaaagcatattagaaaaacaaaaccagaagctatgggagttgttgatagcttggagggaagaagaaactgtagatcagttagtgcactgccatggtcaaaataaggcaaaggcaggagagttgaagaaaaagacagctctggaaacaatgaaggctgctttgaatatttaaaaaccaatttgtttaacataaacagtgctataagatagggtgttatttcatagcaactttattgaatcaaagataaaaacgataaaaataattactatatctcaagcctaggtttgataaacactgtgctaaaaaaatgatttctacaaagtttcaaaaaagtagtaattcttacaggggtgctttaaagaggcagaatcagatcctgtttgaagtctgaattttgtactttgaactatcaaccttcattaagtattaggtaagggttttgctaagacagtgacatgtaccttttcagaacagtgtgagagcgtatttcccttggctataagacagagatgtccgacttaaattataatgtggttcttggagctaagagttctatccaacgctaatgagaaaaaaaattaactcagcaaacatttcttgagtcccgactacgtttaggacacagaattaaaaaataaaaactacccaacattctatcagcttcatgtttttagatgatcactcataatgatatcaagtcctcaaattccagcttgcatgacatcatcacacaataaaaacactacgagtaaaaacagtatgaagctgtcagtaaatcaagtgtcggaactagcagccatcttggtattccgatccagctgaaaggtacacaacgcattcccagaaccctcagggaagacccagcaccaatgtaatttgaagagcgtcgtcagatactctagagactgactgtcccgctgagacctcagaaagaatttaacagagtatcagccaaggtaagagagtagggagtaaaacagaacaggagtcaccagggccaagtaaatatctgccagagagcagactgtactctcagaaaaggaccgccagcatcagggatcaggttgaggcaagtggaggggaaggtcacacaaaggagagaaggaaagacttgaggggaagcctactcaatcctgcaaaataacacatcaacttcattttgtgaaacttttttaaacgaccaaacctctagagttgggcgaatcaccgtagaagaagtattagaaggtacacaaatcataaagaggacttgaaagccggggtagggggaaaattgacagggcaaaactaggaatgaccttactgagtatccacaaataaaatgacttctccttgagtaagcatctctgtcttacagctgccaagccaacgctggcagtaagtttcagcacattctaggtctagacattaatagaaaagtgggtaatatgatacaccgtgcagttattaaaaaaaaacttattagtctacaaacacaaaagcaaggttaacattattggaataaaaatatagaagattctgttcgcaattagacaagtgaattgccataatacagcagtcctcaaagggtggtccaaggatgccaggggtggccatgacccattcaggaggcacatgaagaaaagactactttcatactactaaatgttatctggcttttggtatcattccttcataagtgtacagtagagttgtctagaggctatatacatggaatgcatccttgtgtaactcttgttttaaattttttctcagtttaaatttctaatatgataaacatcagttgatatgaatctcataaataaaagctctcttgggtccttgataatttaagaatataaagttgtcttgaaagcaaaaagtttgaaagctgctgctattaatagttgaaaagtacaatgttggttttcttcaaacataatctcttctaatttcaagaatttccactataattatggcagataaatattgttctctgtgcagaatgtccctaagaccaagacgaggaaagaaaagaaagaactttctaaaaagatgagtaaactaaggaggatatgaaaaatctcccatctctagagtcgttattattctgaatttaccatacaaggagtaacaaatgtacaaatatttataaagaagctgctatgttgttaagagctgaagttataaggataactaagtgataaaccagcccttagtgggctcacaatctcatcgggaaaaaacagatcaacaacatagtgagatgctactaaaaagatggcatggacaaagtggagaaagcactgaaagacacaatttttggaagaagactgagtggtaaggcagggaacaccatttttagtgaaggttctctacagaggctgcatgtgaactgactctagggacaaacaaggctttctcaattagaaaagaagcttcagtattcttcagaaagtaggaggaccataagcccagtccaggaagcacaatggcatagagtatgttctagaaactttaagtaatcacctccaagaataaaaattgccagtaatgacaaacttttatagaacatgacaaaataatttgatggcatgttctataaaagttataattaaatttaatgatgaaagatgtggacttagattttgtagtcttgctaaaaacttctgtcatatagctttttaaaaagacaataaaagtgagttactaaaaaaaataaaatagaaacagacaaacaaattattggcctttactgcagatattttgagaagcactagcttggaggacaggctagaagatggcaggtggggaggaggtgcagagaggggcggcaacagcaggagacaaagcttcaagctagaagcttacatagactgtactatgaacatttttttaaataaataaatgcaaaaaggaagcaagcgaggtttgaaaattactcatatacctctaatccagaatgaagaaattctagttatctaaataaaatgcataagctctgacgttagaatcagaaaattttcagatatgcaaaccacaggccacatggttgaagggcaaatgtagcagagaatcaaggagactatcaggttcacaacagttaatttcagtgaaaaaagaccagggtctgtgtaagaagagaaagtgtattgacagtttgatcaacacttttaaaattattttgattccttcatttgaaacctttcatggaaaaggaaaaaaaaaaaaacctgagttgatatggaggcttcgcatatagcgactttataaaatctgagttgatatggaggcttagtctagtagggatcttcctccccaaacaacgtaagttatatcaattaagatactaagtaaaagacttaaggaaaagtcaattatttaaagataccaaattaaaaaaatgttaattgtattaatgtttcccatagtaacagtaagttaggattaaggaaggtctattacttttctatgttcattatgctattgcaattgctacattatttttgatcagacaagtaacacaagcaagctggagttttaggaagatctggtggttgtaaaagactcgaacaaggatgtcagtaaacaggcctgccagcacaagagctccagatgagaaatgataagactctgaacgaagatggctggctgtgagaaagggaattaagagtggatggaagcaatgctggaaactaacaatgattcatttgagccaagcatacagattttcttaccagggttatccacaaggccaggaaaacactagtgagaaggccaaattggtttacggcaattaattccaactaggacaactcacccagattataaattgatctttctttcaccagcatcacgtttctactaaaaatctggtgtgaaagtttaaacacattttacaaagagttatttcttaaacaaataaaaaaaaatatgactttgaggagtgttttatgaagttggacaggcattccatgtatacaattagcctactttaccaacctcgtaacccagctcatcagtactggcactttttttttgagatggagtcttgctctgtcgcccaggctggagtgcagtggcgcgatctcagctcactgcaagctccacctcccgggttcacgccattctcctgcctcagcctcccgagtagctgggactacaggcgcccgccatggcgcccggctaattttttgtatttttagtacagacagggtttcaccgtgtcagccaggatggtctcgatctcctgacctcgtgatccgcccgcctcggcctctcaaagtgctgggattgcaagcgtgagccaccacgcccagagtactggcccttttttaaaaaaaaatttatatagatattttatgtctgacaggaaagttttaaactcaagacatctattctaccatagttgtcaaaaatttaatcaaactagaaaaaagtacaatagagaactcgtcctagtggaaaaccatgacatataacaataaaaattccattagagaaaattagtatattcaagtgtttaagctaaattgatttatggtcatttagttaacactaccgaaaatattctctgtttttgtatcagcaattttatcaaaattagctaataaatattatacactgagataaacagcacagaaagtatataaagtcctataaaatataaaaaagggtgaattaattttgttagttactcaatatgatgattgtatctctttcaaaagaaggagctaacaaaatagcaagggaaacatggcctaagacactgaaaggctttttaaacacttcattctttatttagtttgcaatattcaattaattacatcctttttcctcccaatcattatctttgagctttcagtcaaaaaaaattactatacttaaaaatataacatgagtgttttgcagggtaagacaaactatagtaaaaacctcataaaacattagtttagaatcctcaacttgtcaaatactcatctcctgagatataccagatcctccttttggagacacagtccactggttaatgaaaggcatattgaaaagacattctatactttgacccaacatctcccaagcttatttgaccatggactgttcatttaaaaggaaaacatatttaacacaacacgttttagaaaaaacacatttgacataatcatctttaaaatctaaaaacgtttaaaaatatgtgaaaggaatatagaaaatcactatcagtaatttgtttttataaatttttagttttcaaagttgttcactatacattataatgtctttttttttttttttttttttttttgagacggagtctttctctgtcacccaggctggagtgcagtggcacaatcttggctcactgcaaccccgactgccgacttaagtgattctcctgcctcagcctcccaaataactgggactacaggcacgcgctaccacacctggctaatatttgtatttttagtagagacagggtttcaccatactggtcaggctggtcttgaactcctgacctcatgatctgcccaccttggcctcccaaagtgctgggattacaggtgtgagacaccatgcctggctgtctttttttttaatctggaagaaaaatctaaatttgacaattttctaagaacaactcattggctgtgtatatttaccagatggctacctataatttacttatccaactcctagttggatccagtgagcattgcttatcattctggctatgtggtaaaacaaaggtgttgaaaattaagaacaacaacaaaccaattatatcttgtggcggggcggtcacaggaatatgcatgattataatgttaattttaatagaattagaagttcagaaatggggttcaatatcaactgtttcatcaaatataaaagcagatttcagactgccaaccagtgattaacacctaattatatctgaataaaaaaattttagtatttacaaataattgcgtcattgattttaaattccaattataagtaaaatataaatgaatatacgaaaagtgacttgcaaccaaataattattagtaattttatgcagtcttttaaaaaataacattttaaagattttcttgatgaaattacaagaaaagctaagcatttaagtgggtgattaaaataacttcattactaggttttctgaacattatcagaatagtgaagaaaaagcagttaggattatccatatgaggcctacaggtaaagagcaaatttggctcaaagttgccattccctttttgaaacactgtggtcaggtaaaacatggtgaatttcagcatgctgtatctgctctctctctttgaccagagtttttcagttagctagatgaaactgaactattcacaacggattatgagcacaataatcaatcattatgcctttacctagttcacttggatttctccttcccagaaataagcagcataaggtccaagagcttaagacatgacaaattcatttaggttgtagctatactagaaaacaggagtgttaatccaagtagaattaaccacttgctcatcgtcttttttgttgctctgcccacctacttgtgttaatttaatccaattactttatcatttctcagaaatactaataatgctctttcctttgtaagaggaattttaataattccaaaagtaatcactggcctatactataataaacacacaataatcaaacatgcttctatttttcctcaaaacggtaattaactttttatctgaaatcagggattgctattgtaggatttgtattaactgtccattttctctggtttttgataaatcgaattaagtgttgtcaacaaaaatactatttcttctttcaagctttccaattcctctctccagaagtaatctacacactgaattctcaagaatatttttctccatttctcttacagcatttaacctcttttactgtttgattacattatttatctacatttattctttccatataagttccttaaaggaaggattgtagctctttcattttttaaaccacattgcctgatgaagtaacttgcacagatgaagtacataatacatattttgaattataagctaatttataactgagaaagaattgtctgaaatatattaaagtcataatgattaagccttaagaactcaggaaaaaaatattctcaccgtctgtctccaagctctgagcctctgctttctgagaaagaaaattgagaaggctgttgaaaagtagctctgatgtcatccggagtcttcagattccctgtcctccttcagtcaagtgtgcatcttaacaagagggaaaagatagtttggcatctattccaaaccagattctggaataccttttgatcaagttcaacttatcccattaccttttcttgttcaagttcaatgcaaaagtagtcatttgacagaaaaatatcaattgtttatgaatgctggttcattaacagaaagcaatagatctctgctttctaggtaataatcgataaaagtagctgcttcaacaaaataagctgtgaaaaaggtttatagttgctaggatgtgtttattaacctttgttaatttcaaatttcttagcgtgctgtgctaaattaattaatttacatacaaaaaattataaatcctcctaaacgtgtatttcttaaaaaaaaaaaaaagaatagctatagttttcttatatggaactttttcagtttcaaaataccaagtatgtaatctttgcagcaaaaaaattggtaataaatatcaaatgccctatatatccatgaaaagatttacacaacaatgcccaaagtagatttatttttaatagtcaaaaactggaaacaactgaaatgcccatcaataggtgaatgaatcatatggtatatccatacaatataattttactactcagtatcaaaacagaatacacacaacacatacggaaaataaatatggatgaatctcaaaataattaccctgagtgcaagaagccagacaaaaagaaacatattttgtgtgattccatttggataacattccagaaaacgcaaattcatctattgtgaaagaaaatagatcagtgaggttgcctggggatgaaggatgcccaagggagggattacaaagaaatatcatcttaatggtgatgatggtttcacaggtgtacacacatgtcaaaacttgtcagattgttccttaaatatgtgcagtttattcatcaattatacctcgataaaactgtaacaaaaattaaatgccttaacatgttatatgtccgttgatgcagcaattccatgtctaagatttatcctaattaaaaaaatcatggaggataggtgtaaatatttagccataaggatgttcaaaatacatattattatatttgtgcagtacattgtatacagccataaaacgtcaaaatgaaaaaattagaaatagttaaataaactacagtatattacatcatggaatattatgtagtcattaaaatattatacaagaaaattaaattatatgaaattatatactatataagtgataaaaacaggaaacaacattatttcagcataattgaatttttgttttaaacaaaagtaaatgcagtaattatttctgcatttagaggtaattgttattttttctttttgctgatttgcattttctaatttctctacagtaaatacatacatattatttttctaacaaacaccacaaataaaatgatgcaaataggaaaaaatctaaaattttccactccctaatacaagtataaaactcctaagaggcagtgcacaatacagatgtagttctgagctatcacacggccaccagcagcaccctactaaatagctgtgggaaagagacaggtctgacacataaatgggagcatcattaagtgagtaatgctttaccagttacaaaatgctatcatggacatgactgtatttgattttcacaactcggtgaaatgagcagagattccatttcatagaggagcaacagatactgagcagggctggttaagtcatatgccccaaattatagatcttggactcaattaaatcttgactataaattcagataggaattctaagaagagtaggaaacaatcacttgccctgattatatatacctagaaggatgtgattcacacatcaacttaacaataaccatatgtgtaattacatgagtactcctattagaatgtggtagggacctcgggaatttctgaagtctccaatccccagtctctgaagtaatactcaaggcacgcccatcttcccgttatcaacattatctaccaactcactgaaattccagtagaatttaactgttcagttttcaattaccttttttccttcttgaaaaaagattataaccttttattttaaagttggaacaagaaagtacccataactatatttgagaatgctggccgggcgcagtggctcacacctgtaatcccagcactttgggaagccgaaatgggcagatcatgaggtctggagatcgagaccatcctggctaacaaggtaaaaccccatttctactaaaaatataaaaaaattagctgggtgtggtggtgggcacctgtagtcccagctactcgggaggctgaggcaggagaatggtgtgaacctgggaggcagagcttgcagtgagccaagatcgcgccactgcactccagcctgggcgacagagcgagactccgtcaaagaaagaaagaaggaaagaaggaaggaaagaaagagagagagagagaaagaaagaaagaaaagaagaaagacaagaaagaaagaaagaaaagagaaagaaagaaaagaaagaaaaagaaaagaatgaaggaaggaaggaaggaaggaaagagaatgctgcaactagtaatctataaattgattactggaactttaaaatgtgaacttgtgggctaaatctttttttggtctgtgtatatagataagaaaccctacaaactggcatattctataaagaaaaccaccaactcctgagaagggtaaaaggaaatatctctagaggaacattactattatcattattatttttatttttagagacgaggatctcgctatgttgctcaggctggtctcaaactcctgggttcaaatgatcctcccgactcaacctcccaagtagctggaactgcaggtgtgcaccacggtgcccaacttagaggaacattattaatgaactggtcattatctgttgatgacaccatgaggaatccttacagctactactcttaccaacactcctagaactaagagacttaacaggtaatgataactatagtttaatgagcaattactatgtctcaaacataacaataagccttttacagatataatcttaaaaaaaccctgtaaggtgattattattatccccagtttgtagatgaggaaactgggtttaagttaccccaaatcacaaagtcaataagagactgaggtggaattcaaatcccagtattttggaaaaagacagggccttgacagttctctggaaaataaattctgatttttccctactactgttcatctacaatggtctcaattcaggtaatgcaaaatacttggtactagcatatgaacttaatgagcctacattttccatgtaaaaagttaaaagtattccgagcccacaatgtgtatttgatattttgtcacattctagaattgtttatgttaatggttggtctctactaagacactctccttctgagacaaatatatgaccacacaaaagataaattaaaagaatatttaaataaaaccaacaaaagataacacaaaataaactactctaacattaatacttaaagttttcctatattaataagtgagtaaattagccttcagttcaagtcagtgaaactgaatatgccagatgtgttctgaatcatgacaaaagaagcatgtctaatgaataagaaaattttaaataacttcatcataattatattatgaaatattatacaatctttaaaatggatgttttcaaagatccatttatttaataatgtggtaaaattatcacaatacaatgctaagaaagcaagatactattcatctgagttgaacaaattgctaaacaaattagaaggctagacactatgctaggtgttggaattacaacatgaataagacgaacacagttcccatgggaaagagacaggaaagaagcaaacagaaaataaaataattgaagatttcaaacaaagcaagaggtagagaggaagctattttacataaagtgataaggaaaagcaaaagcttctctgagaaaatgacatttaagctgagaaggccctagtcatacaaagaataaagtgaagagaatttccaataaaagaaatagtgtatgcaaaggacgtgcctgcttaaggaactgagagatgaccaaagtaggtagtaatgagcaaggaaaaaaatggtaacaaattaggtcagagatgtgagcataaaggatgatctcaaatttgttttttaatgtgttaccccacacacatatacacacaccatactgaagggacggagaacacaatgataacagtgatattctagatggtaggaaaaggagttggggttattttcccttaatatttccacatgctccaaaataggctgcataaacattacaatgagaaaaaatatggctagaacttccagtctagtgttgaaaagaagtggtgagcgcaaacattcatgctttgtccccattttacggagaaaaaattccaccttccactattaattattatacagctgtagtatataatacagctgctattccctcttccctatgtgtagtttgtgagttttgtttgcttttatcactgatgtgttggattttgtcaaatgatttttcctgtatctatcgagataatcatgtgagtttttactcttttatgtgggtttttagtcttttagtctattaataatatattattatatttataatatatataattactatattaattgtttcagtgttaaaacaatctttcctttctaagataattgcctacaactaatatcatactaatggtgaaagactgaatgctttccccacctaagatctgaagaagacaaggatatctgatgtctactcagtgcaacaaatataaagatagatagactgaaaaagaagtcaaaattatccttatatgcaggtaacatgatcttgcttgccaataactctaaggactctacaagaaacccaaaataattaataaaaaaaagttcagaaaggtttatgacaagatccacaaacaactgcatttcttttttttttttttttttttttttttttttttttttgagacacagtctcactctgtcgcccaagctggagtgcaatgatgcagtcttggctcactgcaacctctgcctcccaggttcaagcaactctcctgcctcagcctcccaagtagctgggattacaggcatgcaccaccatgcctggctaattttgtatttttagtagagacgggatttcactatgttggtcaggctggtcttgaactcctgacctcaggtgatccacccacctagaccttccaaagtgctgggatgacaggcataagccaccacacctggccattaaatttattcttaagctttattctttttgttactcttgtggctgaatggaatttatttttggatggtttgttgccagtatataagaaacgcagccaggcacggtggctcacgcctgcaattccagcactttgggaagcagaggcaggagtaaaacatgtgcactcaaaactacaaaacactgttgagggaaattaaagaagacttgtttattggaacaaagattcagttgattgaaagatccaatattactaagacgtcaattctccctacactgatctacctaaatgccatcgtaatctttttctagaaattggtcctaaaatatatatgaaagtataaaataccaagaatagtgaaacaactctgaaaaagtatgaagctgcaggacttaaacttatctaatctcaaaacatactataaatctatatggtaaccaacagtgttggtcctgctataaagatacacatatagacaatggaacagaatagagtccagaataaactcccattcatagtcatttgattttcgacaaatatgccactgcaattaaaataatagtctttttaatacatggtgcggtacagttagatatccatatgtgaaaataaataattaagtgtaaacctgtatctctcaacatacaaaaataactaaaaatggattatagtctgaattgtaaaaattaaaacacaacttctagaagaaggaataggataaactcttatgaccttaagttacagaaatattccttaaataagaaaacaaaagcacaatccatttaaaaaaattaaaaatggaatgtcatcaaattgaaagataatccacagaatggaagaaaatatatgcaaatcatataactgatgaagatatactatacagcatatattaaaaccctttgaagtcagcaataagataaactaaccaaattgtttttaatggactaaagatttaaaggtacttcaccaaagaagacatgtgaatgtttggtaaacacataaaaagatgctcattgtcatccactaaagacatgaaatactagtaaaatcacaatgagatcacattacacactcactagaatagctatattaaaaaaaaaaaagactgaaaaaactcaaaggttggggaggacaggaagaaactgaaactctcctccattgctggtgagaatgtaaaaatggcataaccacttgaaaaacagtttggtggtttttcaaaaagttaaacatacatgaatgtataaccttgcaatgacccactaattgtacactggagtacctaagagaaatgaaaaatatatgtccacaaaaaatctgtctacaaatggtgatatcagcatcaatcataataaccaaaaactgtaaacaaaacaaatgcccatcaactattaaaggcaagcataaagtgtaaccaacaaaaaaagggaatgaactaatgattcacgtcaccaaggatgaacctcagaaacttaatgcttagtgaaagaagctaaatacgaaagatatctatattgtatgattccaaaaagatatctatattgtatgattccatttatatatgaaatgtcttaaaaagctgaactgtatgtagagaaagcagatcacctcctggggcaggagaggagaacagagattggaaatgggcatgaaagactctgtgaagacatgaaaatgtcctaacgccggactgtggtgatggctgcaacatctgagtgcattgactcaaaaccttccaactgaacacttgcagtggatgaattgctggatacatgtaaattatacctaaataaagccatgaaaaacaaaaataaaaatgatatattacatacaaaatcataaatttatttaaaatgagtccgatgtgctgacaaaggtctcatatccagagtttacaaagagtttaaataaatttacaagaaaaaaaacattaaaaggtgaacaaagacatgaacagacagttctaaaaagaagacattcgtgcggccagcaaatatagatataaaagctcaacatcactgatcattagagaaatgcaaatcaaaaccataatgagataaccatctcatgcctgtcagaatggtgattattaaagagtcagaaaacaacagatgctggcaaggttgtggagaaaaaagaatactttacattgctggtgggagtgtaaattagttcaaccattgtggaagacagcgtggcaagtcctcaaagacctagaggcagaaataacatttgacccagcaatcccattactgggtatacacctgaaggattataaatcactctatcataaagacacatgcacatgtatgttcactgcagcactattcacaacagccacgacatgaaatcaacccaaatgcccatcagtgatagactggataaagaaaatgtggtacatatataccatggaatactatgcagccataaaaaggaatgagatcatgtcctttgcagggacatggatagaagccattatcctcagcaaactaacgcggaacagaaaaccaagcactgtatgttgtcacttaaaagtgggagctgaatgatgagaatacatggacacatttctggggaacaatacacactgggcctgttgggtgggaggtgtggggggagggagagcatcaggaagaatagctaattgatgctgggcttagtatctaagtgatgggttgatctatgcagtaaaccacatggcatatgtttacctatgtaaaaaacttgcgcatcctgcacatgtaccccagaacttaaaataaaagttgaagaaaaaaatgagtctgatgtaaaatacactgccacttctctcattattttaaataacaatcatactttaagataaacctaatgtattacaattactctttggagaatgcaaaagtagaattaagatgactatccaccttcttcatacactactggtgggaatgtaaaatgcagtgtagccactaaggggaacagacagttccttaaaaagcaacatcaagttacgacgtgacccaggaattccattcctgtgtatatacagaagggaaataaaaacctgatgtccatccactgataagtagataaaatgtgataaatccatacagtgaagtattatttagtcacaaaaaggaatgaagtgctgacacatgctacaacatagtcaaactttattacgctcagtgaaagaagccaatcactaaaaatcacgtgatcccatttctatggaatgtacagaataggcaaattaatctagacagaaggatcggtggttgtctagggctggggtgggaagggatggaaatggagagtgacagctaacaggtgtggagctccttttaagatcatgaaactgttaaaaaaagactgtggtgttggttacacacctatgtgaacataaaaactacggaactgaacactttaaacaggtgaatttatagtatgtaaattatatctcagtaaagctataaaaatgactattcacctaatacttattaaaacatcaaaagtaatttcagggtaaaaacctagatctctaatcttacttgtgtgcttttgaagttatgtcacatttatcagaacagtttgttaatattcaattaattctggctaaatattagaatactttttttaaataaaatcaactgtatttttgtacaccagtaacaaacagaaaacaacatttaaaaaatatccaacagcaaagcatacctaggaagaaaagtaacttgtaaatactgcatgctcaatataaataaaatatattggaaggcattaacaacgaaacctaaataatccaaataaatggaatgacacaccatgtttattatataaatactcagtatcgtaaaatgacaattcttcccaaattaaacaaatgcctttaatgcaatgcctatcaaaatgtaaaaggtttaataagttgattctaaaatttgcatggagcagcaaaagcccatgaaagagaaaaaatcctaccaccaaaagaaaatagtaggaaacttgccttgccagataccaaaatgtatcataaagttctaataattaagctagtgcgctcctggaaaggagaaaaacaaattgattgctggagaagtagatcatcacacagagaaaatatttgacaaaagttacactttagatctccagagaacggagacatcattcaatagtgttgaaacaactggttacccatcgtggaggcaaaagtggattcctgatgtctaacatataaacaataaattccagagggattaaaggtttaaatagagaaggcatgtctttaatatttttaaaacaaaatataagaggatatctttatgatctcatagtaggaaacgtttccttaagacacagaaaggttaactatatgcaaagcgttaagattaataaattcaaatgcattaaaattgaaaacttcattcatcaaaaatacaacagaagatgaaaaatgaacaacaccataaaatacactgccaaaaacattgggggttggtgtgatggctcacgcctataatcccagcactttgggaggctaaggtgggtggatcatttgaggtcaggagttcgagaccagcctggccaacatggtgaaaccccgtctctactaaaatacaaaaattagctgggtgtggtggcagtcacctgtaatcccagctactagggaggctgaagcaggagaattgcttgaacccaggaggcggaggttgcagtgagctgagaacgcatcactgcactccagcctgggcgacactctgtctcatatacacacacacacaaaactttggtatccagagtgtgtgtgtgtgtgtgtgtgtgtgtgtgtctgtgtgtgtgtgtcctataacattttaattaaaaatgggcaaaatagagagggggtagccctaataagaggagtcagagagctcaagcaggatgaggttggtgtcactgtggagtggaagaaatgatgtggtatggggaattcgagcccaagctctagatctgtattgttcttgttattgtatgtgttattttaaaattttaaaaaatttaagacataaaagtatttaatgtaaagttttaagtatataatgtacgaaaggtatgaactcgcatttcacgaaagaatacactaatggtgaataatcacatgaaaagatgtctaaccttattgtcaatcacagaaaagcaaatcaagaccaataagatgccattttgcatccaataaattaagaaaagggtggtttgaggtgagcaggatgacagagaagtccttgcacaggagtggtccagcactgggtatcaatgcccaagttggagcagaagggcatccacaaaaagatgcactgtggtgtgcaatgtagaaatcgatgtggggtgagaacggcttccacataaaggggctttgaggctcaagtaaaactaaggggcagggtgagggacaggagaaatggcagattgactacatacagggagaatgatcaaataaagtaacactaaggatcatggtagtcaggtttctcactataagaggaggtacaaaaagggaaggaaatataattgaagcctataggattggaatgaaattagagatatcagtatgatcaagggatgacatgtcaaaaagatactgaagggggtactgctggcaaaatcagggacaagatgggcaccaaaataagttacaatagtaacggattacagctcactgaataaaatacgggctcataagcacacactgatacaaataaattaactaaaactgtgatcaggaaagggattttacatagtttcaaagcacctgcatgcaaaataattattaattacagagggaaaatgagtaatttcacagtagatgaaattagcagacaccatcttaatcaagtaatcccagtgaaaagtcaacagtaatgggtcaaaatgaaattgtatgccaccgcagaggatgcaaagagaagacacagtatcacttctgtgatattcctgctcaatattcataacatggatctaatcatgaggaaacagaagacaaccctaaaggaaaagatattctacataattacgggccgacatggtcttctaacatgccagtgtctttaaagtcaaagactgaagaactgttccagactgtgggagaccaaaaagatgagacaataaaatgcaaagtgtgattctaaatggaatccttttgctgaaaaggacattatcgggacaacctggaaacttgaatgagctctgacgattagatagtagtgatgatcaatgattttgatggttttgttgtggtttccaggacaaggtcttgtttctttctgggaaacacacacttgtttattcatgggaaataagtcaacagaggaaaaaagttccactgtattgtacgtgtaacttttctgtatgtgttactttaaaattaaaaatatgtagaatacaaatgcataaaaaaacagttttgagtacataatgggcataggacataataagaatttcataagatagtacaccaatgatgaaaaaacacatgaaaagatgttcagcctcattcgttatcacacagaaaagtaaatcaagatcataatacgatgccactgtatctactaatttggaaaaagttaaaaagtctgacaattcttagatctgacaatgatgtagctcaacagaaacttctgatatattattaatgaaatgtaaactggtctgataacattggaaacaacttcatattatttcatataattgagcattctttacatatctactcttgggtatataccctagagtcttgcacatcttcttcagaacacatataaaagaacgttgacatcagcaatgcttataatagtcatacatatgtgtgtaaatataagtacacctatatatgtatgtaagtatatcaacataggtatatcaaaaacaaaacaaaacaaaacaataacaaacaaacgaaaggacccagcaaccatccaaatgtccacacagaggggaagaaataaatacacacaatggaatattgcccaggagtggaaataaatgaactatacctacatacagcagtataaataaatttcaaaaaaccaatataagttgaaaaaacaagtctcataactgtacatattaaataacttaaagagtgtaactgggttgtttgcaactaaatgtataaatgcttgaggggatggacacctcattcttcatgatgtgcttacttcacattgcatgcctgtatcaaaacatctctgtaccccatgaatatatacacttgtacccacaaaaactaaattaaaaaaaaatttgaaacagcaagtatccgaagacttcatacagaatgctaccattttcgcaaaacaaaaacataaagtaacatattacttaaagattaatgtaaaaaccagtattatttaaaaggcagtaaatgattaacacaaaattgaagaaagcggttgcaagacaccaggggcaaggagagcaacatatcgacagattcagctgtggtagttaagtctgattctatgctcgatggtaggttcttggcagatcactgtcatattgtgcctcataattcaaatacattcctgtttataccaagggttacttacataacagaaaacaagtggctatattgtggcaaatcagagctttgacaagtatcttgtttaggtaagcatcttaataattttcacacatgaacaaatgttaactgttaggtgacagattttctttattctccttgttagaaacaaaaccaaaggagtatataaagagatacactcaaaagaattgaaaaactgactggcagataaaaacttatagcttggtcaatcaaagaatgaggctaattcatatctaccaccactttggtctcaaataaagctaacataaatgcttgcttacttaattactgcgaacttcagaactgtctgatgaaagatgatcattttgcaaaaattacttaacatgagaaataggtaaactggagtaattcaatacacttcaggttcttaacaaaatgcattttccctctaaatctaaacgggcttttttctctctacttggtcacacaggccagcaatcatatattcaccatgacagccaaaactgtgatgagaaatacttaatccattttaaagagcaaagtttacttgcacaataaataactctttatatttattatatggtacttccatctaaaaaaaatacaattcaattttctcaacaaccttgcattacaggtaaagcacacactgttaagcaataaccactgcatgtagtataatacttaaaaatattttaaataagttagaaatgtgaatgatactctaaatcaaatttgctatccaaatacttcttgagtatctagcatgtgaaaggtactttataaggtgcttttttggcattttatgtgatgcacacggattgaaaatcttagctacgtgctgcattcttgttaaatgcaaatgagtacaataatcttgttaaaagacatctcacactaattcctcttcaaaagaaagggagtgagaagccattcatcctgataaacttgcataagatatactgtactgattctttctctgggcttggatttctttttaatgatgtgcttgcacattaactacaggctacacaatactgaggaagttggagtggggtaagatcgcctatttaataacacatttcctttagaaggatcattgcttcacgttacagaggaaacagtcataaaactacatccacaccattagtccttgggttgtatttctttttgtatgtatattttttacaaggtttggggctgaaaaatcaggcactgattcaaagattaaatagatttaatatgcaatttttaacactaacgtaggcactaaataaatgtacagtgtacaaatgtttatttgaatactcttattttaaaattacttccagtgtttccctgtgttgttcaatggaacataaaatatccactccatataacacttaatttttctatttcctattctttattgttattattgaaattacatacttttaaaagtcatttcctattattaatggtcaatatcgttcttttaaaaaatatacattggtccaaaaagtatttatataaacaagtgtttatctgacatccccatttggaggtctccaagcatttcaagtttaatatgtcaataactgagtccctgttattcctaatctcagatcagctccattcttccaattgttcaggctgccatccgagatgcctctcttcctctcacacccacatacaatcttttagcaaattctgcaggctttaccttggaatccagaatccagaattcagctacttcttactgtccccattcaagtcatctccttctctcctgaattatcataatggccgcctcactggtttccttgcttctgtttttgacacctctttggtctacttaacacaactgctgaagcgattctgctaaaacatgatattgggccactcttctgctcaaaactttctaggggcttccccctctgacctcatctcctgtgaccctccctcactcaccccactccagccacaggaacttcgactggaatactctccttcccagagggctgcatcactagctcccatgctgactcagcctctactcaagtcaccctccgagtaaggccttccctgggtgtcatctaaaacttcctggacatctcccctgcccctgccctcaataccctccattctcctctctttgcttcaatttttatttagcacttaataagataccataaattgaattgctttatcttatttgtctatctcaccaataaaatgtaagctccaggagggtagcaattttttttctcttttgttcactgttctatccccaggacttagaagaataaccgaaatacagcaggcactcaataaatatgactgggtagggtgcatagttcacacccataatcccagtgctttgagaggctgaggcaggagattgcttgagcccaggagtttgaggctgtggtgagctatgctaaccccactgcactccagcctgggcaacagagtccctgtctccaataaaggaaaacaaataaataaataaataaataataaacatgtctgtactttgtgatctcaccagagagtctgcagagatgagcaaaactcatatcctcaccagctgtgacaaacactgcagtgacctcctcaaaaacacactgtcctcttccttatccacctgtagaaactcaccctcttcccctcaggaggtgaatcccaattaagtaaagccacttgtgacaaataatgtctactctgatagtaagaggcagggcttaggcatgggtatatgatttaattatgaccagtgaagttgacaaggaaatgtgggaaaatagccatctttcaaccatgaggagtgacatcaccaagtcactcaagatggcagagtagaaaacagaaaataccatgtgggacactaataagatcattatgacaattcattaactgccaatactccaaattttttgttgagtgagaagatacacccttactgtttactttacttgtagtaaggccttctattacttatatttttattaacacagaaaagtttttacgaatattcacacagtttcccacactgggttaagtcaaactaacacgaagttggattgattcctctggtagaagtcaggggttttccctttcttcatgctgcatgcctagacaacatgtcacatgacaataaaacaagatatttcaatggaaatcatattttctcataggaataatatgttacaaacagggtttcctcttaattaagaattgaaaataaacatattaccaaagcaaaggcagtacaaatatagagttctaataagttaaatggtaaaattatgctcccaatgactacatatttaacaatgttctacagaataagtgctcactcagagggaggaaaacatggaaggagggagagaggaggataggtggtaaggagggaagaagggaggtcccaaggccaaataaattcaggaaatgatgatttaagttaaaatagatcacgacattccctttctatgtgtatacactctggaaggcggttggaggatcactaccttccccttctatgtgtgtacactctggaaggcgctcggaggatcaccacattccctttctatgtgtgtacactctggaaggcactcagaggatcaccacattccctttctatgtgtgtacactctggaaggtgttcagaggttcaccacattccctttctatgtgtatactctggaaggcggttggaggttcactacattccctttctatgtgtgtacactctggaaggcgctcggaggatcaccacattccctttctatgtgtatacactctggaaggcgcacggaggatcaccacattccctttctatgtgtgtacactctggaaggcgttcagaggttcaccacattccctttctatgtgtatacactctggaaggtggttggaggttcaccacattccctttctatgtgtatacactctggaaggcggttggaggttcaccacattccctttctatgtgtatacactctggaaggcgctcggaggatcaccacattccctttctgtgtgtatacactctggaaggcgctcggaggatcaccacattccctttctatgtgtatacactctggaaggcgctcggaggatcaccacattccctttctatgtgtgtacactctggaaggcgttcagaggttcaccacattccctttctatgtatatacactctggaaggcggttggaggttcaccacattccctttctatgtgtatacactctggaaggcgctcggaggatcaccacattccctttctatgtgtatacactctggaaggcgctcggaggatcactacattccctttctatgtgtatacactctggaaggcgctcggaggatcaccacattccctttctatgtgtatacactctggaaggcgctcggaggatcaccacattccctttctatgtgtatacactctggaaggcgctcggaggatcaccacattccctttctatgtgtgtacactctggaaggcgttcagaggttcaccacattccctttctatgtgtatacactctggaaggtggttggaggttcaccacattccctttctatgtgtatacactctgaaaggtgctcaaaggacaccacattccctttctatgtgtgtacactctggaaggcgcttggaggatcaccacattccctttctatgtgtatacactctggaaggcgcttggaggacaccatcattcatctgagatgctcccactcatctctgaagtaatcctaagttcaaagtggaggaaggaagtaggtcagtgatagtttgacccaaaggggtaattttgagtcaaagggttttgatttttagctcaaagccaagccattaataacaaagccagaactatgactatccaaaacaagaactcttcaaattctcactacaaccacctaacaaaccacacactgcctcattataaaagtcttaaaaactttgaaaattctaataaactccttgtactatcaagtaacttactgtagacaaaatagaagatattttttaaaactttcctataggataaacctaactctatccttaacacagtatctgtaatatacagtaattgtttagttatcagtagttttagtagctgtcatttttgaaaaaatatttggataaatgatggctctaaaaaaaaaaaccgttcgaagtcactgaaaaaaagtaggtatttccttcaaaaccttctcaccatattctctaatagtaaacaaaggcttaaagttattctgttggtaaaacttcaaaaagcagcaactgaatcaatttaactaaggactttagtccagagaggatgtcttgctcattgtaaggttgactacagaggtctactgatttcagatccaatccctgcttccttctgctctcccctggtcacactacattcaggaaatgaagcaggagatgcagcagaagggtgagttaagactggaattaaaagtctgaagccacagaaggaccaaaagatgtgtgtgatgtaaaaatgattttacaaaaatataaagtagtctgtttgatttcaaatatggttcttttaaataatgggccactgagaaagctgaaaaattaaaatgatcaccgggcgcggtggctcacgcctgtaatctcagcacttcgggaggccgaggtgggtggatcacgaggtcaggagatcgagaccatcctggctaacatggtgaaaccctgtttctactaaaaatacaaaaaattagctgggcatggtggtgggcacctgtagtcccagctactctggaggctgaggcaggagaatggcgtgaacctgggaggcagagcttgcagtgagcccagattgctccactgcaccccagcttgggcgacagagcgagactctgtctcaaaaaaaaaaaaaaaaaaatactgcatactatgtgccaggactacgttaaatgcttaacgtaggcttaattcctatatggtaattctcaaataactctatgaatttatttccattttacagatgagaacactgagccttagggaggtaaggtgatttgcccacagtcaacaatagtaagtaagtggcagagttggggttcatacctagattatctggtcttgttcaaaaccaccacatcacagcctgtgtcaacttcaatccatttacccataaacactactttggctgaaatgcagtttcttaaagattttaagtagcctcaagtatacttctatactgtaatggtgactttcaacatggaatgtaagttttaaaacaattatcgagtgggttattgtcagttatcattattaactttattaattagacactagtaaatacctgttacaatactgctaagacatacattatttcacttaatcattaattgtaaaatagatactatccaattttacagatgaggctgagaagtttggtgactttctcagttaaggggtaaatctgggattcaaactcaagtcagtgtgtttcacagtaaggcattccacaatcactccccagtaaacctcaacagtgtgagatcaattgccttggtcacctggtctcctgatcatttcatgaaaaattaaccatctgtttacaaatcattcatcaaatttcttgttcctggagctatgctaaagacacaaatataattacaagtccttgctggaccccactagactctttaaataaaaatatgttcctagggtcatctagattctggcaatttctattgcaaattcaccaaatcccttgcttttgttactaccacaggataaacaccctgaatttcccttactggaataaagcctgttaaaactttttgcaggaaaatctctaggactttttaggtatcaaaaagctgaggaaatgttggtactttaaaataaatcctgacccagtaagaactggcactgagccttttattttcttgcagtcagcaaaactacaaacctataaaaattcaaatagtagttaaggggcatgcattttgaagtagttccatatgtggtgagtcacttccaaactcatgctttatactgaaaactttttttaacctggatatgtaggcagaaatcacttttaaaacctatcacagccatactatgaaacgaaaagcaagtccatgtgggagtttactaattgtttcccctgaaaactgttttcctggggggaaaaaatgaatattattattgactcctatgtaccaccttgctttatagttcaaacaaattcagaaactgtttttcctaacccagtattgatctagatatttgcaaaaatgaaatgaaagacaggttaatcatccaacaaacataatacacaagtgtgtatgaggagaggagagctggaggaagtggaaagaactaggtcagtaggtggcagatgttaagtggttcaaacttgaaaggaatcctaaaagcatggaccgaggtttgtggaaactcttaaaagtaaatgaacataaaaaataaaaaataaaaataaaaatgtgtggaagaaaggttctaattagaaggacatggtgattaagtaaaacagtgatcatccaaaaacctattttctttgttttgaaaaatacattagaattaacaatattgtccataacacattatctttctatagcattacactgatgcactttatgtatttcctcatttattctgcataatattcttatgatgtaagatgtatcctcatcttacagatcaaaaaactgaagctcaggttaactgatttactaagagtatatgtgaagatgcagggctcaaatataaatcttaggattctaaagccatcattttccatactattctatttaactgtggctgtgacagtagctgctcttaatgcctactcaagaggtaaaagagaaatataccctttgttttaaatttttttaaaaaaataacaattacctctgctttttctgaagagaaaacaggaatccttatatctcaaataaatgttttcttttaaaatacaagtttacaaggtaataagtagtattcatgtgataagtttatcagaaacaagtctaaatgcctgagccaatttaaatagttcacatttattcatttcatacaatgttgctataaaaataaagtctgtataattctcattttacattaaagtaaccaagatgaagagaggttatactaataaaaggtttaaaactaagaaaatagctttctgtggtcaccagactaagtttaaattgtatatgacttttttttttttttttttgagacagagtctcgctctgttgcccaggctggagtgcagtggcgcgatctcggctcactgcaacttccgcctcctgggttcaagcatttctcctgcctcagcctcctgagtagctgggattacagttgtgtgccaccatggccggttgattttttgtatttttagtagggacgaggtttcactgtgctggccaggctggtctcaaactcctgacctcgtgatccacccgcctcggcctcccaaagtgctgggattacaggcatcgtgatgtatatgactttctaacaaatactgtaatgatgctattcatccttaatagaaatccatgggagtatttaaataatacaataatgttaacgatttcttattttctgaaattactgcgaaaatggcaaattagcagtaactcagtagaggagtatcactattaatacaaactgcatgcccatgtttttaaaacacttacaaaagtaactttaataacactccttgtgaggttatatccatttctatgacaataaacaggctgtctttcagaatttttgtttgtgatatgaataaagccagaagatcaatatttttttaacctacactggaaaaaaatgctgaatattttctaaactttatgccctagataataaagggctgtgtatactgcccacataatctagatggccaataaagttaacttcccaaacctattcagttgccaaaagggtatcccaattgcacatcatattttgttacagtaaagaagattgagaaactataatcatttcctcctcccaaattcagtttctgctactactccgtgtcaccaacatctcagcatttaaatacataaaaccacagtcagcccaaatgttcagggtctatgtatgattacagaattcatctttgcttatgctgctgattctatgaaactcatttcctcctttaaccttttaccatttctttctgtgaactaaatttacacccactacccagatatacatgatcttcagattttgggggtttttttggagggggggatatctctgaaagtcaaacttatttcattcttagatactgttcttagcacgagaaccatgccctaatcaaataaaaaaaaaagtcactatccccaattcagtcccatttagaatctccactagccaggcaggctacttagcaatatttaaaaaatactcttaagaaatagaattgaaaaggttgggtttatcttgaagaaatttagggaaatctgtgaaatgattcttttttaaaaatatactttaccccaatgtgaattaaatatgaaaaactaaggataaattttgggaagttaacaaaacttttatctttgaaattgttacattctaagcaggtaatttattactttcaccaaaagcgtttgtactttccctcttgatgaacagcaaagaatattaagtctatagtaacttataaggaaataataagcaaaatttaagcaaaataataagcaaaatttgtttagctaacatattaaataaattttgcttattcaggtaaggaacattaaaagagcattctacatatcacagtaagttaagtcaaagaaatgtacatattcaacaaaataaagtctgagtactgtcataattacccatatcacactttgcaacctgtaaatttctaacacacatgatatcatttcaagtcttcatacaaagcacatgaaaaaactgttgcacaaatgtaagtaacttgcgtaatataacaaagatgaacttttatcttttttgatcgtttctaagctttaaaattatatcaggacacactctggagttgtgtttcaccaatactttgatttatcaccctatatgtgggaggcatcaagttgagtgctttgtaagtcacaaatttataaaagatacaaccccctccatctagaagtttataattttgctgcagcgatgaatgaaacgctatgaaaaataaaggcagtgtgaatggcattcatcaaccactaggagaaagtagatgggagcacatgttcccttctgtccgagtgatcatacaaatcacaggatggatggccttttggtaaaagaaaactagtagggttcaaaagacatctgagctgaagatagcaaaaataatgtggcagaataagaaatgtgcaattaacatgcttaaggaaggggcaaaccaaatatttgatcatgagatatgcaaggaaccaggtagaaataggacttgtcttatcttgtgagcaaaggtctttgttcagggtaataataattttctgcagaaagttttactttgctgtgtagaatgtattgggtaataaaaactaaaaggcaaaagaccaaatagaaagttactgcagtaactatctaataactatctaataatcagaacgtaataaagcctgaatttggaaaatggcagtggaaagacaaagaaaccaaaactcataattcttcctgttccaatgaaaatgattattgacatagtcataattagggttgactgcaatcaaatgttaaatatgtaaaggtgtaatataaaaccaagaacctgccaacagactttcaggaaagactttgatcacatttatcatctcatatttatcctacaatgtaacaaacattataatgtcccctttgaatgtattctagggtaccatataccataacttggtatgtctttaattaaatttttgtactattttaaaaacatttattgtagttgacctaaaaataaaactttgagaactacaattagataccacctgtataaaatgaaagccaaactatacttctctttccaaagaggaaatttggaaaaattactttccaaaaccttttgagctctgcctgatctatactaagataccaaaatataatgtatgtctcctatattttacagaaacagaagaaatcttttataaatgtacttctcagactgattaccaacataattttattatccaaatgaaaaaaacacatatttatacctataagaaaaattacctgaccataataataaaccctattttttgaaaacttcatatttacatattacctttcaaagggatgtgtatgtcagtttgatgaaaaaaactactttcaaattattcaaatcatccaaatgtattcttatgcttataacttacaatttttgttttcatttcctttaaatattccctgccccagaaaacctataaaggcaaattttcagaaataaaaaaaaatgtgtatcttctccatgcattcaataaataactagtctataaacaggtatgtcctccttctagatgctcagcctcagactagcttcttcagatttattagtaacgaacgcaacagaaattcttgccttcagggagtcccaattttagaaagattaaacaataaataaactatactttaaaaagaaacacaaatttcattgtatttttaaaggtgttaagtgcttggaaaaagagaacagcataaaggagagaggaaaaagaggaggcttccgttttgaattgtgtggtcaccagggtgggcttcactgagaagacgccttttcagctaatgcaaggactttagttttataccaagtgaggtgaaggcttttaagcagagaaatgattttcttttcttactacccaataagaattgagtgtcaacaagagtaccaatttcatttaagagtgtggaggtagtattatcaaaaatgtgttgggggtagggctataaaacaaccactgtatcccagatctgggaaccaaaacaagcactaaagtgtgattatgccgtttatttctcaaagggctattccctccacaataagtttccatattgactgttctcacaggtcaatagtcccttatccacattcccaattttgaataccaagaagctttaaaacccaatttggtggcaaaatcaaacccacattaatgtgagatggtttatagtcttgatttatcccatttggcaaaaataaacatgaagaaacattaaccctcaaaatttaggtaacctttaaatatcctaagtaatgagaagtcataggcacatctatatgtacacatacaaactatctgtaaacttccctattttattaaatatggtggagttacagcatacagcaatttatcacattcaattaagccagccatgcttttgaaaaaagaaaaacacacttcccctaaaagtaaaattctacctagtataatagaagctggaataagatggaagatatgaatctactgttacagattttgattttttagtttaaagatatgtatctgtcattcaacatgccccctaaacactggctaattgatttatctgatgttcaaccaaagaaaatgctacttattccaaaatagaaggaaaaataggctgtttgaaacttactgaaagatggtacttcagcatttgacatggcacctttctactggatttttaagggtaattttaactagtcatgaacttgactaaagcactgtcttttaaaaacccaaaatgtaactctatagctgtgctgtctaatacagcaatcactagacacatgtggctactgtgcacttgaaagatgactagtcagaattcagagagctgtgcgtcaaaacacacaccagctttcaaaaattcagtacagatttacattatttttcaatgcaaaatatctcataattttatattgattattcattgaaaggataacattttgcagatactgggttaaatcaaatatattattaatttcaccagttacttttaaccatagctactagaaactttaacatttaaaatttaaacttacataatgtagctcacattatacttctagtgaacagcactgctctataggaaagacctagaaaaagattaatttttcaaatacttatatgctagaatgaataatatcaattttaatcaccagaataataaaaacacaaaggtcacaagaaacgcttgtcaggaatgctgaaataagtgttttgtgactcaaaagtatctattactttaaatattcaaagaggtgtccaaatattcaactaataaaaaaagccttcaatacatgttatgcctgatttgcttcaaaatccactttcagtatttcaatcatacgatcataagtacatagaggaggatattgtgtcctagtttcattcactagggttagaacaaacccaggttttgtgagccaaatacatattataatggaatcagaaaataggtaacttattttttaatagatgggaaaatttaaataactcctaagaaacaactttagagtttacattaagtcaaagaaaaataagtctctctaattataaaacctaccattaacaaaagacacactgattgacatttcctaaatattcttaaaagcactgtaagtacctattactctaaacacatgcacatcccaccacccagcagttccactcccatgcttacactgtactcatgagaaatgaaggcttatttctaccaaaagacccaaaaaagttcacagcagccttatttgcagacacaaactcgaaagaaaactaaatgtccacttacagtggaatggataaatggtggtataatcatagaatagaacatagacaatttagggggaaaaaacaaataacatacacaacatggatgactcttacagacataatgttgataaaaaaagacactgatgagttcatacgacatggttccaactttatatagtttaaaacaggcaaaactaatctatagtaaaagacgccaaagactattcctgttaggtagaggcaggatcgattagaaaatacacaaattacaataagccttctggagtagggtgctagttactcagactatacttacataaacaacaatcaagctagcaaataagggtgtctatttgattacatgaagttacacttcaggaggttttgtataaaaataagaaacttcttcttaaaaggaccttatgcattatgatttcttttcaaaataattacttaaaactaattcctatcttgaatatacatgggaatttgtcgatttaatccttcagctaaactttcaatttctttgcagtttctttttaataagaataactatcaactctattgaaacatacctttaattttgagatatgataacctttcatgaattgataattcatattagcattaaaattataacttccatctttatagctaagtgtgaatgtttatacgaaatatttataatagttcattctcatctttaatttgaaaagataactctgaattccataaaatccagtttctgatcatataatttattttactgataaagtatattttaaatttaattttttgggttcatttacaagttctttcacagacctaatttgcttatttacatttcttatttgcttttgcctttcccccgtaaccgacaaaaagaggaagaatatgctggtttgccaataaataataatcttaaacacagagtttccattttaaaagttcaatgcagcatgctggggagacttattaaaagactgtattcaaccaaccctagaaattcacactgcttgacagtgattaagaaaatcggtaaaaaccaatttttgtattatttcatatgaataaaaatcatgaatattcagctaataaagttacatctgtattatagtaaaagaaggtggccaattcactataatcttaacaaatacattattttattgcatgtatttatgcatccttccttcatctgtttctatcccaagcaagacagctggcaaaagtttttgagaaggaaaacacaagatacagaggaggtataaggtcgaatattaagaaggatgccttggatatagatcaagaagactatgttcaccactgacattagtcaaattggctggcatatccatatgtgatctatgaggtatgctatggcctgaatgttgtgtctccccaaaattcataaattgaaaccatatttgcaatgtgagggtaatttggaggtggggcctttggtgagtgattagatcatgagggcaatgccctcatgaacaggattagtacccttataaaagaggtcccaataattctctggccacctccacccatgtgaggttacagtgagaagtcagccatctatgaggaacaggcccttactaaacattaaatctgctggcaccttggtcttggacttcccagcctccagaactgtgagaaataaacctctatggtgtataagcctcccatctatggtatttgttacagcagctcaaatggactaagataaggtacaaaagacaaagcacaaagtgagtaagtttctcaacagatgattttaacataaccttccttcctagtaatatgtcacatgtcctgacactctgggcctacaagcagataaattattatgctataccaatctatccacaaatgataatgcaaagagagaatttcgcaaatggatgttcggaggcaaaaccaggtggcctggctgagtctgtccacggactctgatgacagactgatccaaatgcagatggcagctgatccctacactagaaggtagagctgtcacaggcaggaagacttttaagactgcctgaatgtttcaggtatacttcacactgtcttagataaaaaggaactttatgtatctcattttcaaatcaagacattctttaaaatagttctatagtagtaaagtaaaatgtaaatacctcagtgtttaaaataggtaaaactggtttactctaaaccagacgttttattcgcttacacaaaattttgatttaccaaaattgaaatataaccttctttgtgacaaatggcaaggtagtttatccatatctaaaagttaaagaaaaataacaaaatgtggcataacagtcttacttttctacaattggaaaggcttgataacatttttaaaagtggggcaatgagacaaaagacaataccttctggctgtgtttctcccaaatgttaaaataatgagtcctgagaacagttctgaaatagctcacaatccaaacacttcctgaaaattaagagaaataagtgttacttcaagtgcaccttatctcaaagatttgttttacaatggaattttaactactaactaaatcatctcaaaaaacaacaaaaaagatgtattacaaggtaaaaaaaagtattcatattcttcatgatacatgctttctttggacatagttgttgaccacatgtaacaaaacagctttcattacagaattatttgccaaaatacactacccaattgtttttttgtttgtttgttttttgaggtggagtctccctctgtcacccaggctggagtgcagtggcgtgatctcggctcactgcaacctccgccttccaggtccaagcgattctcccacctcagtctcccaagtagctgggattacaggtgcccagcaccacgcccggctagtttttgtatttttagtagagacgagttttcgccatgttggccaggccgatctcaaactcctgacctcaggtgatccacctgcctcggcctcccaaagtgctgggattacaggcgtgagccagcacacccggcccactactcatctgtttttattttactataaagattgtccctattgtcaatgatgtaaaaagttaatgtcaaagataaagaggaatttcagtcaaggattctgggagaaaaagtattagaattatttaacagtcattgcagagtttgaaacacctcatttcttttctgtaccactaggaacagaaaatgttaaactcagaattagaaccatactagatatagaatgacactgacgtggaaaagttcatactttcaggaacaaaagagtggatcaaagtttttggccagcaagagatgtagcaaacaatttaacattgtggtggctgaggaaactttattttggtcaacaggccaatggacagtgaagctagcggtgataagggaggtaccatgcgaactccctgataccaccatagcagcattccatttctatcagccacgccacttagatctgacttatacttctagaactctcaattcctagcctataacctatgatcagttctcacagattatagctttgaataaaaatacatctgtaaacctgaattctaacctcccaaaataaagtagctatttttcattttcatttcattttactgggggcccttcagtctccttaaaaccacttaaagataacaaattgcttaaagtaatacttccccaaaatccagctcttcaccactatacctgtaggtcacttagtctgtatcttgcttattgttattctccctgtgtctgtgagccttcaatacccagcatggtgcaaggtatacagctggtactcagtaaatgtctgataaatgacatcaattaatcacagagccttaatcaattaatatgccaggcttaagtaaaaatataaaagagaagacggtagttttatatggaccaactacaatgaaaaatatatgcctttaattactacacacacatgcacattctctctctcatccactcattcactgtcagttcttcatcagtaagactcctccagtatcttatttcaatgctctcctaatccccccggcccagacaatcagcctggttgggtggtaggtgtccattctacccagatgagttgggactctagtgtcgctgtctgacgtcctataccaaccagcatggtactcaggcattattaatacaagtctctaagcacataaaggcatacctcagagatatagtgggttccattccagatcactaaaataaagcaaatatcacaataaagcaagtcacacaagttttttggtttcctagtgcacataaaagttatgtttacactgtactatagtctattaagtgtgcaaaagctttatgtcgaaacaatgtacataccttagtataaaaatactttattgctaaaaatgctaacaatcatgtgaatctttagagagttttactcttcagtggtgggcaccttgcctccatattgatggctgccaaatgatcaggcttgtggttgctgaaggttggggtctctgtaatgatttcttaaaacaagacaacaatgaagtttgccacatcggctgattcttcctttcacagaataattctctgtagcatgtaatgctgtttgatagcattttacccacagtagaatatctttctagatgggagtcaatcctctcaaaccctgccactgttttatcaattatgtttacatgatattctaaatccttcgttgttatttcaacaatgttcacagtatcttcaatcaggagtagattccatctctagtaactactttctttgctcatctataaggagtaactcctcatccgtccatgttttctcatgagattatacaaattcagtcacatcttcaggctccacttctaattctagttttcttgcaatttccaccacatctgcagttacttcctccactgatgtcttcaacccgccaaagttatccataaggggtggaagcagcttctttcaaactcctattaatgttagtattttgacctcctcccattaatcacaaatgttctcaatggcatctagaatggtgaatccttttcagaaggtttacaattgcctttgcccagatccatcagaggaatcactatctatggcaactacagcttcacaagatgtatttcttcaatagtaagacttgaaagttgaaattactccttgatccacaggctacagaatagatgttgtattagcagccatgaaaattaacattaacttccttgtacatctccatcagagctcttgagtgaccaggtgcgtggtcaataaacagtaatatttcgataggaatcttttttttctgagcagttggtctcaagagggggcctaaaatattcagcaaaccatgctgtaaacagatgttctgtcatccaggcttcttcttccatttatacagcataggtagaagagatttagtataattcttaaggggcttaggatttttggaatggccaaacattggtttccacttcaagtcaccagctgtattatccactaacaagaaagtcagtttgtcctttgaggttctgaggccaggcattggtttctcctctctagctattaaagtcctagatggcatattcatccaacagaaggctgtttcatttacactgaaaatctgctgtttaatgtagccatcttcatcaatgatcttacctagatcttctggaagcttgctgtagcttctacatcagcattacctgcttcatcgtgcacttttatgttatccaggcagcttctatccttaaacttcatgaacaaacctctgctagcttccaacttttcttctgcagtttcttcatctcctctcggcctttgtggaattagagtgaggcgctgctctggattaggttttggcttaagggaatgttatggctgctttgattttctaggcagactactaaaatattctccatattagcaataaggctgtctattagtccgttctcacacagctatgaaaaaatgcccgagactgggtaatttataaaggaaagaggtttcattgactcagagttccgcattgttggggaggtctcaggaaacttaaaatcatggcagaaggtgaggggaaagcaaggcaccttcttcacaaggcagcaggaagaagtgccaagcaaagtgggaaaagcctcttataaaaccatcagatctcggccgggcgcggtggctcacgcctgtaattccagcactttgggaggccgaggcaggcagatcacgaggtcaggagacagagaccatcctggctaacatggtgaaaccccatctctactaaaaatcaaaaaattagccaggcgtggtggcgggcgcctgtggtcccagctacttgggaggctgaggcgggagaatggcgtgaacccaggaggcggagcttgcagtgagctgagaccgcgccactgcactccagcctgggcggcagagcgagacttcttctcagaaataaataaatcattaaaattaaattaaaaaaccatcagatctcatgagaactcactatcacgagaacagcatgggggtaactgcctccatgattcaattacctcccactgggtccctcccaggacacatggggagtataggaactacaattcaagatgagatttgggtggagacacagccaaaccatatcaggctgctttgtgttcttatcattcatgtgttcactggagtagcacttttaatgtcctttaagaacttttccttttacattcacaacttggtgaactggcacaagaggcctagctttcagaagagcttggcttttgacatgccttcctcactgagcttaaccttttctagctcttgatttaaagtaagagacctacaacttttccttgcatttaaatacttagccattatagggttattaattggcctaatttcaatattgttgtgtctcaaggaacagggaatcccaaggaaagggagatgagatgggggaacagccagtctgtaaagcagtcagaccacactgaacaagttcgccggctgatatgggcacagttcatggtacctcaaaacaatcacaatagtaacatcaaagatcactgattacagatcaccatgacacatataataatatgaaaaagttttatatattgtgagaattatcaaaacatgaccacaaagacacaaactgaaaacatgctgttgaaaaaatggtacttgctcaatgcagggctgccacaaaccttcagtttgtaaaaaacaaaattatcttcaaagagcagtaaagtgaagcacaataaaatgaagtatgcctacacatcagcaacaccaaagctaccctacatcattaacagggtatgtcacctaagtgtataagtcaaagatatctagaatcttaactacaggcaggatgttcccaaaatcttagtcgacagaaggcatctcctcaaaatagagtttataatcagacaaaaacaaacagaacctgaagagacctccaggtgataaaggaaaaacaaaaagcattatcatttcctattaggacattacttttttaggagctaaataaaaacattaccaaatcattttatgtaataaaatttaaccttattttgacctttctcataaagcaaataaacctctctatccaataaggttccatctgaactatgtaagatgataggcaataccttaattgcattcatttacatgactctgaaactattctgggctgaagtcactgaccgcaaggtcacagaatacaaaaaagtagaatgtgtgtaatttaccaaggagaaatgatccacttagacagtgtggcagcaccttttccatccttcattaggggatactaaatgcttaatgcaatcaacaggtgtagacatctccatttaaaatatatcatacaaatacatacacacacacacgtattcattttacaaatatataaataacactaaaatatatatttgaataagtccatcatatattatggctttcttcttaaaattaatctgcctaaataaagaacaattctataccctaatagcatttagaagcaaaatacaatatagggccattattttcccattgtcttataaaatttctaacacctaatattcaggttacaaagctatagttttaggaaaagaatttaaaacacaggatgccaagtatgttaagagttcttgctttcattttttataacctaaacacgaatatattcaactaatttgcttagagaagcatagtttacatgtctcaaatccaataatactatattaataaaagaaaagaggtacaatagattgacagattaacaatcatagattacaggggataatgtgtattctccaaaacctcaagagtatatcaaaacacacacacacaaaagttaaccctacaaattatttccctttagctttgtaaaatgcaattgtaacacaaacaaggtattattggcacttgaagttactggagaaaagagaaggaactcaaaagaataggatttagggtactttttaaatgtttataatattagtacatatgcagactgtgaagtatttgtttcaggtttaatacaacatcaccaaaagattcatttaaacagtttccacacattaaattaggtaaatctctcacatttaatttactatccaagcacttttacactactcaagccaatcttttgcaacttacaaatgatttaatgaaaaaaaagctatgatattataaaattcatgcttcttcattttctctccctatagagaagggcaaaacttttcttacgtaaatctatattagatccaaatcatttcaagagatgctactccacaaagaacacacagatggacatatatttaattaatatattcctaaaaaacttcaatacatgatgtcactttgtcctttgtaaatgagaaataaaatttctcaatgtcttcttataagttaagccaattcactttggattagcttagttttaaaataaatgcatacatatacataataaaatactaattcctattgttatctacatataactttcagtgaccacatcttggtattttaattttctttctataagaaacaattcagagtcagacatgaaatatatgtgtgtaactaggtaacaggcaatatttggttcctattctttgacaaggataagctattgagaccaatcagaaccttccaatgtgtttccaatgttcttggctacatttctacttaaactcaaacctcaggaagaatataatctgttaagataacttttgtttttctcaaacattctctctctgcctatcccaaaagaatcaatcaatgctttatgttactaagttcactgattatgaggacaatgtctgaagatttcatacacataatattgggatcttccctttccttgaatttcagaatatgttggagccaatttctataaccaaaacgtagtatttgtgtatctttaaatgagctacaatccagaactgaaaatgaactatactaatggcatcgcacttaacaactttcaatgaagaaagaaataggttagagtctaagttcaaacacacttcaaactcacgtgaccacagtaaatcctacccttaaagcaagtacatatgtgtgtattgtttatgtttcttattttctgtatattatgatggttttgactcctttctggctgggaagagattgcccctctaggggccagccaacgcttagagaaggcaaaggactcagcgtgcctttcacatgcaaactaaacaatccacagcgatacctcctctacctgacccatacacccaggaggcaatattcccctgcctggtatctaccaggcaaactagggatcactcttacagtttagagcctgtatacctataacttattcaaagctactattattacacacctatagcttattagtagtagtagcagtagcatttacctacagctaatgcaaactagcgaatcctaaacttggttacccgccctgccttgcctttcccacagatactccagaaacggctgcagcccggtctctcttctagctcctgcccctttggcccctagaccaacactggggctttctcatgtggccctgaatggcatgctgtgcctccgagaactcatgagtataataaactttgttttcctgagcccctcctgggtctccttttcacatgcacctgactgaccacataaaagaacacagaactctgtgtgtgtgtgcgcgtgtgtgtgtcattttcattttattttcccttgttcaggtggtcaataaaaaattattacacctttaaaaagaggtacctaaataaacaaacctaccaattctgtatgcaaaattaaatcctggactggcagtgttgctcagataacactcagaaaagaacaatgtgactgaaactgtaaggaacaggtcaaaaacactccatttaaaatgtgaacacctgctacagaatattttgattcacaagtccatctaggaaatatttttcttcctccctcacctgttcccccacctatcttgcattcaacaccataaacagcacttatcccccattataaaacagttgacggttaaaacaatgagccaaccaagaaagtataatactctataactgacatttactgcattggccttggacttctaatctttaccagacgggcacacaaatcaatccatcagctcataaaggtgtgcttttttaacctctaaaacagatgggattggccagaagtgtctggcatgtcaaactgctaatcactgctgccctttgcacaaaataacccacttaagttgaggcatggttgcactgtaaccgacattagtctgtgggaaacccatttaactgtcacacactcctgccactcctgctctcccttaattaagcctaatgccttatgctttgaccttttgttctagcctattaaccctatctagtacaagttcaattatgttaagctaaaaactttgctgtaaaatattaaatgccaagctcaaaaaatcataagggacatcctctcagccctaagttctattcaccctgatactcaatacatttgaaagtaaaacctcactttcgaagtaacgctgatactgaagcaaggagatgttgaatgactcacccatttcatagcttttccgtggcaaagcctcactaaaacctatctaatccctagctccaattctttaatctccatggtgcttctgattaatagttaaaccacccggaagtatgttaaggatactaacattttcaccccgaagtattatccttcgccatcctctagaatatgctatgcaaagaggcctaaaacaaaataaactgcgacttcagcagctgagaagtaatgattcctttcccctcccacacatcaaaacttcctatcctatcccctcactactttttttcctttttaaaagtaacaatggtcattgagaactactaaatcctgcaacactcacaaggtagtatgtacaaccacagttttcccccgcgatacttcactgaagtattcaatacagccaatgacttaaactacagaaggtaattacaacttgctacttatcctcactggacaaattcacgcagcatatcttttcaaatacgtcttttttacacctatatgcatatgaattgctgctcacatttaccagaattccaaaaaacacaatgaaaaacacttcctaattcactgtaaaataaaacaaaacgtagtccaaagtaacatgctatcattaaagatagttttaccacagtgatgtatactgttatttttccttccatttacttcatacaattaaaaaaaaggttcctaccactctcactgtgacacataaacaacttaaagatcagtaacataaaacaaaatttgaatttctgattggtataaagaaatccatattaattttagattttcaaaagatttaaagtcagattttaattttacttttgttgactgcccaaaggcccatttttacctattctcaatattaacaaatattgtcagcttttgcctttagcaaccctaaactttacagttttaaagtaacatgccattaaacagaatatacaatgattttgcaaaagcaagatcgtttagagtactgccaaaacaatgaataatctcaatgagataatttattaaaggaggaaaaaagagaacgagagtttaaaattcacagtgaatgtgtttgtgttgttagaatgatgcctgcaaaggaaagcattccttggcattatcgggaggaatacccatggatgtgtaaaatgtaaaataaatagatagatgtatggtcaaagctaagcaaacacttgtatcaggggcaactaccaggaactttagttttattcacccttttcattgcaaaggataatagtgttaattttgatcagatgtcatgccttagctacaacttttagttcatgaaataaaaattaagtttgggtgtctgctgaggaatccaacagtgggaaattcacactcacaactaatttatagaaattcacacatttctataacataccgactgacactaatgaacaatgagggaaaaaattgttcaggaattcaggataagtaagcactggaggaaagcacacagtagaacacagtgcataaatagtaaatgtgctcatttttctgcccttttacttcatatattagtccattagcttgttcctttttgctatgatttacaagcaggtgaatacacagaaatatgagccaaaagaaatatactgtcaaatactcatgaagttacctttgttaaacaaaaaagaaacaacaaacaactttgtcttcacaaagcaagaaactaggttaaagttattttaagagcatctgttaaaaatcagtgttataaatatatatccatataatttattttctattagcattttaaaataaatttctcgtctagaaatctctgagctccatttcaaaataattttattttctgtctcttaccagcagttattaatgtagttgaatatgactcttagaaaagagtcaggaaattcaccttcagtgaagagcaaatcctaatttttaaaacatagatgggcttcatatactacttaatcccataacttaccaagttctgaatcatcaactgttcttgataccctcttaacttttaaggttactgcacaccaaaatgaactctggatgtgaaatgttaagatttccaccttaccaagccgtcaaatccaaggcagttaagtgtgcccagctggcgggtccctttgactacaggaagtgatgctaaggaaactgcctagtaggctccagaaatatttgtattcatttccttacaaaaaaaatgttgcccccaaagattttgctaaacgttttctaatataatttgcgtattactgaagaaatgtaatattacaaaacaaattatttcaagtaccaattaattataatgtcaataacagtcagtttcactttttccctcataattagtatgcctggaaagaagaagatacattttaaggaaaaaatattgttccttttaaaagtcctaatttaaacagactaaagaaaaaacgtggaagagcttccattattcataagttacacataataattaacaactgctatgcataaatacataaaggttctactgctgtgccaaattttgccagtggttgggactggtacagttcaatttaacaaatgcttatagacatccttctgtgtgccagacacttacaggaccaacagtacactgatgaataagctcctattcatggagttctaccaaggaaaacagctataacacaagtttaacttttacaatcagggcgtacacaaaactgtgaaagaaaatctgatcttgttagaggcttggggacagaagtaagcctacaaactcccttgcccactgtcccatgagggagaatattcctttccaatttgtttcaccaacatcaggaacgtggccagtgtgtggtccatgaaaaggtctacacataggtttcttctctcttgctctcttttctaggggtgtagaccaacgtgcacttggttcatggcacattatcaccactggtccacacagtgccccctcatcttatttgttacctttctcaagagaatagaggaatggggtccataaactttgagatatgtttccagttgaaccaacagacccaaccacctacattaatggtgttggaatactactcatcagtaaaaagtagagctggcctgtgagtgttctggtcaactaaaggtatctggctctctttgtctgcaaataaatagcaagtctccctacttctttttaaataaaattccaaatgtacgtaacatgtaaaacaatgccactgcatgaacatgtacataactgtactattctttttttaaattctcagcctggaaattacatttcaagtactagaatattcaacaaatcctaagacttttatgaagaccatgagaagaaaataaggtactagaacaaaagtgatgcagccagccaattctcgtttcatgtctcaagacccagttcttattattatagatccctttgtggggttagcttggattttactgcgggatccatcaccaaaggttattaactattccttaacacctggtacacaaacccctctttctgagactgctttgacaaaaataaacaaaaaagtgtgaaataaatcaagatttgactgaccatcctaggtctacccaactgctagctgaatgactttcaaaacgtctttaaattcttaaggactcaatttcttcctccgtaaaatgcagatagtaactgttttgggcattttaacttaacagcaataacaaaaactacaggaagataagtaattattgaccccattgtatcacatggatcccctggcaattaaaaaaaaagatgaatgagatattaagaaataaaaaggaaaacagagtaaagacaaaacagaaataaagaaggaaacccaaaaggaaagaaaatggcacataagcactaaatggtagcattttatcattattttatttatagtctacactaactgtgtgctcttccatacaaaagatgcatctaaaaactaacttgtttgataaatggggggaggacaaggtgcctctaagataggtgtgcttaaatccagagcagccgtagcttttatcaaattctcttccaacctgaaaaatctaacgattctatgaaataacttcaatttgtgaaagcccaagcaaaagaaattcaaagttaaaaaaaaaaaaaaaagaaaatgtgactttgactcaggtcagtcaagtattaccaggatagataaaagtagatttttagcaatacagttaacaatgggtcttgccacaataatagcaaacatccagatattggaaaggaatcagatggtaaatttaaaaaagactgttttcaatccttatatttggcttcacatagattcagtgtattttaattcatttttttttaaaaagcatggatcagttaaggaaataatataagttcattctgatctttaggaagacattcttccccccatattgttcactttgacaatttctcttttttcttatttggccaaaatataacgtattctctaaacaaaacacagatgtttcctttgcagcttttatacaaatctcttgcttttccaacatgatttggcaactcaaaatccaaagcaccctagaaaatattatgtttacacgtcttattattcatctttgtgtctccaatatagtttcaatttgactatacctttcagtgtatagggaaccactcagcttgaatcttttaggttcaaaaattccataaattttaaatgaggcaagtaaaaggaggtggagaagctcataactccatttcttatggctttaacaataaaagaacgtacctggtatgtacttaaaaatgtactatgtgccacaaagctcccccactcaacaatctccctcctgacacagtctaccctcaaaataaagtcaactactcctcatctctctgcttccacttccttccaattcacaaatacattgttaatttcctctttgcatttcagagagcagtttatcagcacaggatagtctttaacaaaattgttgtgagtgaagatagggtaattaaaaaaaaaatcatgttaagaactgttaatagtcaagagttgtaacttttcaaccaggaagagctatggttctgaatttgctacaactgctccttgaagtggacaaacataactagccttgggaacactcagtttaagaccatgacaagctatttcaatgaattatataaagaaacatagttgctttcactgcctcaaataacaccgcagtaattctgtgatacacttcagaagagttagcactggagggaaaagagcctgtgcggcagcccttggtgactacatttccctccagcgcaatgcaggtagcaggacatcagcgctttgagaactagcataagctgctgcagaatcatcgactggcaacaatgtgccttcccagagagcctggtcttggagaatccaggctatgaggcttgcaaatgctgcatgagttttatggctaccaggttgggagcaaggttttttaacggcttcctgaatgtcagatggcaactggttttttcttcaaacaatggcatattctttaagaaaatcaaattatcaatgaaatttgccatgtgaccacaggcaagttaactattcttgcatttttcagactaggtttccttatctctaaactagagaaaatgatacctacatgtcacaggggaactggaaggattaaaagacaaaatgtgtgtaaagcttccagcacaatgtctggcacaaaacggttgccccaaaaagttcaatactcttcctttccctgctccccctcccaacaaaacaggaaaaggcaacagccaagtaactaaacaacttcttaatattccaagtttctacccaatcatctcttcttcttttaaaaccacaggcttgaaatctttactgtttactgtcaacaacggcatatactgctgtacagtcagaattttagaatttagaaatcaaatataacccccttattcaacagatgctgccgggggagataaaagggctttccttttatctgtatcatcttgatttagtagcagaacctaaactcgaaaaataaacgtggaataacaggaatactattttttaacatgtttttcaaaaatcaaacctgagcctacataacccattgtgcaaacagtccctttaggagaaaaactgcaactgtgattaatttctctcaagaatatttatttcccatttggagagtttcacatgtttccaaacatattttcttgatgtcctccatgtcattgtgtattctctccttcccttaatttgtttcttttccagtgtataaatctattgctctattatagattattataatataaactcataaattcaggaatttaaaaaaaatctttaaaagcatgcttctcagaaatcattacactctgttaaacacttgctatctctcaacttctagatagattcctcaagagagaagtccttttttcattctgaacttctaattctcaaattttgattgtgtcctgttagttaccaaacacaccattatactactactctcatttcaatattgtacataaacgattccccatcttactaatgaaatgcttttttaaagcagtaacatatttaacatgtgcacatgttatgaagagtataggcaaactcaactattaaaaacatgtaactataaggaaagccatcttagacactatatgtgactacagctaagcttttctcttaagtatctaaagcaaatcaccagacttttacatagtaccctcacatagctagataagaaagtaaaagtaaaataatgaaagcagactctaaacagcagaagctccaaactccttagtttctctgttgtgctcaatcctttagcaaattacaggcctgaaaacaaggagtagctctatcacttaacaagtgactaaggaatgactttgttaattagaagtccaagggtgagaggctcctttccaccaaagctctgaataaacatcaacatcaggtcaaccagagttgtcttggtcccaggagtagcttaagcggatgactcaaattcccagcagaattctagtttaatatttattggaactccgagcttagtcacacagtgacttggaatttaagacacatggggtctcttctttccatccttaaagatatttttgctaagtgacacaaagttaaagaggcaagatgggttttaatttagagtttttattccctgaggtgtaagaaattaaaattttattttctggggagagtgaaccatactagctctgaatttcaaacacaactattaaccctgtcagataattctattatcaagttttacaaaactgtttactattattatttttttttgctaccccagccctatgtattgaaagtggaaagaaggaagggagggaaggagggaaggagagagggagaatggatgaatggatgtatgtcacaatcacctttctagccaaaactgcaacatatgctggagttcttgaaattatttcaaccaaaaaaagaatcacaggactcataatttgtttagcaggtaattatttgccccattatcttcaagaacaatctatcttaaaactgtgtatagctttttaagaaatcttaatactaagaggatcctttttttcataaccccaaagagtgttttcttcctctatttttgaattgccagccttctcaattctttaaatctgattcacattatactacttttagagttctaggctaaatgtttatccatagcatgattcaaggtattaatttcaacaaaatactaatataatgataaaatgtatcacatttattttcaactctttcctattcttctgatttaagaacttaaagaaaaatattttatgtttcgggtgcattttgataagctaaaataccacaacttttgtaattcttcatttgtaatatttgcaagatagtgtagggatcaatttgaatttcaaggttcatgatatagagtatgtaccataacagtgagaaaagttagtataaattcctactcatctcagtttctatatttattgcaacaaattaaaactgcatttcataactcgtagtaaaacaaaaggaaagttctgttttaaataaactccaaccttcagaatcctatacattcagtatccatcaacctgaacactaaatttcaagaaaaaacaacagatgggcatccatataatagtttgcaaagaaaccctgataagacttcaggagtttctgtggtctctattttccccctaccatgaatcataggtaatgtgcttaaataaagcattatttctgcagttatttacatgtttatctttatcagagatcctataaaagaattatccagttcaccacccaaactttagcactcagaacacggttttccctgttgatgaagacccttgtaaaattccagatcttaaaagattaaagaaaatgtgatctaatattaattcattttcctccaaagtataactcctgattccatgctggtacccaattttgatcctctactttaaagatatctcagagacattcaaaacaaagtgtgaacatgcacaaaaggggaacttgtcgtttctctccctcaaacaaccactatttatataatattgctggcctcctaaaagagaatagaatccattaccatcagcaattcatgtctctgcttcagcatcagatgcaaacaggatacagaaactagatctctctcctccatttactttttgttcattccaacctctcgacataatcttcagttccattccaatggcctgtttcaccatctgacactcctggtttttaccttctcaagtcttagtggccatagtggtgttacatttctctaattgttgtgttatctaaatactacaggatgagcctgctcattccccctcccccaaaagtccctgaaaaaactacaacttaaggaaatgcaacttgaacctttttagttcacagattcaaactcatatcctgcaagaccctagcatatcttgttgaaaattttctttgacttttcaacagtagtcaagattattttaatgaaaatatttctccagttggaagacatgggtatacaggactttgctagaacggcaaatgctttttcccagtcttcatccgtgtaacagtaaatcgttattaaacaaacacacagaacaaaacccactctgattgtgtatcaatcacctgaaggggcagaagggaaaagtacaagagtgaagaaacttctccccacccacagccaagaaggaacgctgcaactaaggcagtttttcatggaagaaaatatccaaagatctagacagtgtttattttagaaaaggggaagagagcaagggagggagggaaatggtagggaagggactaccatttcctcttactaacctacattaaaaactaattgtatcaagcaatctcaaatgcgaaaagcaaaactgaccctagcacaatttaaagtgaataatgttttccttgacaaaaattcggtattttaaactcattctgagcaaaattatcttttaacctgatacaccaaactattactgcttttcccaaacaacagttagaacatgagcttttgagtttcttacattctttacgttttaaaattaaaagccaaattcctttaacctcatatatcctaagccactctgatttaaaattacttctatgtcattgtcttctagcattggtctgcaatagaatctgtgcaattaacaataatcttcttccctctgatctttctagagtcaaggatggcatatctccttatcttatttgttccattagattggcatattttgcctcatctgtcaccttctatcaaactctgctttcagatatgcgttaattcatttttagttgtcctcaatgttctaaaatagtgatgtttgacagaattaatacagtgctctagttctttctgttcaactggtatttaattaaagatcttggaggccatctttctctcaggctacaccacttaaaggaggaacattacttcctccatggacaatgtgataagccacatggcaacaaagctgcctccctaaggtctctcatttaatagactgctttaccacatataaactaccagcaaaacagattatcactttaattcacattgattttactcttcatatctctgaatcacaactctgtcatgggctgcgttctctcttaacttctgaatttccagaatttctgtagttgtaatgctctcctgtatttttgcttttgtttcatctggacttcaaaaagttctaatggcatctgattgggaagatttcttgaatctctgataacaacgcagaagtctttaagcaatcagaactgccttggcgcacaaactgaaaactccgttttaaaatcttctgaattaacatcttttggagaatagcccactcaacttgatatgtcataattttcaattctaaaggtggcacggataatttaaagtggcacttgctatttattacttaaataattgttctcttggacgggcttttgaaagctagtacttcttaatcattttcgactatatcagaactgtaacagacatgtcaatttaagcaaacttcatgagcaataaactaacaaacagactctaggtggtggtataggttattttttatcatgatgttttgcacttataactgcaagagtcagaaaagcctttagtctcttcacacacttctttagtgcaaagttaacaatattttagggtgttaaaattagcaaaatccaagttctgcagagtttagaaatgcatgtaaaagaggcattaaacctggttttcaactaacttcccacaggcattaaacctggtttttcaactaactcatttgaataaaatcaacaacgaacagtccttttttttttctgttatgttctgatgtatattttactcacactcctagggcacttttaaaggtaagtttggaaagaggtctttctccaccagagtatgaaacagactagaacaaccaatcctacaacctgcagggcagtagccgctccactaattgattctccttctttgtctctaggaactatgcccaggcagaaaaaaagttactgtaggtgatgaagccagtgctccctgaaccaaataaaccctatcgacgttaccgaactgccgggcaaaaccagagcaactcacttacttggaaggtgaaaaacacttcaacatactccaggcggcaaccgacacttaggggccaggcagatgaaacaccatttgtttaaaaagtctattatttcactgtctcttcaacaaaggtggaaaactgatgattaaacactgaataatgccacccacttactaaacctatgattcactaataagcaggttcaatgcaattcataactttaaagaatgaattaccgaagccccttgcttcacaaattcccccaagaaacagaaagagcattcatcacatataacccgacaaccatttttactatggacacctacagatggcttctcttcctctaaggacacaatttccttcacaatcccacatgtaatcatttacaataccagaaacaaactccaactcagttccaccaactgggtttttaaaaatccttgtgcctaagaacgtcttttttccccaaagtaaaatgtgccattaaaaaatatttttaaaacgcaaaagtgcttatcattccgtacttcttttactaccttcagcagccaattattgacgtgataaaaggtagaaactcctggaatgcttcagagatcaacatgtgtcacagactcccagcctgtccgcctctaagacacagttggttcctttgttccttctgactgaacaccaactcctgatcaaaattgggaaactactttggaagggatgggagggtctgcagaatacatccacggaaaccttcataaaacaatattcaatcgtaataaggtggacacagaagaagggagaaaaggcagcctcccggacttccaccgggctcaccctaaatgggggccggcccctggctcctggtaaaatgatggctgaggcctcgggtccgtgagcctcgccatcgggaggggaccgcgagtgcgggcagagcggcccggggtcgggtgggggccgggcgagctgtcccttttcctattcactttcccagccgggtatccagcgagcaaggagcagggaggcacccaggcgaaaggcgccgcccaggatccggctggacagcaggacggagagcggcgaggcgagcggtgcccggggttcgggaccgagagggcaagcgagcgggggcaaccccgacccggccccccgagtccggccccgctcaggggccacgcgacggccgcccccttgcccagaactggcacggacgggcgggccgacccggggccactccacaacttgccggcccgccgccccggccccccgcgagaacccggagactcgaaccaggcagcagaggcaggatttccccggaaacgcgccctccccgccgccccgacgcccccgcggccctgccagccaagcgagagccgacgcgggccgcgctcccgggccgtttccggcggcgccggcggccgctactcctggcgccctggccgcggccgtcactcaccccaggccgccgcggctcccagcctccggctccgtcaggctcggtccgcgaaggcgcctgc

SEQ ID NO: 422 - DNA, 56658 bp, Homo sapiens
  source 1..56658: mol_type = genomic DNA
ctcactcggattctttgctggcatgccttcagtttcagttgtcatccagagaagtcaaaggaaatgctgcttggggatgagcatgtaattacgattaactttccctacttcgttgtctctttgtggtaaaagactgtcacaagtgctattcaaactataggtatttttttttagatttctaaaaagtatattttgtctctgagggcctcctgtctttggactagtttgtctttttccagaccccagaaaggctgggccaccttttcttctttgagcaggttggcaacagtggtcacaaatagcagaggagctgagattctagagagctatcctaccactgcttctcagatgccagtgtggaaacagcctcttcttttttgttgaattagcttggaacagctctctaatctctgaagagtgaggaaaaactgtgtttttaagtttcaaggctaaggcactgtgttctcttttctccctgttcctgctgctgttctcccccaactcacatgaacgcatacttaactttcagtgtatgtggacagtagggttgctaaattcatgtcaatatttgtggcattcctacatgttaggcatttggtttacatttaacttatgaaacaaatgtttaggcttttataagccaggaacttttccagatattggcaataatgaacttttcagaagttacagtctaatagacaggcaaactattcccatagcatgctatagtagcaacatgtaaaatgtgctgtggaaccacagactattaaaagcctaagttttgggaaatcaagaaagccttagggatgtttagtgatgaatgcataggttagtggaggaaacaacttgtatcaactcaatttgagaagcttagctgtgaataagaggagagagaaatagattttagtagggagaagttgggtcaggaagagtgtgtgtgtgtgtgtgtgtgtgtgtgtgtgtgtgtgtgtgtatttaaaaatccagtcaatggaaaaaggttgaagatgcaggcaacgtccttgttttgtccttggcaagttcctcttatggttgcaagatggctgccacaagttcaagtgtcacaagaaaatatgacttaagtttcctggaagaagacacactttttttttttttttcctaggttgttgctatcagtgagaaaaatttttccctaaagcctcatagcagatgctaccttgtccctctctcctctcttcataggtcagcattgcacacaagccagtgcctaaatgagtcaaggtcaaggggaatagtaccgctgtgattggcataaatggatcgtgattcatcttaggttgtggctggggtctacttccttggaagttgatggcctcgggttgagagtagatacgtgagcacagtcagggtttggttagaaagtgagggggtgaatggtgttgtgcagttaacagtgacatccttgtctactagttctgccaccactacacttagatacaaacttcggaggagaaaaagaaaatgtgcttgcctttggatttggaattttaggtgactttttttcctcttatatgccatttccttctatgatcaagtagcacttttacaatcaaatcaaatcaatggtttatttaaaaattatttaaaaattgaaaatgccaattttgtcaataaatatatatagaagaaataattttttttttcaatgctttaaacatttcaaaagttccctgccattgtcttattcctttcagggagaggagaacatataattatatcttgtagtttctgattatgtgtatactaagaggactactctgtccctcagtccatagtgcacacccacctgtggtctctatggcttgcactgagtgctgaggccagcctggctcagatagaattgttagttcattggctagatgggtcaggattctttagaatgcaaattcttgaatcaggagtacaaacaggaacatcttcccttttctacacactcattcccctcctcgaagggaaagctgtcccgtagttagcttattcgtcattcttttcagactttaaaattaatgccaccttaagtttatacagtattcttgtagtactcctaacttttctgttttgctgtatgtgtacattgtagaaagattaaatcaagctaattaacatgtccattacctcacttacctttgtgtgtgtgtgtgtgtgtggtgagaacctttaaatctactctcttagcaattttgaaatacagtaggatccccacccactgttttactttcagcagtttgttacctgtggtcagatgaagtccaaaaatattaaatacaatagatattttgagaaagagacaaacatcacattcacataacttttattacagtatatggttataattgttgtattttattattgttaatctcttactgtgcttgatgaaaaagcatagtatatatatagggtttgttactatctgcagtttcaggtatccactggggttcttggaatgtatcccctgtagataagggggacacctgtgtatgttgttacaagtatgatcactgtgtaaaagcacttttgtatttcattcttgttccttctcaatcgcaggtctgggtgctttctgtgctgtgaaaggcagacaaataatgtaaatcctaaacacttgagtgttgtaaatttacaaaatgagaattgctcaatggttgtttctttttgagagtaacaaatagactgtgataaatggccagagtaggcttctgaactggtattagttttttggatagaatttagaaagacttgtactaccaatataatttttgtctcagataaatgcaatagtatttccctactcagtagttcctcagatgctatttaaactgagctatatttcagctttatttataggctgcaaattgttccttatttggctgaatcttgtggttatgatataatgaaaagtagttactgagatcactggtgcaaatctgtagcttggaaatcctcattttagaaatgattattttgactcccaagttaaatagtaaaaaatagacttatgtttttagttttagctatgtatattgagaaactgtggccctacggtggctgttagggattagtggattaggttgtttttaaataagacatttcagtttagtatctctacttgaataaaacagtttcaaatttgtgattcatatgatatactgattgccctacggtaacttctgttttatttaattaaaattgttaacattcttttttatactcttaagcacctccctccaccctcacccccctttttgactcaaattttattgtgagttggtgtatagttaggaatttgaagagcactttttttgtttattttatcttttcggttactatgcatactatgtgtgtcaactcttaaacctgcagggggtcattttggccatcaactagttttagggctttcgcctcctaaagaatatgaattatggttgtaatttttacagtttaaaaaacaagatggcatatgaagaatctttatttcattatgaaaatagaacatggatgcttaatcctctgtattgaaagtaacttgtagtgaaatacttcctagtgttctcttcttctagttgtccatatgtagtatgtataactatagaccttgatgatttaagttgagcacagtttagtgtcaggttcctttcagtgatgcatgagattggttatatgatctagtgagtgttatttagaaattaattcaccagacccgggtgtggtggctcatgcctgtaatcccagcactatgggagggcgaggcaggcagatcacctgaggtcaggagttcgagaccagcctggccaacatggtgaaaccctgtctctactaaaaatatgaaaattatctgggcgtggtgatgctcgcctgcaatcccagctacttgggaggctgaggcatgagaattgcttgaacctgggggacaggtgttacagtgagccaagattgtgccactgcactccagcctgggtgacagagtgagactctgtctcaaaaaaaaaaaaaaaagaaagattcaccaaatattgattaataaggggaaatttgttgttccacaaatgcccatttaatctgtttgtgtaatagtgttccttctcatcacacacaggatacttggggtatttcttgaactccttgttcttccatccctcctcagttttacctattcttcccccacataccacttgagtcatgtaacatgaattgaaatgtaatatttggacctgggagcagagactttttcagtctttaaattattgcccttctcaagcctttagtttccttatctgtaacagaagcgggtcatcctggatgaatgtgcttttttaattggaaattctttaggtctgtgaaattagccattattttgggcagacttgtgcaattttaatattttcattttatcttgagatccttattaagcttaactgaatttttattataggaagtgttaagccaggtaatttacagaagatcacatggttgatgatatcagtagagcgttaatctgattatccacagctgctggtagccttaaaataacctaaaacttgatttcctgttgtccctaataattctgtgtgtttaacacttcatatttttcagagggcttcgtgagacagatagggtgggagctacctacttaggctatctattcagtttcacacatgcacatttgcccttgttcacatggctagacttgacttgatgggtctttcctcctcattttcctatagcagggttctctcattttttttaaacaccaagtcttctttttattttagatttctataaaatttaatttattctttagtaatttattgtgaagaatctgctaagttttagagcccatcaacttatcatgtagtgacaaaccaattatctgctgatgactgtaggaaatatctactctaaagggggaaaatgtaattggcaatctttgggagatttcacgacaatcaaaataattgtgaactatctttttaaccaaggcacattttttgtttgtttatagttatttattccaacatttttctgattataaagtagtatgtatttatggttaagaatttgaatgcagaaacaaaaattacctagatcttaccatgctaatattttaattatatatcctaacaaggcatggtgatggtgatgagggtggcaaccaagatttctggacatactgaattggtgatgcctattagacatacaggtagtaatttgagtatgcagttggctatatgagtatgaaattcaagagagaagtcaagattggaccaaatacgaatatgagagtgttcagcaagtcagtgaagtgatcgtgtctccattgtgggtccagatgggttcacctagggagtgtgtgcaaagaagaaaccagaggattgtggtatcctggaagccaagtgaagacaaggtttcaggaaaggaatgatcaacttgttaactattgctgagatgctgtgtaagaagactgaacatttgccatttggtgatgtggaagctgttgagcttcactaaatggtttccacggagtggaggggaaaaggcttgtttgagtggcctcaaatgaaattgggaagagagggaagagacagtgtgagtataaatggttccttttggaaattcagtacaggagagcaaagaattatagatcgaggggtataaggagggtcaataaattttaagagaggatccattattcatcagttccattaaaggcaaatgcaaaattttattatgtgcgtggttttctggtggaagttcaatagatttcatcagattctgtaaggcagagaaccagtgctctagtgatttggcagttcaacagctcatttttctggaggatacccttaaaattttaactgatttaaattaatattcaccagtattaaatagtatgtgtaacatcgtacccaaacaagatgtctttctgtatttttttctttccttctcttagttttgttaaaatctttttagttcagaatattctctatcaaatgccttttctatttgaagactctcctaaaaagttatattaatacttgcaaccaagtgatcaaccatttacatttaactaaattttgctacttttgtttactatctatttaaacattttaagtttgtgtttttagtcaaagtaatacttgttggtttttgtttgtttgtttttttaagtacagagaacaaccttatctgctgcacctcaccccctaattctgcttcagagttatgtgcaatgtttactggtttctgctatttaatttttttggtggatacctctgtctaaaatgtttacacctcagtttatttatcaacctaagatattatctgttgacttggtattactgtgggtgatgatttcgtttactctactatccccccacatgtatttgtaatcttattattccacttctactgttgatcacctctgcaactccagctctaaacactttttttctatttctttttcttgtctcattaatctgaggcagtgccttttgactctgcacattgtaagttgtatggaaataccattcccattcttcctgattctgtctcccagcctgctttattttgtcaaggttaataatatttacattctatgctatagttataattaagtctctcattatttgtctattctaaaagttgaaaaaagtcacagagatgtaaagtgacatgcttaactgacagtggagtcctcaagttataaagtgctattaatcttttgtgctgtccacccataggtatccctagagcagcgctagctgctgtttggcagtttctggagaagtctttatgtccttacttgtgctccctgataacaactctgtcctcatcttcagcccctgattgtgggattttaggggtatctgagatgtaagcatttagaaagtggtgtagacaaaccgtggaagaggctgagttgggaaattttacgtgttgggggaattttcattctttgcttttttcccctcccctctttcttgtgggagccttaactgggatagtaacaattgcacccgcctctctgcccattagttgctcatcttagaaaatctacagttaacatatttagtggcgaaatacttaacactttccttatatgggaatgagatgaggatacccactgtcaccactctcactattcggtcattgcaataagggaagaaaaagaaataagcataaagacgggaaagaagtaaaatggtctctgtttgcagatgacatgattgtgtgcatagaaaatcctatggaatccacaaacagctatccgaactagtaagcaaattaaggttgcagaattcacggttgatatttaaaacgataattttgtttttacacaatagcaacaaaacaaaacaaaagagaaaatgaagtttaaaaaaaccaactctgtatgcagtaactataaacattaaatgctgaggaatatagcaaaagcttcacaagccctctactaaaaagatcataataatgctgagataaagaatgcctaagtaaatgaagagagatgccatattcatatactggaggactcagttttttagatgttggttctccccaaatagatctatattttcattgcattcctaatcagaattcaactagctcttacagtagaatttaataagaattaaaaagcccagaagaattagacatttcacaaaagaaggtatacaaatggctaataagcacatgtaaggaggctcaacatccattacttatcaagaaatgcaaagtaaaaccacagtgagataccaccatacatatcaggataggcaggattaaaaagatgacagtaccaagggttaatgagaatgtagagcacggctgtccaaccttttggcttccttgggctgcattggaagaattgtcttgggccacaaataaaatacactaacactaacgatagctgacaagctaggaaaaaaaaaaggtccatgcatgattttcatgctatctgccaccgccgatgaaacaaaacagtcctcacgttcaaagggatggacacgtcttacgtagagcattctaattaattgccatacattggaattgtcatacactgctggtagcaagataaaatgatacagtcactttggaaaactattcagtaatttctaaaaagttaggcatgtgcctataatatgacccagctcttctactcctaggtgtttacccaagaaaagtgatacacgaaatatatgtccatgcaaatgttcatcaaagctttattacaataatcccaaattcagaacaatgcaagggtacatctttattatagtagtccatcagagtcaaatggataaacaaattgtggcatatccatgtaatggagtgttattttgtaatacaaaggaacatctgatgtatgcaacaacatgaatgaacctcagaaacattaagaagtaatgtttctgagtaatgaaagaaacccgaagtaagagtacataatatgtgattctatttgtataaaaagaaaatgcacattaatccatagtgacataaagcaaattattggttacctggaatcaggcacagggaagggtacatgtcaatgcccttggaggaaggggcgtgtgaaattttgaggactgatggaaattttgtcttggttggggggggtggtggtggttttatgcacatatacagttgttaaaggtcattgtattgcatgctttaaatagatatggtttattctatataaatcatacctcaaagttgcttaacaaatagtgactgacaaaggcatgacagaaaatatgtattcagtaaaaaagctttattgatgtggaccaattctagttactagttcacattttcatagcagataacaatcctattcagaatcaagtagcagccaaatatgttaagcaaataaaagacttcattgtttcttaagctctttgtagtaagaaggtataacagtggaatctgttagtcttgttttggttctggagcttggatttcctgtgttccttctcatctttgttccagtatttacttccaagctcttctaagcttatgacctggaattatcaaagttggttttcatcatttgggaagtaaaacaccatttatttttgagctttgaggagtctataactttaacaaacttccctaacagttcacagtcttctcctctaagcttaactttagtttcataatttcgaatatggatttagacccagcaactataacaaaaggtccatgacttaactatatagtttttaatgttaggaaaagtaaatgaaaaatcttgcctgtatgggacctcacatgatgttgtaataatcatgagctgcaaaaattgtagtgattccctcccaccccatttttaaaaaagcggtggcatctttagttatataacagttctaatgtaaattaccaggttatttactcctctaacaatgtcatcatttttggtgttgctgtaagctcctctgctacttaccttagttcaaacttttttttttgtttcccattttcattcagccttttcaaaatatatttgtcagtgtaccttatccaataatacttaaggattttcttaaggctgagagaaataactttagaaaatgtgactatcaaatacagatgtttaaacagttatgatatttaagcctgtaaacggttaaagaaaataacagcttggtcatggagttactcttccaggctctcctggcaggtgagtcgggtcttaggaccttgggaagaatgttgtcttaaattactgtcctgaattaagtttccacagactttctgatgttaagtttttttcagaattacagaatgatgaaaagccatgtctttagaatttttcttatgggaatctccaccttaaatttaaaatcatttttaaaataaaggcccttaaaggagagttaagggtgtagacacaggatactgttggatctttgccatccacttgaaaaattgaatgtaaggttcacctaatttcagaagaacactcaaactttgggtatcttaggtgtattgtaacaggaactgactggcttaggggagtttgaagcttgggcttagggaggttagctttcttagcttagggagctcagaaagatgtcatagtagaggaatttccctgtcttctgagccattgaataccctgccctgaaattgagtgaggtgaaagtaattgacaggttgatgaaggtgatgttaggcagaaacagtgaggaggcaaaggtggaaattccaaatagccactagaaatgcgagaaggcaggttttgaggaatggactgggctgcagatcagggcactgcttttataaaaaggctggcacttgcccatatgcaccgttcctgatgtccactggccaccacttgtggccaaccacacacacacacacccttgactaacagaactatttgtgaaataattgttctcattaattgaatattatggttaaatgaaaattgaccaggaaagtagtttttgtttgaagacttacttcaaataaatacctttccagatgtccacattcctgtgtaaattgattataatgatcattattatcttttttacttgaggcatcattctcattttgaacatatctaggttatgttcttgaagggacagtcttttatttgtgttttcttggcacttaatgcatcatatggcccagctaacacttgtaggaagaacatttgtcatttttcaatgaagataaaaaatgtatggtagcctttttttaaaaaaaaaaatttgaggtgttatttattgtacccttctacattgagaattaaaacacaacatataatctattgaaacttgaggtagataaaattctagctctttttcacacatggaactttatacaaagttatcttctgactttctgttagatgaaatattgtagacctggttccatgatcacatgttcaccttaggtttttaagagttttttttcctttaaataaattatataatgtgataaagccacagcatcttgttttctgtatgattttgaaagcaaaaatgtcaagtagtaactatatcaaaacttaaattatgtgcattcagcagagagcagaagttatttccaaattgaggtgtaggaagctttaaaatgcttattcatcctttatcagcactagtgaatgaattggcaatttcctaaggtcagcaaacttttattttgaatgataacaatagtattatttctaagaatatagaaaaatgcaggcgtaacacaggagtccaaatttagtattaagttaatagaattttagattctggaaggctggagtgtttttaggtttgagaaatgttagaaggtgcatgatggatgttagaggacatgaaggtgccgttcttgtctgatgtagttgttacgtagttattgggtaaaaatggattgctgaccacttagatggtttccaggattaggagaaatgattttcagaacacttctgtagtgcctcatgctaatgaaagcaaaaggcaaggtgttttcatgactgtaggtcatatatattggccatgtttatagttgccagtccttgctcttttttggcctgttgttgcaggtatgtctttgacttccagagggatgagctggcctcttttttgtccctcaagtcgctggaaaagctgtccaagaaattttctctgaatgcttggctcagtggcattgttccacatatgttggaataggtgactaggctgtgtttggaagaagatctagattggggtccccaacctccgggttgcacagcaggaggtgagtggctgtccagtgagcattactgcttgagctccacctcctgtcagatcagcagtagcattagattctcacaggagtgtgaaccctatggtaaactgtgcatgcaagggatataggttgcgcagtccttatgagactctaatgcctgatggtctgaaacagtttcatcctaaaaccattgcacccgcccatgtggggaaaatttgtcttccatgaaacccatccctggtgccaaaaagttggagactgctgatctagatgatctctgttttgtttctgtattaaaaataagaaattactaattcagcagcatgtacctgtgttggaccaggtccaacaggtatgcttgggttatggcagggaacaaatcagacaaagttgtgacatttaaacagagaactaaaaggtgaggcattagctggctgaagagtagaagtccagatagtggccacagtgtatgtggaggccctgaaatcagtaggagcttggggcctgtggagcaggaaggaagagacagtgaggctagagaatagcaagaaaggggggcaatggcttgagataagtctggattaatggatggaaaacccaactacataggacttgaggacgtgttaaggattttgaagtgatatgccatttatttggaagatgacgtagggtttttgttaggaagagaatacattggagggggtcaagaggggctttaggggtataaggcttttgttaatattatcaccactaataacagctaatattatttgttgctgtagaccaagcactgtgctgtgaacccttttcccacatcatctcatataaacttcagaacatctcagcgaggtggtgttttctctactttatagatgagggaaccgagacagtgaggttaagcaacttggccaaggtcatatagctagtagtggcagagctgggatttgaacccagacagtgtaagattgtaaattctgagactctaaatcctgtggtgtttgccactgggcctgtatttttcattgcgtaggtgatgcgcctatgtgggtcttgaaattgagtggatcgcaactgggatttaaaaaaaaaattgaatggagtagaaagtatcagactacttgcaagtaataagcataaatattgatatgtgaaactttattttatgtaagtaaacttgtacatttgtgagcttgtgagctgttatagaaggttaaacagcatttttccaggcaggagctgatgatggcttggattagagttgtgctgatgccgatggagagaggtggaccccagtgctaagaggcagaggcagcaggactcagtaagagattggatagaggtgcccagctgaggaaggaatgaggagtgagtcccagatttcttgtatgaacagcatcagtcatggtgcatgctgtgctcaatccacttgaagggagactgatccttcttagaggggtcctcctggatggctgttttactacctgaatttctagtttctctcagctgcagctgacaggacttggggttggcatctcgcccaggggcagcaaatctgtaagctagctctcaacccatgagatgatgtgttactgaaaactgcctaaacagatgttgagccaataattaattctctggaatttgaggtgagtagtcagccagctggtggcaggatgagaagcggtgggccacagatgtatgtagttgactactagcagctctagggtgaaggtgtaggaattatttgtgtggagtcaccttgagattcaaagaacctttagatttccgtttctaaggcccagagtcattctctttctgaagctcaggtccaattttttttttcttgctctctctgcggtccatatctgtattctcaagcataaccttttagtcatatccagctccccacattgctgcagtgaatctccatactgtgcgttcagctagtactaactggagacagaatgatggagtagttaaaaaaaatgtctggtggcaattctccatctttgtcttattggtcttttgatgttggccaagatacttcttactgagccttggtttccacatctgtaaaattgggatgatagaggagcatcacagggctgttttgaggcataaacgagagaaactctatctagcacttagctcagtgcctggtgaagaattacagcttaataatcttgccattgatagttaacatctttaggatagtctctggagagacttaaacgtgttcattaacaaacattatgggaaggagccagcatagagggagaggttggatatctatgagacagggtcttaagagaaggtattggatcccagagaagcaggcatggcacgggattaagagaatacattacagattgttttcaacagaagagggaacctgatggaggtggtaggaggactgttttttctgaggttgggtcccagtcatggtgatttgctaggagagatgctgatatcaggaggagaaaagtggcaaggtggaaagctattatagagaacaggagacagggacataccagaaaactggtgaacagtaccaagagcctgcgactgcacattgtaaatttataatgacaccagtctgtgtatttctacagtgttttctggcagtgctgtgttcaaaagaatgatgagctatagaagtaagattagtatagttttgaagggtgtgcatcctagataccaggaaagaataaggaggctgggagcgtgggtacagggacatagtagggcaggtggtcagccatggagtccggcttggttgggagggcagtgtgctctgggcagggtatagtcttgaagaaagaagagggcagtggtctgtgtgtggtgccacccacaaaagatatataacttctttgattgatggttttccctgttattcttaacactaatttcttgtgttgataactgaagtattaagactaattgctaaaaataaatttatattctcgtatgggccaaaactggagttagttctagtgtttaattttgaagttaccagtgatttcgtgtggtatgctgaatcagtaaataagttgtgatccttaaccttgggactgaacttcagtagtccttatttctcctttcatttttgtttggagtgtgtagcaaatctgaaagcagtaccatttactcattcactgaccatttgaaggcttcccatgtgtcaggagaacagaagtgaatgacgcagggatgataccgtgaggcatcacacggataaaggccaataagctcctcacagtatcatcctttccggccgtagggtgctggaagacaatattagaacttctcttttaacctgttactttgaacttctgtgtttctcagaacatatatatcagaatagtagcacatgtctgaaaaatatagataagcatacacgtattgggggtattcttgtttttggcagtagtgtgtatgtgatcaaaaaatatttggaggctattatatgttagtatgtattttaaaaaaatataaaattataactttttcttagcattttgagaaaacctagtttctgcatgtaattaatgaggtagttttacttgcctgtatttgtagtgtgaagtaaatcttactgtataaaaagacttactaccaagatctggcttgacacatttcagtcattttcttcttggtgctggaggaactttaccttttgtagaacagtgtcccttgttataaaacactaaattcacttgccatctatcagatgttgaggaatggggtgtggagaatgtggaacagcacatgcctgttttactatcagtctcatcccaaggtgtgacctctggggaccttccttcttacctctctggctgtctctcctgccttctctctctctctcaactgtctcaaaacaataggattgggatgccaccagaaattccctgctcccatctgtttgctcagagtaggtggttactcagtgtgtaatgtctcactttcagagagccatgaaatccttggttcaaaaagttccctcacaccaagaatcttttccgtaaaattagttagaaaaactgctatcaagaacctattttaaatgaagtatattgaataaatgcctctaggttgttcctctggaggttttttattttcatttttgttttaatgagtatgtatcttagcctgtatttgacactgtcattttttaacaagatgttatttaagtgaaatcttgcatgtgtgtttgcaggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgagagatccatgtttttggcaattttaatctacttttacttaagttttttatggttcataatgttgaaaataaagcacagtctccttgtcaggtggctatggagcatttcccaggttctgtgcaaccccttttttttttttttttagtttttttaatgtaaaatcattaattttgaatgttggttaacattactgagcagttggatataacataacacccactgttatgttatttttgatgaaatgaccaaatcaggacacgcccagtggattgtaggcaattggaaaagtcatggttttgagagtctgtgctgtgtgacattctcttctaggggccctttccagtgatcagcaattgtagctatgtgtgttagtctgttctcgtggcgctaataaagacatacctgaaactgggtaatttttaaaggaaagaagtttaatcggctcacagttgcacatggctggggagacctcacaatcatggtggaagacgaaggaaaagcaaagggacttacgtggtggtgggcaagagagaacttgtgcagtgaagctcccccttataaaaccatcacatctcgtgagacttattcactatcaccagaatagcactggaaagacccgcccctgtgattcagtgacctcccattgggtccctcccatgacgtggcaattgtgggagctacaattcaagataagatttgggtggggacacagccaaaccatatcactaggtttagggttctgtaaaacgtccgttttcccaagacatctcctatgaaaaggaggcactccatgagtgttctgtctccccttctttcttgacttagtctttatgtattgattagaaaaaataaacagtgttgcgtcatttttatatagccttatttttacatacatctttttctctggtctgttgtggagctcaggctaacaaatatttgggtccttgttaatgtcctgcctttcagaggaattctcttttgggtggggatgtgctggctgtgctgactcctagcagcatcccttgctttagttagtaactgctactagcagagtatcaaggctgtggcattgggacacaaatagaagttaggaggaatatggagaaagaatgtagaaatcatttgagtatgacaggtctatgtgggatattcccagttggatacggttggataaactgtaaactaagtctacagtttagcttgttgctgtccatgcctacttctgtgaaactgcagctacggttttgggaacaggttgtctgttagttttgtagcagaggtcagagtcaatggtgcaatatcaagaaaatggtaaaaaaggccaacctatgaactagccattgttttaaaaaaagaacaacacattttataatggagatgtattaactatggttcatattttcaaattattgaatgagactttacaagtaaagcaaagtttgattcgtggatttaggaggaaaggtatgtgcatacatgcatgtgtgtatgcattcattcattctttctaatgtgtaaatcataagttttcaaatatttgaagtgtttcattatagtgacaatgtcaaaataccttataactcactatcctaaagacctttttagattattttaacatatttaaaaattttaattgaaatttttatcgagtgtattagggttctccagagggacagaactaataggatatatgtatgtatgaaggggcgtttgttaaggagaattggctcacatgttcacaaggtgaaggcccattataggccacctgcaagctgaggaggaaggaagctagtagtggcccagtccgagtccaaaggcctcaaaagtagggaagccaacactgtagagccttcagtctgtggccaaaggcccaagagccctcggcaaaccgctggtgtaagtctgagagtccaaaggccaaagaacctggcgtctgatgtcaagggcaggaggcatccagcaggggagaaagatgaaagctggaagactcagcaagtcacctatcccacctttttcctcctgttttgttccagcctcgctggcagctgagtggatggtgcccacccatattgagggtgggtcttcctctcccagtccactgactcaaatgttagtcttctctagcaacgccctcactgacacacccagaaacaagactttacagccttcaatccaatcaagttgacatttaatattaactgtcacactgatgttttcatgtacagatgtaagaaacaatgcagagttccttttcactttgtccagtgtccgccattgataacattttgcaaaattgtagtatagtattacaaccaggatattgatacaatctcccatagcgttcagattgccacaattttgcttgtactagcatgtgtgtgtgcgggttaagttctatataattttatcccctgcgaaggtttgtgtatccaccaccatagttaagataacagccgggcccagtggctcatgcctgtaatcccagcactttgggagggcgaggcaggcagatcacctgaggtcaggagttcgagaccagcctggccaacatggtgaaaccacatctctactaaaaatacaaaaattagccaggcgtggtggcgggcacctgtaatcccagctactcgggagactgaggcaggagaatcacttgcagtgagccaagatcgtgccgctgcactctagcctgggtgacagagagagactctgcctcaaaaaaaaaaaaaaaaaaaaaggaactgaacttgccaacacaaagatcccttgtgttgtccttttataaccacagacatctcctgcctacactccatgccctcatccccttgcccccttcctccgtgcctaatccatggcaaccactaatctttcttccttttctaaagttttgtcattctaaaaatgttatataaatggaattatgcagtatattacctcttaggattgatgttgtttgacttagctgagattatccagcttgtgtgtatcagcaatttattcctttttattgctgagtaatattctgtagtatggatgtaccttgtgtgtgtgtgtgtgtgtgtgtgtgtgtgtgtgtgtgtgtgtgtagctttttacctattgaaggaaatcaggctaattctggtttttggctatcacaaataaaattgctgtaaacatttgtgtactggtttttgtgtgaacataaatttgcatttctctgggataaaagaccaggagtgcagttgctgggttatatggtagttgcatgtttagttttataagaaagtttttttcaaagtgtctgtaccattttacattcccactagcaatatgtgagtgatttagtttatcggcattctcattagcatttgatggtatcactgctttttattggagcctttaaaaagcctaaacatggtttagcatgtttatgtttttaagaagatcacagccgggcgcggtggctcacgcctgtaatcccagcactttgggaggcctaggcgagtggatcacgaggtcaggaaatagagaccatcctggctaacgtggtgaaacccccgtctctactaaaaatacagaaaaattagccgggcatggtggcaggcacctgtagtcccagctgctcgggaggctgaggcaggagaatggcgtgaacccgagaggcggagcttgcagtgagccgagatcgcgccactgcactccagcctgggcgacagagcgagactccgtcttagaaaaaaaaaaatcacaaatattaatattatcttgaccactcttataagaactcagtggtttcaaattaattttgtgcttttaatccaggatgatgccttctgtgtactggagttggttccatttgcctctcactttaagaggcaggtttaatgtaaatgtgcaagtttctacttaaaagttttgttacttcgagtccatgaatttttgctgaaacagtaccgaggcatgatttttataacttctcttagatcacttttaaaaatctgaatctttaaaacttttactgttaggaatttttgacagtaaagttaatagttaccagttagtatgcatttaccatggatcaagactttgtaactgctttacaaatactgttttatatcctttaaaattctgcttttgtagcttgtagcagttggagttgtttggaatacagtggccatgtggagctgggctagcagtagactcactatgtgtggcaggtagtgttcatcctgctctaattcatagatgattttttttttcactatcatgggaaaattgtggtaatgtcttacatctttaacttatgtgagtaaaccataattcatgtgcaattaagagaggactctataaaatagtgtgtggtccctgtgaaaagcatgcttttccaggatctttttcttttacatttcttagaagaatatgttttcttcaaattaaagtacatattttataattatcacaaataagttacatatctctctattcctcttctacttattttgtttttatgtactagacagctttcaaatgatgtgtttgtttttattttgtgtatcaacaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtgagcaggaatatgttcttaattcattgttttaataaccattaattgggatttactgtggatcagctccctttgcatcattagggatataatcaggttcagggagtggggaggaaactcatacaaaattaattgtaagactgtgtgatagggctgggcgcagtggcccacaactgttaattccagcactttgagaagccgaggtgtgggtggatcacctgaagtcagaagtttgagatcagcctggccaacatggcgaatctccgtctctacaaaaattagctgggtgtggtggtgggtgcctgtaatcccagctactcgagaggctgaggcaggagaagcgcttgaatgtgggaggcggaggttgcagtgagccaggtttgcaccactgcactccagcctaggagacagagcaagactgtctcaaaaaattttttaaaaacactgtgtgataaataccaaaagagagagatgaagtttgaaggacttctgttcattcgtttccagtagatatattaaccataaagtaggttcacacattggctgtgttcacacatcggccatttaattgtttaaatcaaatgccatgctgcaagacaaaaaagaataatgattctatgctcattatttgataactcctggaaaaatgcagcatatattcagtcttgctcattgccaacaagaacctctagacctgggacatgtccctgagcagtggtttaacagtgattagttgtaggaatgtgacttctagtggagtaaagtttattggatctagtttttcatggccattgatttttaaattttcctttggccatttcaactattgatgaatgtcttaatttagcatgagttacatgtagctggtatgatattaatcaaagcaagcttgatttgtatattctgtttgtatttgatagatcctttctgtaaaatattacttataagtccaataatgacaagggcctgttagttccttccaaaaatatattaattaaaatattttttcttttttttgtttttatattttatgattttttttgcctttcaatagttggcttttctctttataatcacaatttacattctttttaaaaattatttttctattttatccattgcattttttcccctttcttgggctttatttgttttttgtaagaatacttaacatgggatctacccttataacaaaattttaagtgtacgatacagtattgttaagtataagcacaatattgtacagcagatctctataacttattcttttatgactgaaacttaacccatccaattgcaattccccattttttccctctccctagcccctggcaaccaccattctactctctgtttctgtgagtttgactgttctgtctacttcgtataagtgaaatcatgttggatttactctcctctgtgtctggcttatttcacttagcatgatgcctcccaagttctccatattgtaggcaaatggcaggatttccttctttttatcaggctgaatggtattcctttgtgtatatacaccacgttttctttatccgttcatccatccatggacatttaggttgtttccatatcatggctattgtgaataatgcggtaacgaatatggcggggagtacagactgggcacagtggctcatgcctgtaatcccaacaccttgggaggctgaggtgggtagattgcctgagcccaggagtttgagatcagcttgggcaacatggtaaaaccccatctctacaaaaaatacaaaaattagccaggcatggtggcatgtgccagtagtcccagctacttaggaagctgaggtgagaggatcgcttgagcctaggaggttgaggctgcagtaagccatgattgtgccaccgtactcctgcatgacagagaccctgtctccaaaaaaatatgtgtagatcagtgcagatatccttttgagattgtatagaaattgggatagaggcctatgttttctttaatgtaaaataagttctctgaaaaacttagatgtataccttcatcttcctaggtttgactataattataaaatacagcaataattagtaatatttatttcatattctaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctggtaagtgtaaaagtttcttgttactatttaaattccaccactttcttttttgtcaaggaaatagtttttaaatttctaggtcagatataatgctcaattacttattttaatatgtatcaattaccattttatcatttttaccatgatatgctgtgatatgtaagtgctttttaaaaagaaggttttcaaattaagaatgactttactgtctacctaatcattagtggttgtgaatagattcaagaaattataaagcactttaggttctctgttttgtgtctatagaagttaatattccaggtgttcatttaaatgaactgtggacctgaataacttgttttggttgataccaaaaccagaccaaccaggatctttcatctaaggaaaaaaattctgatagatatggtgatatgaattgaaaatattaatatctaatgggatcctaagtgagaacaatgcttgcttttgaatcttttctttttcttttttgagatggagtcttgctttgtcgcccaggctggagtgcagtggtgcgatctcggctcactgcaagctctgcctgctgggttcatgccattctcctgcctcagcctccggagtagctgggactacaggcgcctgccactgcgcctggctaattttttttttaatttattttttgtatttttagtagagatggggtttcactgtgtgagccaggatggtctcgatctcctgacctcgtgatctgcctgtctcggcctcccaaagggatttcaggcatgagccaccgtgcctggcctgaatcttattttctattccagcatcaagacacaaattaactgaaaattgattagtttactcctctttcttttttccgttggtggaaggaagcattgtatgaaagaggacaactctgatagtacaggccagctaaagctaagatatggtaaaagatagcaaggaaacagcctagaagtagtaaaaacattgcttgaatattcaattttgtgtctattaattgttgaaagtttaaaagttgggattgtggcaagttttcaagcgtgaacattctagctatgaatggcaattaaacagcaacaatttagggaaaaaaattgtgcctccaggagaagttgaaaaataaaaaattattatttatatattgtacatatactttgtgtaaaaagataaaaaatcataactatattaaagagatgaagcataactaaataaaaaatagaggaactagatgttttacaaatagaggcatgagagatgttaaaaaaaaaaacaaaaaacccaaacaccgacatgatattgctgaatagttaaaattgttaaaaccaaggaggaaaagttttcaattctatagtacttagtacttttagagtgtgtatcagtaatacctttaataaacactggtgttctttcttattcagttttgaattaaacccttacctgcctttagaaggagtatagcattttgagcttcagtttttattctgtgctgcaatacagagatgctttttacactgttaggttatgcgaagctagtggaatgaaatctacataaaattgtactactgaagttcttagttatgcttcttagttctttttcttgctctttctcgtctgccagctataatttatagtagttcatagagtttatccagttttcttactcctctaaaaataaaaataaaagcgaaacaagactattctagtttatttcgtaactttattttataaatggatactaagcaaatatgtttgagagtagctattatcctttagaactactctatttcttggctcaagggttttatttttttgatacaaatcagacattggtttgctagattattgatattgctactaaatttcagatatctaggatgaagaagccttgctatctttgggctttcttctccctctgcctttccttcttagagaggtggcagatacagtggttaaaattgtgggctctcaatcagatgcttagtaactttgggcaggttaatttctctgtgacttggggttttcatcggaaaaataggataatactagttcctactttatagattaggtgcttatttgggggaattaattgagttaatccatctgaagaacttagaacaatgcctggcacgtagtaactactcaataaatactatgtattttttattattttccattttctactttttaaaaaattttatttggtttatttatttatttatttttagacggagtcttgctctgtcacccaggctggaatgcagtggcatgatctcggctcactgcaacttccgcttcccgggttcaagcgattctcctgtctctgtctcccgggttcaagcaattctcctgcctcagcctcctgagtagctgggattacaggcacgtgccaccacacccaactaattttttgtatttttagtggagaacaggggcttcaccgtgttagccaggatggtctcgatctcctgacctcgtgatccgcccgcctcagccttccaaagtgctgggattacaggtgtgagccattgcatccggtctccattttccctttcttaattgaccttcttcctaatgtctctgcctaaactgtaaactctgtgtttggtatattgcttctgtcatcatagtaaggttcctttcatatggtcagtgaataactactggttaattttcaatacaaagtaatattttgtttctcaacagtttttatgaaatccaaaatctgaatggtcagtatcctgtttaactattacattaatttggactctttggcttcaagaaacagacttttgattgaagaatgaatgaatgaatgaatgaatttgttgtagggagataggtacctctcatttagaagctagacaatggagccaggcctcataaataacagggaacagaagtggaagactcctgggaacccagggacttctctgtgcacccgcttcgctctctatccgagagtggctttgtgtgtcactaagtgcacatgggaagggtggctgtggcacaatgcctgaataatttcactctctccagggactaatccagtcagagactactgttttagtcagttctgaattcccaaggagagcatcttactggctgaattcactcaggtatcctcttctgtgactagcgagcaagaacaaaatagaagagtcaagaccctcctttctgggcaggcacagcagacatctgatagtgtctcctgcacctagataggcgccagtctgacttctaaaataaccccagagaagttgtgttggaatttttgtatcagagtgactcatttgtgtttcatcttccttgaagtctctactcagtccttcacactgctctcagttctagtgatttgtactggcaaactccagttgcagcgtgaggggtacattacaaatttctgtactgcgtagatgtctttctcagataaacataaacagaaaatatgctgcttattagctaatacgaataagaaagctggcccgtctagaaggaaaagaatttgacgtttaagatagttattatggtaagaagtttacttggaccctggttgttgggtgatgttatggatcttgtcttttgtaaacagaaaactaggagggttacagccagaggtttatacttagtagcatggagagttgagaaagaggaaggaatgtgaacagatatttgtgtatattttaatctcattgagatgttactttttgaaagtaacatggccaataaacaagcagtattcttagtctttatagtctaaagattataacaaacctatttaagggaaattgcttgtttaataattaaacagccatttgcacatagtgaatgactggttggctttaacatattaatagattcacagtatttattgctcaggtctaaaaatattcatgcagagggccctatattctagttagtttggtcttaggctattggctgtttgttttcctagaaagaaatcttggaactttttgcagttcgtcctgagggcaatggcataatagattctggatggatcagcatgtgataaaaaggggtttgattacaatagaataattattctaaaatgtttgcaaagtgggttagtattataattatgtataaaggaataaaggacacttttattaaagtctcagtgtgttgggacaaagggagatgtgagttagcatttagtaaataaggtatttctcaacaagaagttctgtcagagtctaatagaacctttgaagaaaaggtgtttatttatttggtggaaaaatggatggtattgactttagcatttattttgaattttatagtatgttagaggttaagcattaatttagcattgcttttattacaagaactgaatgcgcataatgcataagccagtaacatgactttggttttttttgttattttttttattttttttatttttttttttgaggcagagtctcgctcttttcgcccaggctggaggtcggtcttggctcactgtaagctccgcctcctaggttcacaccattcacctgcctcggcctcccgagtagctgggactacaggcgctggccaccatgcctgggtaatttttttatatttttagtagagacggggtttcactgtgttagccaggatggtcttgatctcctgacctcttgatccgcccgcctcggcctcccaaagtgctgggattataggcgtgagccactgcgctcggccgacttttaaaactaacaattataaagtctttggattcagcttctgttcagtgtttaacttatgaagctcttgtctatgtagctttctttacaaggtccaagtttattcttttctggaagattaattcagaagttagaaaatatacatatctctgataaccattttaacctcagaggtaccctgaaatgaagggagcctcgctttttgcagaaaaatatttaccaaaatgtatttcttttagaaagtatcaaatattgttttcgatatcaacttgtaagtgatcagcaatcagaatattcacaaacacttgcgctcagggttgaggtgttcagacaccattttatttcattacttttgtccattatgatggcacagaagtaaaacgacctcatccgtccttagtgatttgcattttgtggtgaagattatattttattaaaaataaacctgtcctattcacaactagtcacaatttactggctgctcaaccaaagcgcaccccagtggcccttccggaacctgccctctgtcattccgtgttgtcgttgagcagcatttcttgaaatgtggtgtgtgtcccattggcatcatagttatcttggggtgccccttaaggtggacatttcttagtctataccagagctgttgttaaggccctggaccttgcatttgatacaagtccaagataaatgtcatgtacgttttaaattctgagaactcactgcatgatagcactgaggtcagacggaggctttggagacaaatgactggaaagcctgcctggccactgggtagctttgtggtctggggcaattgcttaacctccagtacccacattcccccgttactaatgtgggataagagtaacagccacagcggggttgatgcaaggatctgatgagatcagggatgaaaagctgtttgtactgcccagcacgtgttcagggctcaatatgtattagttgtactttaaataaaagtggttctctattcttcctataagtatttgctggtgaccctacatgttaaatgttgtgcttggtaccaggatgtcagaaatgagtaagacagaatcctcacttacttacagtctcatagggagtcaagttcaagtgtgttcattttttcttgagcttcatgtcagcaccccccaccccattctaaaaatttcaagctttcagaaaagttaaatgaatgggtaccataagcaaccatatactctgcatgtagattctttgatttttgacattttgccacatttgctttatttctctatcttgatctttccgcctttgtctctccacctcagatcatctgtctatacctgttggtttgtcagtctttgcacctctatctccgtctatccatcttggtccttttttaaccccacttggttgatcttggtctctcaccccttggtgtcactgttgttcctgtcctgctgtcttgctggctgtcattcctcactctggctctcttcctctccttttattttctgaattgtttgaaagctaccatattatgacacttcatccttaaatgtttaaacatgcatcttctaaaaagaggcattcttagatatgactaatacctttattatgcctgagaatttcaacacatcctaaatattatatctagtttttattcaaattactctgattttcccatctttcatagatgcttttttttcaaacgaggatacagtcatcgtataatgcatttgattaaacctgtttagtctcttaatctagaacaagtactctcattgttttaatgacaataactttttgaagtatccaggctggatttctcataaatgtcttactttaagttatttgtctgattgcttccccatggctttaagtcatttctccatccctttacttcccgtaaactggaaatgtttgagttgaggagactgagtttaaacattcactggtgttgtcctttatattgtgtcgcctagggaggcaggaggtccagtgtcagtattgtcgtacctgggtagctgggaagtgccagattgctccattttcaaagtaatattttttcaacctgtgttgcttagttatctatgatgtgttacttgggcactttataattatcccgttccccaatactcctgcatcctttagaatatgttgatgaccttcactgtgattaccatgattacaaaatcatgatttttctaaatctttcattctatttacattattttagttggtattcctgattaaaaaggattgttcttcctttctttctcttttatttttttatttttttttgaaacagagtctcactctgttgcctaggctggagtgtggagtgcagtggcgtgatctcagctcactgcaacctctacctcccaggttcatgtgattctcctgcctcagcctcccgaatagctaggactacaggtgcccaccaccacacctagctaatttttgtatttttagaagtgatgggttttcatcgtgttggccagcctggtctcgaacacctgacttcaagtgatctgctttcctcagcctcccaaagtgctgggattacagacatgagccaccatgcctggccttttcttgttttctcttttccctccctcccactctttggaatcacagtggactcatggattaattttttctgattcaatttgttaggataagtaatagtcattattctttttgatgttgacatttttcaaatttggcctgggagagcccgttcaagccagctcctgtcctgttgacataaccatctagcacttgccatggtctcactttttaacctctattgtttcaagatttggaatcacccatttctttaaaactcctggtttcttctagcagttatattggactttggaaagcctacctgctgctggagtattattccttctgggcctttttcagtggacagagctaggaaatatatgcatctgtgtataaaataaagttcattatatcatgaattcatatatatcaggcttcagtaaatgaaagtaaaaagtacattagaaatcctgagtttatgtagtatttccagtccaaatttagcagtatagagcttttgtcttcacttctgtgtttatgtttaatctctcatcatttacaggaaaaattttggctccaattacattagtgtattgtttcctttataatatacagtaagttctcacttaacatgaaatgatggataatgaaaccagtttttttcctcatcaactttataatgaaaggatgttgtaaaaatgagaacacttggacacagggtggggaacatcacacaccggggcctgtcgtcgggtgggggagtggggagggatagcattaggagatatacctaatgtgccgggtgcggtggctcaggagttcgaggctagcctggccaacatggtggtgcaaacctgtaatcccagctactcgggaggctgaggcaggagaatcgcttgaacctgggaggtggaggttgcggtgagctgagatcatgccattgcactccagcctgggctacaagagcgaaactccgtcttaaaacaaaaacaaaaacaaaaacaaaaacaaaaaaaacgagttaatgggtgcagcacactaacatggcacatgtatacatatgtaacaaacctgcacgttgtgcacatgtaccctagaacttaaagtataatataaataaacaataaaataaaaaagaaaggatgtggaacaaaatgtttattgaggacctggtgtgcgttgtttctcttaaagtcagtttccaaaaacctgtcgatgattttaagtgagggcacactgtataaaaagtaagaaaattagacaatcagtattactattaacagtaaacaaattgagcagaatttgagatttatttgcttttttatgcttaaatatttcccagtgtgaagctttaaagttatttgaaatatttgtgttaccaatttggcatacaattaatttttttttctatttatattactgggatttactctacattttttgagacagggtttcactctgtcacccaggctagagtgcagtggcacagtcatgactcactgcagccttgacttcttgggatcaagcaaatcctctcatatcagccttctgagtagccaggactacaggtgcgcaccaccatgcccgggtaatttttttgtgaaggtgaggtttcgctgtgttgcccaggctcctctcaaaactcctgggctcaatcgatcctcctgccttggcctcccaaagtgctgagattttaggcatgagccaccatgcctggcctacatttttaatttgttttattttgaatgtaaaacgtttatatggttcaaacattaaaactatattttaaaaaatatatactccaaatcttgatctcatcttctccttataccctattcatagctacttcctataggtaaccattttcattagtttctggatttttttttccctgtgtttcttttctaaaaatgtgttaacattttatgtctactcttattatccatcctgctgcatggaagtattttatatacatttttctgtactttttaaacttaagaattgatttataggaaatattttttcttagttcagagaggttgtcattcgttttccagctccatagtactcagtagtgactgtaatacagttcaaaccagtcttctgtgggtggacagttgggatcctgcagtgaataactgtatactgtttcatgtttaaggagctgtgtctctaggacacattcctagaagtgggattgttggatcaagggtaaatacatacataattttattagatattaacagattcccctccttaggaattgtcatatttggccttccagcagcagtatatgtgtgtgtgtctgtccacaccctcagtcaagatttgttgtcagcttttgggttttttccagtctgatagtgagataccatgatatctcgtggtagcttttatttttatcttatgagtgaaaatgagcatttttgcttatatttctcagtgccatttgcagatttctctgaactgccgttcagaggttttacttactaaggaactattagtgaccattttctaacagtgagtactctttaccctatcataaaattgtcacttgtacttttggtgccaaattcttctatatctttattgggtgagttatatttatgatctttaaaaaaattatatttgaataaatattgtgcactagctattcaaaataaggatttagatgcaaaggtttttttttttttttttttttgagacagagtcttgctctgtcacccaggctggagtgcagcggcacaatctcggctcaccgcaacctccgtctcccaggctcaagtgattcccctgcctcagcctgcccttttagctaggtttacaggtgtgtgccaccatgcccagctaatttttttgtatttttattagagacagggtttcaccatgttggctaagctggtctcgaactcctgacctcacatgacccgcccacctcagcctcccaaagtgctgggattacaggcgtgagccactgtgcccagcctgtaaagattttttgttggtataaaatccagaatggtaccagaatgccaattttattcctttttaagaaatagctctaattaaaggtgcagcacttcaaacgtgatttatacagttgtttttataggaaaatggaaatatattgtagggataggtagcaggacactaatagtgagtcccactcatgactgtaagtagtgactttgggaggtatcttaaatactgatgtcattaagtaattaacttgaattacttgtattttacttttagttattaagctgactgctattatagtaaatatgtgtcttaaacttagagtgaaatggaaactgcttagaagcttagctgtgtaggagttaaagtgcaggggaacagatgggaacatttaatttatagaaataattctggtggagttctagggctgtgcctatttgttttagttgttgtgaagaagcaagccatcttgtatacttaaagaatgatgtcatccctaatttagtggggtgggaggagtgagagtatttaaagatcatgtggatattaagatacagaagtcataaaatatttgtaatcttcatagtatctgtaggttaagtagtggttctaatttctgggaggaagctcaagtactccttattttgttgaaccatatttaatttaaaagaccaaccagcagttgaaaattttctattgctgtttagaatagattcatcccaactttggtagaggagtccatggctgaatattgccatgagtgaagaaagattctttctcactttcttctggaagctttgttttcatcctcctttggattggcttctgagagaccataaaaagaaatgggtgttgattgcatttaatggttcctactgtgaacaagcagtaggtaccgttcttgccctttcagtatctgcagactcattttatcagaagagtgcaactgataaactttgcataagagaaaatgtactggccaaacattgattttgcttacatacacatacttaacacgcacattcttgacctacatctatttaaaaaaaaaaaaaaaaagaacttgtatataaaaatctgaacagattggagaatactttgccatataaaaatttagtattttgtatttattgtatattttctcaaaatattacaaggctttaaaatattttagaaataacaataattggattcatacataattttatagtaatacttttgtataaaaccataacaatacttttgtataaagcaaaattcgttttacccttttagtgacttttatgtcataaaagactaaaggatggcacttatagattagcactatgaactaacttgtctcaaggttaactggcagcctcaactctccagaacctgtcaatgaacagaaagcaaacagaacaacactgacttgttgagagttgtgataaatttcataagaaaaacgtttgactttctagcaagtgtttatttactcttttcttataaataccttgattatttggtttcctggctcataatagattagaagcaataagatgttagaacaagaaggatgaaatgggatgataatagaaaagacatgctgtcagcagtgataagtgacatggacaggaaggcaggaaccagaaaaacttttgaaaaattctgtggtagactttcttataggggtaatatcttaaaattataataataacaaaaatggtaattagcaagcacaaaattacccccccgaattcttcacactttagtaactcacccaccggctgtctctaggcatcttaaattcagtcccatcccttcagtgggtttgatgttgcttaaatcaagagaggtgttgtgtggattacatagctgagattgcatgttggaaaacatttagcacaatatctgtcagagaatctgctcaacaaatgctggtcattagttgaatcttgcaatgctttgagtctcagtaattaagttatgctaactgtacttttactttttttcttgtatcccatccaaaatgccatccatacctgttatgtacagtctgtaaatccagaaagctccaaaaaccgtatgtttgtcacaaactcttttgaccgaaaaactgccccaaattgacattagactacatagtctttatcctactttcttcattatttgctattttaatgtttacctagaaatgtaaagatagttgatagggaagtgctgccccaggcctgctagagaaattatgtgtgcacccatactgtctttccaaaacctgaaaaatgctttgtgccaaaatacatctgccccaagagttttgggtgggagattctgggcctttagtatttaatgtataattgaatggaattgaaaggataaactccatgtgatcttacttgatgagaagcccctgtatattatttgatcgccttggaaatgttgattgagctaataaacacaagccattgtgttctctttccccacttcacagcaaagtgaaaaggagagcttgttgaaggaaagagatcacattttgtcaactctgggtgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccataagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacacccaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgttcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtagaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaatagaattgtacattccattttcattttctcacttcatgtggatttactcagtttagtcttttgatcggtaattagtatatctgaatttgtaggagagaatctttccttagttgatgataatcatgcctcaaaaaaaaaaaaattccagcattcaggtgttttaggaagcacagattttagctttgcttctgattttacttaatgttagtttggatagagaagtatagggactcttaaggggtattatctctatcagtcattaagttttaaaaacttatctgccgagtcagctctttgtatcctattcaatttccaaccaggcccttctgaccaagctttgggcagctgctcagcggtattggccatccagggcaaagtcttctggtctaatcatagtgattctcagctggggatgattttgcttgcctaggggacacttggcagttcccagagacacaaatctcgggggcagggtataggatatggcttctaggggcagaggccaggacagccctcacaacaattacccacccagggtatcgatctggctgacattgagaaaccctgactagaccaacgatggaatcaagatgacttgtaagaaagtgctcagttgtgtgagatagtgtggtggctgcaagagttcaaaggagacagggtgagaaacgtgggatttcaccaagctttgaaagattgtagtctgaatcgggagaagatggtctctggggagaggaggccacttggcacaaataagcctggcgtgttaaaggaacagaaggaggttgtcacagtgagagggagaaggaggaaggcccccacttgagtgttcaccagtgggtgtcccagcatcttgccctacccagattgacttaagttatcgaaggtctgaggttagactgtaagggctttaagagcaacagaagtataggtagtaggtattgagggtttagaggaaggccaaaaatagcaccctttccctggccagagttttgaaccatttgagaaataaaaagtaggtgaagtccatatcgctgatggaacccagcttggaaccatggctttctagctgtttagcccagtgaacctgctaaaagtgcattctggaattaggcagacttaatccatccaccggtcaccttggacgaccccaaaaggggcagagctcttagaggagcagaaaaatgtaaacagggagcaaattccacaagtaaggggtgggccgagccaagtagacttaatgacgctaaaaatttactcattagaatcagggactactacatcagggccaggacaaagtacaaagtggaagtacaaaggccagagggtgtttcttgccctggagatttaaactagggaagtcttagggaagagtgttcccctttcatgctccccagtttaagttctcttgaaacattggcccattgctcaaccagggctgtgactgatggcctggaggaggagagcatctgttccagagggcagacctcctctcacctttgaggccacttcccaacaccagcctttgcaggtgtgactggcttgggctgtcagtgaacatttggtctcagaaggctctggatccagcagtgtactagtaagtaaatgaattcaaaggctactctgtaccaaagactgaacatttttctcatccctaattctctcctacctcatcgtcccgtgtagcatgtagcatatcagatgttctgcattgagattagatcccaacataacattcccataagaaaatgcatgaaagtccaggaataaaatgctagcaacataatgatatccaaatttgaatggaagtttaacttttattattcaacttttagagaaaaaaattcaaagattaagtccctttggattaaaaaaaatctaaaggcattaaagtctaaaggaactaaagcaaatcaaattattttgtccacctgagttcgaagtacaaaactttaagaaaaataaatcccaagactatcctgccagatttctcattcagatcagccttggccagaggagtttttgatgcctaggtccagttgagattctttcaagaggctgtagctggagttgtctttaagagagtggttgttcctaccgtgctccagaaggaactaggtttgaggctgagtctctgatgtgctcactttagagtcagaagagttaaccacaaaattatcatagccttggccccacaaccacccttgtttcgaaacaagctaattcccaggtactaaagcagtcatcccatacaacactgctcccacagctcagtacctagtgctgccagagaccatagtagaacctcaatagtatctggaaaaaaaaaaaatcttggtttcagttccccaaagatgccccagtgttctgtaactcacaactcgtgatcctaatttctattggaaggacgctcaaaaagggcttaattttggccgtatacactgatcattcctgggggaaagaccaccattgcatgacaccttaatttacatttccccttccaacaagctgtttctggtacctggactgttgagtgagggctccctctaggggctctgagccaacatccctgtatacaggcgttttcaggcctgagccagaatgcatgtttaggcctaagaaagttgcctcctagggatggaggaggcgtcttaaatctatctttacggcccggcagggtggctcacgcctgtaatcccagcactttgggaggctgaggtgggcggatcacgaggtcaggagattgagaccatcctggctaacacgatgaaaccccatctctactaaaaatacaaaaaattagccgggcgtggtggcaggtgcctgtagtcccagctactcaggagactgaggcaggagaatggcgtgaacccaggaggcggagcttgcagtgagccgagatagcgccactgctatccagcctgggcgacagagtgagactccgtctcaaaaaaaaaaaaaaaatctatctttacatagatttaagcagtccagaatcaactacagatgaaccacatggatccaaggtcccttcatggttccctccttgtgcctgaatgcagaatggaatttggggtggctgatacagcaagggccacagtggcctggcgctaccagttagaagctagaaccttacaagcactctgtagtacgttggaacccagctgccttgaaaatcggtgaaaatcagtacctattatttttcccagctacacctaaaaggcctgtgaagtctgcttttcccctggaaactgcagcagtggcatcttgaggccacctgccctgccaagcacctgtgggcgctgggcctttccctgtgaaactgctatgttgctgttgatggagaggggcccaccggcggctgctgcccacatttaatttattccatgttgcacccactttctagggcctcttgcagtccgtgagaggtgtggagggaatttctgccagttgggtttaagatcatgggtagtacattccagaaagtgggtgttgactgacaggcatcagggggaagctaatgtaaggattttccccattgactttccttgcctcagttaccactgagtaccttccacagcctttgggtgcaccaggtaccgtgttctaagaatataatttttcttggacagctgctgtcttggctggggattggcttgatttcaaaacaggtggtgcaaatgctgtgataatcttgtgagtgtctcattaatgctgagccacttagactcttggcattgagccagttaaactcctgagtccctgaaggaattgcactatgagaggcgctccatatctcttctgaagtccttgcgcctttcacttaagatgcccctccccaccagcctctccaaaggcctaaggagaccagttagggctccacagaaagtcattctctgaggaaaaacaccacaagccacaacgatcctctagattcaatatgctcacagcctgctttaaaacctcttacccagaccaacgtcactcctgtaaaaacccacttggcctaatacaaacctccacatacaatcgaaggtaaaatgtcacggcctctactgcaccccgtggttcacaagactcccaatcacatgcgtctcttactacccaaactctgctcttctggttttgatttttcaatgtctgtatacaatgccgccctgccaaatgttgggtttccaaaggaacattgcatattcctttcctgagctatgaagaatttgagagagaaaataaaggaatggtagatgggaaaccaaaacaaaacctcagttgctgataatggagtagcttagcgtgagagcctagtgcaaactccagaatgagtcaagttgaccttatcaggttgtttcttgttagagggaagtaacttttccacccttggtttccatgaagggagattttcctctgggcagcatagcaccacctatactccgctaatcagcatggtggtgtggaggcgtagagtgctagtggtgctatttggagacgggcacatcccaagaggaagaatggccatgcagggcagaggacaaccagttattttcagatttatcaatcagccagcgcactccatctctgcagggatgaggggagcaaagaggttgagggaagatcatgttccaaggtcagagtgtagaaggtgaagggaagaatgtggaaaggaattacgtggaggcagagtctgggggctttgagaagcttgcaagaagagaaagagaaagataccccagaagaggagcagactcccatgaaagccacgaacttgccctctcatctgcacactccactactagcgggaacataggttcaggtttaaaagccaagcctgaccttgtgtttaactgcaaacacttctttttcctcttcctcatcttattcttaaagtataaatgcaaagatcatggaaaatatttaaaaattgagcacattaccttttcattttaaaacagccatcctttaaaacagacaccattttcattctgcactcttagtttatacttaatcactgtcccgaaagtcagctgttttctaaacagttaatttccttctttcaggagaccggacctaaataattttccagataccatcttgatatgcaggtttcccatgtgatgtgaatctcttggcaggagatcctgttaacaatacccagcacgctatatgaaaatatccactataacttaagctttctaaagtaatacctatttggtccacctcagaaactgacagtagttctgttttgagctattaatttcagagaatcttcctttgtgaaataagcatgcttatgttttccttgctttgatttaaatgatagccttaactgctgggcacaggactactattaaaaccttaagaataagattttctgaagaaggaactcgttttttaagcactgtgttttcatctcatttgagcgtttactctgggctttagaagacctcatctattatgctcaacatctgatatttgaggggttctgtttcagggttctgtggaaaatctgatgtgccaagaagtgttccataccattctgagaactctggatacctgctcagacagctctgtttcagctaaacagtaacatctgggagggaagcttaatgtggaatcaaggatgaagtttaacacaggaatgagaagtagagcacatagctgctaagataaggtaggagaatttggctagtaaaagcacttaatggcctgaacttgtgtttactagggcctgggagagcagacagctgccagcatacttaaaataggttgagtatgaagtatgcacttaaggactaaaagaattgcagaaatttaagcaatgactcagttacaaatccaagccccttcagaaagtacaggaactatggggaggaatagaaagaacataaacctgcagtgagacagacctagttttctttttttttttttttgagatggagtctcacttttttgcccaggctggagtgcagtggcgcgatcagagctcacagcaacctctgcctcctgggttcaagccattcttctgcctcagcctcccaagtagctaggattataggtgtgcaccaccacacctggctaatttttctatttttggtagagacggggtttcacgtgttggccaggctggtcttgaactcctgacctcaagtgatccgcccgcctcggcctcccaaagtgctgggattgcaggcgtgagccactgctcccggcctagacctagttttgaagcctggttttgatgcttagccacagtatagccaaaggaaaattacttaatgtctctcagatagaatttccttatatgtatgtctttcatgttgggacttctggtcctcgatagcaaagtaagactgactcaaacttctactcacacctcgtgaaaattcaaatcaattcaccgcattgaatgccttctttaatttgctctgttgcccaggctggagtctcagctcattgcaacctttgcctgccaggttcaagtgattctcctgcctcagcttcccaagtaactgggactacaggtgcgtgccaccacacttggctaatatttgtttttgttgttgttgttgtttttgttttttttttttgagatggagtcttgctctgttgcccaggctagaatgcagtggcatgatctcagctcactgcaacctccaccttccaggttcaagcaattctcctgtctcagcctcccaagtagctgggactacaggtgctcgccaccacacctggctaatttttgtattttttagtagagatggggtttcaccgtgttggccaggccagtcttgaactcctgacctcaggtgatccacccacctcagcctcccaaagtgctgagattacaggcatgagccactgtgtccagcctaatttttgtatttttagtagagatggggtttcactatgtttgccaggctggtcttgaactcctgacctcatgatctgcctgccttggcctcccaaagtgttggaattacaggcaagagccaccgtgcctggccggttacagttttctaagaaatggcaatggaaggcctcactgagaagatgtaagaactgaaggaggtgaagtgagttttagtggttacacattgcaaattatttttggctaagttgtaagtaaaaaatagaggaaataaccaatcttgtatggttgtagtaagaatcaaatgaaacaatgtatggaagagtgtctaccagaaggccccatgacacagctagcacgcaataagctttcatcgtcttgtatagaatggtaccatccaattcagtacccactagccacatgccacgtgtcacaacccccttcttttcttagtacctttttgtcagaggtcccctctctgttcctccaacttgccaaaattcacctccatctcctttgcagcatttgagaaggaactggccaagaagtgtttttggaattcttagctgaccacccacctccagcctacagaggtggttgaaaagactaagaagagttttttggagaagatagagaattttgttagaaaatgtggtagtgctgggactgtaaccttcttaatcttagtgaggggggctatgagatgcccactaaaaaagccttgacatgagtcacctagagtttgggagacacaaaggactggcaccttatgcataaaaaatattgcttgagtagatggatgaaactcctgtggcagcagaatagagtggcatttgggaagaagaagaattggcactggtgggggtaaaagttataggacttcagccaccagatgtggaacctaaatgaggactgttcgtctgaggtcatttccaaggggatcctattcaacagggcttctgccagggagggaggttgcctttgaaagagaaaatctgagatttaccctcaggtacagaagctgagggattgctcatggtcaaccaatggagctctaaaagatgagcgggaagctgggtgaagaggaagcatgttttgagccaaggcaattgcatatgcaaaggctgagggatgagagagggcctctcatggtttatttgtagagctgaaagatgtttggtgtggttgcatgccatgtatgtgtggccggggataatgagggctccaggttggaggagtgacatgtggtgagtcaggagaggggtgagaagagtccagaccttctcaggtatatgataaagtttgacatttatcttaaggacaatgggaaacttttgaaaggtgtgatatgatcagtcctgtgtttcacagtttgttttggctgcagtgaggagagtggattgtggagtgggaagagtggaatgggagataccagtaagaaaccacggctgtagtcagacaagaagttaggtggactggaccagggatgtgttcgtgggaaatcagaacagtggccagattcatgaaacatggcagagatgactgtcctgaggtagaagaagagctggtaaaaaagatagaaccacagacgatccccaggttcctttcttgaacaacagagtggaagatgtttctgttcaatgcgatggtgaacacgaggtcagagcaggtttgtggaaccaggtgttaaattcagtgatgagtgtactgcaggcaaggcatgctgtgtggcgcccatgtggttgttgacatgtaagacttctgctcaggaggaagatttgggccaaagctttacatttatgcctttggcatatggtccacttttgaagctatgtgagaggaaaagcttgcctgaaaagtgtgtgtgtggtgaacagaggagatagcccaggacagaccccaaaggaatactgatgactgggaaagaagaactcataatggagataaggaacactagaggagaaggaagatcagaagcaagcaagatcttgcagcagcaagatttattgtgaagagtgaaagaaaaagcttccacagcatggaaggggaccggagcgggttgcccctgctgactggggtggccagcttttattcccttatttggctctgccacatcctgctgattggtccattttacagagcactgattggtccattttgcagagtgctgattggtctgtttttacagagtgctgattggtgcgtttacaaacctttagctagacacagagtgctgattggtccgtttttacagagggctgtttggtgcgtttacaaacccttagctagacacagagcgctgattggtgcgtttttacagagtgctgattggtgcgtttacaaacctttagctagacacagagtgctgattggtgtgtttacaatcctttagctagacagaaaagttctccaagtccccacctaacccagaaggccagctggcttcacctctcaatcccccctctaaacaggacaccccaactgctgctgggaattgggcgatgactgctctagctacttcctgctggatagaggcaaagaagggtccctgcagttgcagtgtcttccagaggggaactctctaggccagtgaaagggccagcgggtcggtccaggggtcctcggtagaagttgttagtttagctcatttggggttccattcgtaagaccatctgtagcttgatggcctcgattctagaggaaacagatttgacaaggaggttaaaaataagggtccgaaggcgagtaatagcaagatggctgccacaggacctagaaaggggagaagccatgttgcccaactccagaggttggtataagagttttgaaaggcgttgtctgatttcagaagccttttcctgtaagcgccaggtggcatctcttactatccctgactgattagtgtaaaaacaacactcttcccctaagaagatgcagagtcctcctttctcagcagtgaggaggtctaggcctcagcagttttggagagtcactgctgccaaagagtctatttgggattgtagagtaaggatagatttcgttatttcttgcaaactatctgagaaatcctgtgagagtgtgtggtagtaggataatgaagtggatatactggctattccggttcctgtagcagtagccattcctaaccctattaagtagggtattagttgtatggctctgcactgacggacttgagctttgaggggaacagatagggtctgatttccataaaattagaagttagtacaatacatgttacactgttaacttttagcaaacttttgttgaaaaccttgtaagtttggggttttaatttttctttgctattaataaaacctcattcagtccatattaacttagaattggtatagatggctccttcctgatactgtaagtactttaaggtttggctgagtgcaaacagctgcatgtttgaacagaccaattattaggcaattttcttaactgcttctacaagagtttccttatcacttactgaatacccattgtgtcttttttccttagtagttgaggaggaaccgtatattatcctgtcctgaagggagttcctcctagatctggtcagacctttgtatggtaattaattaagatttagatcccctgttaggaaacctgctgggttaaggatttttgataggaaggctatgggttgtcagtggcttcagtgctttcgggctacgcccttgtttacactgacaacaaggtgatattggagtgttacagggttacagagaagaccttcaattatcaattataggttttaaatttaccctggcttttaatggaatagggtacactgtttttcctttactacttctatctctctctttctctctctttgacttcttctttgtctctttctttctctcttcctttctgttgcctctgccagctgcttatgttgctgttttcccctctccttccccttttgatggctttggcagtgtaagactgccacctccttgggtttttacactgcatgcaataactccatggtttctttgtgatatttaatgggcgttcccccagaggttagtaactccctttctttccatattgcagcatgggcatgtaggattagataagcatacttgctatctgtatacacatttattcttcttccctttcccagttctaaggctcgggtcagtgccactagttctgctaacggggcgctggtccctgggggaagaggcttactttcaagtactgttactgtggcataacctgcccttcgtatcccattctccacaagtgaacttccgtcggtatataggttaaggtgaggattagctacggggacttctaagagatcatgtcaggcggcctaagtctggactacaatttgttggcagtcacgctcgattggttccccatcctctgggagaaaagtggcagggttgagggccacgcatgtacatatttgaagcaccagtccctcaatgagtagcgcctggtatctgagtaggtggttgtctgatagccataaacttcctttggcacctagtatgccatttacatcatgagtagtccagacagtgagatcctttccttgtattattttgatagcctctgacactaagatggccaccgccacaactacccttaaagagtgaggccagcctttcgctactacatcaatttccttacttaggtatgccactggttgtggggttgccccatgagtctgagtaaggactccaagagccatccttgctctctctgtgatgcataaagaaaagtttcatcctgtgggaaggcttaaggctggagcttgagtttgttccttccaatgcccagacttcagggttgattccctcctcaagtaggggacaacaaatgggtaactcgttccccatattcatgtagataataactccagctttggctactcctactggatctagtggagtcagcgtgatccgcttctcccactcacctagtccccacacgccctgagagctagtccctgtggtctgatgtccacccctcacttcttctgccctttccttatacttccctgctggagtgactggaagtggggatgctcttccctggacacaggggagaaggagggcccctggggttgtcacttcctctgcccttttgggtggggcaggaagggcacatttgatgttagcaattcagcgtaaaagtgaaaactaatttggcctcaagatttaagagtcatccaaacaacagttacagggctaatatctttaatctttacacatttgacaatatccaataaaaagaacaccaaactacatcaagacaaaggagcaacagacatgggcctgcagaggacaaaagagaaaacaggagcactcaataaccaggaactcagggactttggaggcaacctgtgtgggttaaacatgcttttgaagatttttatcattatttctcattagaaatataaaaagtgggctgggcgccgtggctcacgcctgtaatcccagcactttgggaggccgaggcaagtggatcacgagatcaggagttcaagaccagcctggccaacatggtgaaaccccatctctactaaaaatccaaaaattagttgggtgtggtggagggcgcctgtaatcccagctactggggaggctgaggcaggaggattgcttgacctcaggaggcagaggttgcagtaagctgagatcacaccactgcattccagcctgggtgacagagtgagactctgtctcagaaaaaaagaaaagaaaagaaaagaaaagaaaagaaagaaagaaagaaagaaagaaagaaagaaagaaagaaagaagaaagaaagaaatgtaaaaagtgctaaatagaaagaagtaaaaaatatatcaaattagaaaataaaaaatgagggggagtgaaactggcattctaacacaaggggggtagtatttaaaatagcttttatgctttggggaagcagtttgatattttatttaaaacattttaaactagccataacatcagacacagtaattgtatgccaaggaatccatcctgaagaacaataatcttaaattttaggactattattaatccataataataataataaaaatttcttcttatatcaagatgtccatcatagcatttatcatagtaaataattttgaatagacctttagaaatggaaaaaagcaaagcactatattgtatctctactcaaactaagatttgacactgtactcggctctttttataatttttcccttaatcctcacagtaaaatcaaatgtttgacacaatgattgtctctttatgagtttttagctaacaaaatgtttatggtaaacatggaataaaatgaaaaatactcatgacagatgctaaacatgaaagcaagtgatttatgtatctagtatgattataaccaggtatatcgaaatctctctgtgaataaaaaaaattgaagtccatctggggtgaacagttgttatttattaaaatttgcttttgcgagtactcatgaatcttgagacaataaccaccaccacgattataaaactatcaaacacgattttaagcaaagaaagaaatggggaaaaccgtgaaaggaaaataaatctcaagactccagaatcactaagccaaagggaaaagtcaagctgggaactgcatcagacaaacctgcctcccattttattcctaaataaaataactacaaagaaaaacaataaaaataaaaaagctacatacctccctcacaatttgcccgtaaggaaattccttgtgagcctcaaagatctttaccctaaaacagttctgttgaacttcatcctggccatattaattgataccttatcttcacaggcccaggacagaggacagacagaactcttgatcattgctctgctcacctgtgacaaatgcatttctcattgcttcctctgacctattgtttatgtaaaaatgcagattcactgagtcagactaaggcatcagtgactattcctctattcattccacctcacatgtattcagtgaaaggctgatcgaagaccccaaagaatgaaaccttttgtcccttatctacctctgacctggaatcccttacttcgagttgttccacctttctggaccaaaccaatgtacctcttatgcatattgattgaggtctcatcaatgtataaaatcaagctaaaatgtataaaaccaagctgtgccctgaccacttgggtacatgtcatcatgtacccaagacttcctgacgctgtcataggcacgtccttagccttggcagataaactttctaaattaattgagacctgtctcaaatactttgggctcacaaaacgtagctgtccatcaggcagatatctaaaagcaagaagtgatattttactcagctaaaagctgctattttgtcggcggcctcagaggccttccacaatgaactccctccccaaccctctggcctcattcccaggcccctgtcctctcctgggaactcctgggaatgtcatgtttgccccattgtcatcttgtcagtgaggctcccctgactgccctcattaagactgcatctggccaggcgcagtggctcacgcctgtaatcccagcactttgggaggccgaggtgggtggatcacctgagctcaggagttcaagaccagtctggccaacatggcgaaaccctgtctctactaaaaatacaaaaattacccaggtgtggtggcacacacctgtaatcccagctactcaggaggctgagacaggagaatagcttgaacccacgaggtggaggttgcagtgagctgagatggcaccactgcactccagactggggcaacagagcaagaccctgtctcaaaaaaaaaaaaaaaacaaaaaaaaaccccacatgcttcctccttcctaccattctacctccaatccccatccccatatcctgccctcttgttttctctctttgtaatgcctgccacctcccaacatagtatagaatgagcttgtttacttagtctagtgtttaatgtctgtctcactccactagaatgtaatcatcgcaaggccaggagatgcgtttggtctgtgctgcatctcaagcaggacaatggctggaacatagtagggtctccaaaaatgtttgttgaacgttgctgatggcggcatcctggagtaggaaaaagactgaagagtggaaaaagaaatcctgacatgaattctgggcaaaggcaagcagtagctgacttggaaaatgattacagtaggttttgtgccatttgagttatcagtattgcagatgtttttgcacctgctccaccaacaataattgggttaaggcttgcagctgggatattatacagcttgctttatctaggttttgttttgcttgcaaatcaatcaatacttacaatgattttaacaaggggaaagagccgtagttgtagaccttggagtgtatttttttttgtctagctttaaaaaaaattgttaatgttttgatactgtaactctttttagtagttgtggctttgcagaccttgctgcactttgatctttttctcgttccagctatagatggcagcacaccactacctacgatccgatcaccagcctgggtttgtaagtcagagctgttggtcaggagatggcagctaatgagtaatcagtccaaactgaatggcaaattaatgtcttcattaagtgaacaaaccagcttcctccataaacaaggtcagagtatttataacccagtgtatttcataaaagcaaaaacgcatctccatttacataactttactatggagctcatgatttatctgcacaaagcatatgcaaaatctcacttgtataccgtctttaataaggacccatgccattctgatgtaattattaataaagtcacacttgataagc

SEQ ID NO: 423 - DNA, 47250 bp, Homo sapiens
  source 1..47250: mol_type = genomic DNA
cgcccgccgggcgctctcgcttcagtcagtcgggccgcgccgcgcctcagctctggtgagtggctcggccgtcccgccggcccttctccgggagggttggcgcggtcagggccgcgggcctgtgaggggaggccggcggacaggtccagtgaaggcgcgggcgggccgggggcggctctttctgggctgggcggggcgcggggggcacgtatcggggcccgcggggggcgccggcggccgggatcctggaagtggccgcgacgccggaaggggcgtcccgtcggcggccgaaccccctgcactgccggagctgttgtttacccgcgcgcgccgtactttacccggggcgggcgggggctgggggccgcggggtccctgccccacccccctccctgccctcgggcgccagcccggcccctcgcccgcggcccgcccgggctgtgacacatcagcaccgccctcgcggctggggccccgtattgtcctccgccgcctcccaccgcatgcccagcctcgcgtctactcagcccggtggctgtcgcgcgtggaatcgcgtaagaaaagccgagtttgtggctggggagagaaggccaccgtgctgagctggatttagcgaagactggttttggggaccggagagcccaggactccctttgttggagttttgcccacgcgttgtaattaagcctcgcacaatatggtgagagtgggcgttgattctggagacaccagctttgtgctcgtgtaatgtaacacgagtgccgttgctttctcattcttacacggcagtttcatgtcattgagtagaattgtgcggaatgcttttatggagtgaggcttctgcgttaaacttgtgctgattccaggtaaagtgtagtagtaattgtgaaagaacgtgtatgaggaaaacgagctacaatgtcatgcttggaggaacaaagaatgttttgtaggatgctttgctttttggagaattgtgtaggggtagggactgttacccatggatgatgctatgggaatttgatcatgtatttgaacaccctttacatcagagggtctgcattgaatgcagttcagaaggataaagggtggaaatcccagatgtgttagtggcagagcacttgagcgcttcacatagtcaagcagagaaatgggaagaggtcggcttgcttcttcctggtctttgggtagtggtgcaagggctgggctgggcttgaaggcacttgccacttctgcctttggacatcttgaagaagcttagggaagaaaggctcccggtgagtcagcttggagtagggtgactttggcgtagtgattcttgtattgttgtttaacctatgtttctgtcaagtggtttactgttgttcggtatgttggttggttaacaaggtaggatgactctctaaaaagttgggttgctgagtcattcgccccagcttgagaggtaattagaaacagctggtgcaaatactctcatcacatgcctccactataaaaggccaaagagcgctctagagaggttgcttcagaaggctgaaggggacccagctggggttgttttgatacaggttatcagtgggtgaagtggaagagcactcttaggcagtggccaatagcactgaggcgggtttaaagacggagcctcgtgacctgctgtctgagaataaatttgcgctggagagagctaaaactggggaagaaatttgcagctaggggtaacccaataaaaaatattgtaacaaaaatatttactactcttactggacttagtttcctttttgtggtttctgttacgtggtctataagtttcaagcagtgagcttaatttgtgcgtcataaaaatttggttatgagtacacagaagggacttgctctgtttctcatggcccttggcttttcatgcatacacaagaagtttcaggagtcagaggagggtaagcaccatatgggtggaattaataggtctcattgggttaagtctcgaaagagctgtttaataaatagccaaccgtaaatacctgtctcattgtcttgattatatgacaccactgcctttacacctggtgtcattgcttcttgctttaaaaaggagcacacaacccaaatatttatatgagtcctcattgcaaacaaagtttaggaatgggaaatgtagagctgggaatttggccctttggtgaaaaaaatgatgattcctattaatggtagttcatttaaaatattctgtattaggaaaaacgatttattttgttcctttaagtctgggactagaggagattagaaatcatgaattttgtaagtattagggcctccaaggtggggtgcaaggaggttcatttggaaggaatatattaaaacttttaaaaactttaatataagaaagacattaagcttaaagatgcagactaacaatcgtgtattcatattatataatgcgcgtgcatgtcctccacccctttgttgctgggggaacatagcctgttaaccactgtcagtaacattctttcaacaaccggaatgctttttcttttaacttacggtttcctcctaagagttctttcagactgttaatattccatttaagttttattttataggtagttctattgtctgtatgttttactttagaagcttgagtgtaaatttcttgttacattgttgatactggggatggaaatacaaaaaatacagaatttcatttgataacctgtattttgaatttggagacaagcccagcggttggtttaatgtatgtgatctgaagtgcagtgatgtgtaaaagggtgcagtggaaatacttgaagataatctacacattggagtgtaatatgtatagcatatgtaaaaattagtttgtactgttactccttgaagtctgtttttttttgtttgttttttgccaagcttatgttctcttaagattaataagacgacatattcagtaaatcccttgggaagtggcatttattcagaatatcaacctcctactagtgctgggggcgggtggcggcggtgagggtggttagtatttaccattcagttaaatctcatgtgccatgtgccttctacacccctgtactgtgagaggtgatgctcagaataacagttgcaaagcccgttaaaattaccacttgtcagattttctcttcatagtgctgatctctccatgacttacgttttaggaatcaccacctctcttctaattttctgactaatgttctgttaatgagagaattgtcttaaccctaaaacctgcattccctgagcattctagacagagggtttattttatgtggtggaacgatgatttttgagattgttttgatttaaaatatatgtcaaatgaggtaatgtaccgatggccaaggtatgggtaatttgagtgcaattcgccagaatccgtgccccttggagggagtaaacatttcaggactgcagctaaaacattgacttacactctcctgaagcccaggcacctggcttacacagtgcactaacataactgaagtctgggtttgatcactgtacagttgacaaagaagcagtaagcagaatggttaaaaagtagttctggagccagactgcttaaggtcaggttctggttgtgtcacccactttaaagccttgggcaagctcttctacctggtaactagtgcctcattgtttcctctgtaaaacaggggtggtgatagtagaatctgtatcagagaggttgttgtgaggattatatgcgttaatacggggtaagtggttagaacagtgccagctttataagaaacatcaagtgttaggtgttattatctgttgttcagaatcagggaagtacttagttacacagtagtgttttatagctgttgagagctgaattgccggcattgatcacaagtgagactggaaaaacaacccggggaacactcttatgttaagtcagtagcaccatctcaaacatacatccaacttctgagggcaacgaacacaggacatagctttttacttaaaggaatcttaacagtctcagcggagtgcttgaggtagtcactaaccagttaattgaaactggcttttacgaaataaaaacacttgccattctttggctagtcttttccacgttgtagttgacattgtggcctggcagctttagtaacctgtccacccctcccttcttgttaataccagaacagaactagtttctcagtacatattcctgggccctatccagtttgttggaaacatttagaatgtaaatttgtaagctaattagtttcttctaagtattatgttttctttagatgatatgcctgtactaatacagaaaaattatccatgaaatggatatgaatacaatggacatatttatcgtatagctttttgtacctgttagtaattcagaaaggttgtgttattttgaccattctttcagccagattgtaagtttcctgatggtgagaatctgtgtctttctgttttatctcctatggcactctgaatgtgccttggctgtgtttctttaataaactgttggttgctgaactgggtggtatgatatgcgttcattctagttctgtgattttgaaacttgggaatgtttaacagattgaaggagagaacatcgtgtgtggtaccttgtaagtgtgcactgagttgaaattcttttgattatttagctttctactttctgtttttatcattggtgtgattattgagaaggcagctggaattaagtaattctagttcatctcctaagatagacataaaacttgtcttgtgacttatttttacccataattggattagaattgaattgagcaaaatataatttggttttctagatgttaaatgtcttatatgtctaatactttgaatatcactcctctagaacaggttctttgttttatttaggatcagggacaggttagaaaatattcaaatattcataggataataaaaaactgccctgaagcaaacgtgaggaagaagaaatagtggtagccagaatcttggttgttaatgaccagtgtagaaacacagtgggcatgcagtgaaattggctggcagctggttccttctcagtacgggcacaatttagaaaatgttacattaatgcagctgaaattttgtgcagatcatgttatttgaaaaataaatgtaaacactttttgcagtgccttaggaaagtcatcgttcaaactaatatttttgtaataaactagttattcccagttttttttttcttttttttttttttgagatggagtatcactctgtcgctcaggctggagtgcagtggcgcgatctcgggtcactgcaacctccgcctcttgggttcaagcaattcttctgcctcagcctccgtagtagctggaattatggggcaccccccaccatgcccagctaatttttgtgttttagtagagatgggtttcaccatgttggccaggctggtctcgaactcctgacctcaagcaatccacccgccttggcttcccaaagtgctgagattacaggcgtgagccactgtgcctggcccctaattattcccagtttctttcaggtaaagtttttttcactttttaaatttatcatttttttagatcagatcagtcagtggacagttgcactctacttccccatccctcattaaagtggaattacactaaaaaaggttttcaattcctttgtagcctggacattagtaatagcctacctctaaggctgtagagtaaatagtatagtaagggaaatgtccctccctccccctacacaccttttttccagttatctcttctttttattgatttgtctgcctccaggaccctagggaggtgtttttgtcctaaggaggtgaactcctgagggtcctattgaagaaatagggcgacctatccacccaacttcctctttactgatatcttcacatgcttattgccttattcattttctaaagtgtgccagcgtctttcagaagtcagctaaattagtgcagttgctcatccatcagacagttttgttataaaatatgtggctataaaagattgaataaatttattaggttgtaatttcattaatgtgtattttatatttaaatattattttaaaaaatgtacagtggttatctgatcttggcccaggcctcttcaatttccagtgtacctgatgtctctttatcaactgtttttctgaggtgtatctcagcctggccttgggtactcccctaggtaagagtcataattcaggttaaaagaggtaagaaaaaaaaaagcttttggcttttgtaatcttgtttttttttttttctttcacattagcaaaagactgttgaagtagagagcattttgcccagctcactcggattctttgctggcatgccttcagtttcagttgtcatccagagaagtcaaaggaaatgctgcttggggatgagcatgtaattacgattaactttccctacttcgttgtctctttgtggtaaaagactgtcacaagtgctattcaaactataggtatttttttttagatttctaaaaagtatattttgtctctgagggcctcctgtctttggactagtttgtctttttccagaccccagaaaggctgggccaccttttcttctttgagcaggttggcaacagtggtcacaaatagcagaggagctgagattctagagagctatcctaccactgcttctcagatgccagtgtggaaacagcctcttcttttttgttgaattagcttggaacagctctctaatctctgaagagtgaggaaaaactgtgtttttaagtttcaaggctaaggcactgtgttctcttttctccctgttcctgctgctgttctcccccaactcacatgaacgcatacttaactttcagtgtatgtggacagtagggttgctaaattcatgtcaatatttgtggcattcctacatgttaggcatttggtttacatttaacttatgaaacaaatgtttaggcttttataagccaggaacttttccagatattggcaataatgaacttttcagaagttacagtctaatagacaggcaaactattcccatagcatgctatagtagcaacatgtaaaatgtgctgtggaaccacagactattaaaagcctaagttttgggaaatcaagaaagccttagggatgtttagtgatgaatgcataggttagtggaggaaacaacttgtatcaactcaatttgagaagcttagctgtgaataagaggagagagaaatagattttagtagggagaagttgggtcaggaagagtgtgtgtgtgtgtgtgtgtgtgtgtgtgtgtgtgtgtgtgtatttaaaaatccagtcaatggaaaaaggttgaagatgcaggcaacgtccttgttttgtccttggcaagttcctcttatggttgcaagatggctgccacaagttcaagtgtcacaagaaaatatgacttaagtttcctggaagaagacacactttttttttttttttcctaggttgttgctatcagtgagaaaaatttttccctaaagcctcatagcagatgctaccttgtccctctctcctctcttcataggtcagcattgcacacaagccagtgcctaaatgagtcaaggtcaaggggaatagtaccgctgtgattggcataaatggatcgtgattcatcttaggttgtggctggggtctacttccttggaagttgatggcctcgggttgagagtagatacgtgagcacagtcagggtttggttagaaagtgagggggtgaatggtgttgtgcagttaacagtgacatccttgtctactagttctgccaccactacacttagatacaaacttcggaggagaaaaagaaaatgtgcttgcctttggatttggaattttaggtgactttttttcctcttatatgccatttccttctatgatcaagtagcacttttacaatcaaatcaaatcaatggtttatttaaaaattatttaaaaattgaaaatgccaattttgtcaataaatatatatagaagaaataattttttttttcaatgctttaaacatttcaaaagttccctgccattgtcttattcctttcagggagaggagaacatataattatatcttgtagtttctgattatgtgtatactaagaggactactctgtccctcagtccatagtgcacacccacctgtggtctctatggcttgcactgagtgctgaggccagcctggctcagatagaattgttagttcattggctagatgggtcaggattctttagaatgcaaattcttgaatcaggagtacaaacaggaacatcttcccttttctacacactcattcccctcctcgaagggaaagctgtcccgtagttagcttattcgtcattcttttcagactttaaaattaatgccaccttaagtttatacagtattcttgtagtactcctaacttttctgttttgctgtatgtgtacattgtagaaagattaaatcaagctaattaacatgtccattacctcacttacctttgtgtgtgtgtgtgtgtgtggtgagaacctttaaatctactctcttagcaattttgaaatacagtaggatccccacccactgttttactttcagcagtttgttacctgtggtcagatgaagtccaaaaatattaaatacaatagatattttgagaaagagacaaacatcacattcacataacttttattacagtatatggttataattgttgtattttattattgttaatctcttactgtgcttgatgaaaaagcatagtatatatatagggtttgttactatctgcagtttcaggtatccactggggttcttggaatgtatcccctgtagataagggggacacctgtgtatgttgttacaagtatgatcactgtgtaaaagcacttttgtatttcattcttgttccttctcaatcgcaggtctgggtgctttctgtgctgtgaaaggcagacaaataatgtaaatcctaaacacttgagtgttgtaaatttacaaaatgagaattgctcaatggttgtttctttttgagagtaacaaatagactgtgataaatggccagagtaggcttctgaactggtattagttttttggatagaatttagaaagacttgtactaccaatataatttttgtctcagataaatgcaatagtatttccctactcagtagttcctcagatgctatttaaactgagctatatttcagctttatttataggctgcaaattgttccttatttggctgaatcttgtggttatgatataatgaaaagtagttactgagatcactggtgcaaatctgtagcttggaaatcctcattttagaaatgattattttgactcccaagttaaatagtaaaaaatagacttatgtttttagttttagctatgtatattgagaaactgtggccctacggtggctgttagggattagtggattaggttgtttttaaataagacatttcagtttagtatctctacttgaataaaacagtttcaaatttgtgattcatatgatatactgattgccctacggtaacttctgttttatttaattaaaattgttaacattcttttttatactcttaagcacctccctccaccctcacccccctttttgactcaaattttattgtgagttggtgtatagttaggaatttgaagagcactttttttgtttattttatcttttcggttactatgcatactatgtgtgtcaactcttaaacctgcagggggtcattttggccatcaactagttttagggctttcgcctcctaaagaatatgaattatggttgtaatttttacagtttaaaaaacaagatggcatatgaagaatctttatttcattatgaaaatagaacatggatgcttaatcctctgtattgaaagtaacttgtagtgaaatacttcctagtgttctcttcttctagttgtccatatgtagtatgtataactatagaccttgatgatttaagttgagcacagtttagtgtcaggttcctttcagtgatgcatgagattggttatatgatctagtgagtgttatttagaaattaattcaccagacccgggtgtggtggctcatgcctgtaatcccagcactatgggagggcgaggcaggcagatcacctgaggtcaggagttcgagaccagcctggccaacatggtgaaaccctgtctctactaaaaatatgaaaattatctgggcgtggtgatgctcgcctgcaatcccagctacttgggaggctgaggcatgagaattgcttgaacctgggggacaggtgttacagtgagccaagattgtgccactgcactccagcctgggtgacagagtgagactctgtctcaaaaaaaaaaaaaaaagaaagattcaccaaatattgattaataaggggaaatttgttgttccacaaatgcccatttaatctgtttgtgtaatagtgttccttctcatcacacacaggatacttggggtatttcttgaactccttgttcttccatccctcctcagttttacctattcttcccccacataccacttgagtcatgtaacatgaattgaaatgtaatatttggacctgggagcagagactttttcagtctttaaattattgcccttctcaagcctttagtttccttatctgtaacagaagcgggtcatcctggatgaatgtgcttttttaattggaaattctttaggtctgtgaaattagccattattttgggcagacttgtgcaattttaatattttcattttatcttgagatccttattaagcttaactgaatttttattataggaagtgttaagccaggtaatttacagaagatcacatggttgatgatatcagtagagcgttaatctgattatccacagctgctggtagccttaaaataacctaaaacttgatttcctgttgtccctaataattctgtgtgtttaacacttcatatttttcagagggcttcgtgagacagatagggtgggagctacctacttaggctatctattcagtttcacacatgcacatttgcccttgttcacatggctagacttgacttgatgggtctttcctcctcattttcctatagcagggttctctcattttttttaaacaccaagtcttctttttattttagatttctataaaatttaatttattctttagtaatttattgtgaagaatctgctaagttttagagcccatcaacttatcatgtagtgacaaaccaattatctgctgatgactgtaggaaatatctactctaaagggggaaaatgtaattggcaatctttgggagatttcacgacaatcaaaataattgtgaactatctttttaaccaaggcacattttttgtttgtttatagttatttattccaacatttttctgattataaagtagtatgtatttatggttaagaatttgaatgcagaaacaaaaattacctagatcttaccatgctaatattttaattatatatcctaacaaggcatggtgatggtgatgagggtggcaaccaagatttctggacatactgaattggtgatgcctattagacatacaggtagtaatttgagtatgcagttggctatatgagtatgaaattcaagagagaagtcaagattggaccaaatacgaatatgagagtgttcagcaagtcagtgaagtgatcgtgtctccattgtgggtccagatgggttcacctagggagtgtgtgcaaagaagaaaccagaggattgtggtatcctggaagccaagtgaagacaaggtttcaggaaaggaatgatcaacttgttaactattgctgagatgctgtgtaagaagactgaacatttgccatttggtgatgtggaagctgttgagcttcactaaatggtttccacggagtggaggggaaaaggcttgtttgagtggcctcaaatgaaattgggaagagagggaagagacagtgtgagtataaatggttccttttggaaattcagtacaggagagcaaagaattatagatcgaggggtataaggagggtcaataaattttaagagaggatccattattcatcagttccattaaaggcaaatgcaaaattttattatgtgcgtggttttctggtggaagttcaatagatttcatcagattctgtaaggcagagaaccagtgctctagtgatttggcagttcaacagctcatttttctggaggatacccttaaaattttaactgatttaaattaatattcaccagtattaaatagtatgtgtaacatcgtacccaaacaagatgtctttctgtatttttttctttccttctcttagttttgttaaaatctttttagttcagaatattctctatcaaatgccttttctatttgaagactctcctaaaaagttatattaatacttgcaaccaagtgatcaaccatttacatttaactaaattttgctacttttgtttactatctatttaaacattttaagtttgtgtttttagtcaaagtaatacttgttggtttttgtttgtttgtttttttaagtacagagaacaaccttatctgctgcacctcaccccctaattctgcttcagagttatgtgcaatgtttactggtttctgctatttaatttttttggtggatacctctgtctaaaatgtttacacctcagtttatttatcaacctaagatattatctgttgacttggtattactgtgggtgatgatttcgtttactctactatccccccacatgtatttgtaatcttattattccacttctactgttgatcacctctgcaactccagctctaaacactttttttctatttctttttcttgtctcattaatctgaggcagtgccttttgactctgcacattgtaagttgtatggaaataccattcccattcttcctgattctgtctcccagcctgctttattttgtcaaggttaataatatttacattctatgctatagttataattaagtctctcattatttgtctattctaaaagttgaaaaaagtcacagagatgtaaagtgacatgcttaactgacagtggagtcctcaagttataaagtgctattaatcttttgtgctgtccacccataggtatccctagagcagcgctagctgctgtttggcagtttctggagaagtctttatgtccttacttgtgctccctgataacaactctgtcctcatcttcagcccctgattgtgggattttaggggtatctgagatgtaagcatttagaaagtggtgtagacaaaccgtggaagaggctgagttgggaaattttacgtgttgggggaattttcattctttgcttttttcccctcccctctttcttgtgggagccttaactgggatagtaacaattgcacccgcctctctgcccattagttgctcatcttagaaaatctacagttaacatatttagtggcgaaatacttaacactttccttatatgggaatgagatgaggatacccactgtcaccactctcactattcggtcattgcaataagggaagaaaaagaaataagcataaagacgggaaagaagtaaaatggtctctgtttgcagatgacatgattgtgtgcatagaaaatcctatggaatccacaaacagctatccgaactagtaagcaaattaaggttgcagaattcacggttgatatttaaaacgataattttgtttttacacaatagcaacaaaacaaaacaaaagagaaaatgaagtttaaaaaaaccaactctgtatgcagtaactataaacattaaatgctgaggaatatagcaaaagcttcacaagccctctactaaaaagatcataataatgctgagataaagaatgcctaagtaaatgaagagagatgccatattcatatactggaggactcagttttttagatgttggttctccccaaatagatctatattttcattgcattcctaatcagaattcaactagctcttacagtagaatttaataagaattaaaaagcccagaagaattagacatttcacaaaagaaggtatacaaatggctaataagcacatgtaaggaggctcaacatccattacttatcaagaaatgcaaagtaaaaccacagtgagataccaccatacatatcaggataggcaggattaaaaagatgacagtaccaagggttaatgagaatgtagagcacggctgtccaaccttttggcttccttgggctgcattggaagaattgtcttgggccacaaataaaatacactaacactaacgatagctgacaagctaggaaaaaaaaaaggtccatgcatgattttcatgctatctgccaccgccgatgaaacaaaacagtcctcacgttcaaagggatggacacgtcttacgtagagcattctaattaattgccatacattggaattgtcatacactgctggtagcaagataaaatgatacagtcactttggaaaactattcagtaatttctaaaaagttaggcatgtgcctataatatgacccagctcttctactcctaggtgtttacccaagaaaagtgatacacgaaatatatgtccatgcaaatgttcatcaaagctttattacaataatcccaaattcagaacaatgcaagggtacatctttattatagtagtccatcagagtcaaatggataaacaaattgtggcatatccatgtaatggagtgttattttgtaatacaaaggaacatctgatgtatgcaacaacatgaatgaacctcagaaacattaagaagtaatgtttctgagtaatgaaagaaacccgaagtaagagtacataatatgtgattctatttgtataaaaagaaaatgcacattaatccatagtgacataaagcaaattattggttacctggaatcaggcacagggaagggtacatgtcaatgcccttggaggaaggggcgtgtgaaattttgaggactgatggaaattttgtcttggttggggggggtggtggtggttttatgcacatatacagttgttaaaggtcattgtattgcatgctttaaatagatatggtttattctatataaatcatacctcaaagttgcttaacaaatagtgactgacaaaggcatgacagaaaatatgtattcagtaaaaaagctttattgatgtggaccaattctagttactagttcacattttcatagcagataacaatcctattcagaatcaagtagcagccaaatatgttaagcaaataaaagacttcattgtttcttaagctctttgtagtaagaaggtataacagtggaatctgttagtcttgttttggttctggagcttggatttcctgtgttccttctcatctttgttccagtatttacttccaagctcttctaagcttatgacctggaattatcaaagttggttttcatcatttgggaagtaaaacaccatttatttttgagctttgaggagtctataactttaacaaacttccctaacagttcacagtcttctcctctaagcttaactttagtttcataatttcgaatatggatttagacccagcaactataacaaaaggtccatgacttaactatatagtttttaatgttaggaaaagtaaatgaaaaatcttgcctgtatgggacctcacatgatgttgtaataatcatgagctgcaaaaattgtagtgattccctcccaccccatttttaaaaaagcggtggcatctttagttatataacagttctaatgtaaattaccaggttatttactcctctaacaatgtcatcatttttggtgttgctgtaagctcctctgctacttaccttagttcaaacttttttttttgtttcccattttcattcagccttttcaaaatatatttgtcagtgtaccttatccaataatacttaaggattttcttaaggctgagagaaataactttagaaaatgtgactatcaaatacagatgtttaaacagttatgatatttaagcctgtaaacggttaaagaaaataacagcttggtcatggagttactcttccaggctctcctggcaggtgagtcgggtcttaggaccttgggaagaatgttgtcttaaattactgtcctgaattaagtttccacagactttctgatgttaagtttttttcagaattacagaatgatgaaaagccatgtctttagaatttttcttatgggaatctccaccttaaatttaaaatcatttttaaaataaaggcccttaaaggagagttaagggtgtagacacaggatactgttggatctttgccatccacttgaaaaattgaatgtaaggttcacctaatttcagaagaacactcaaactttgggtatcttaggtgtattgtaacaggaactgactggcttaggggagtttgaagcttgggcttagggaggttagctttcttagcttagggagctcagaaagatgtcatagtagaggaatttccctgtcttctgagccattgaataccctgccctgaaattgagtgaggtgaaagtaattgacaggttgatgaaggtgatgttaggcagaaacagtgaggaggcaaaggtggaaattccaaatagccactagaaatgcgagaaggcaggttttgaggaatggactgggctgcagatcagggcactgcttttataaaaaggctggcacttgcccatatgcaccgttcctgatgtccactggccaccacttgtggccaaccacacacacacacacccttgactaacagaactatttgtgaaataattgttctcattaattgaatattatggttaaatgaaaattgaccaggaaagtagtttttgtttgaagacttacttcaaataaatacctttccagatgtccacattcctgtgtaaattgattataatgatcattattatcttttttacttgaggcatcattctcattttgaacatatctaggttatgttcttgaagggacagtcttttatttgtgttttcttggcacttaatgcatcatatggcccagctaacacttgtaggaagaacatttgtcatttttcaatgaagataaaaaatgtatggtagcctttttttaaaaaaaaaaatttgaggtgttatttattgtacccttctacattgagaattaaaacacaacatataatctattgaaacttgaggtagataaaattctagctctttttcacacatggaactttatacaaagttatcttctgactttctgttagatgaaatattgtagacctggttccatgatcacatgttcaccttaggtttttaagagttttttttcctttaaataaattatataatgtgataaagccacagcatcttgttttctgtatgattttgaaagcaaaaatgtcaagtagtaactatatcaaaacttaaattatgtgcattcagcagagagcagaagttatttccaaattgaggtgtaggaagctttaaaatgcttattcatcctttatcagcactagtgaatgaattggcaatttcctaaggtcagcaaacttttattttgaatgataacaatagtattatttctaagaatatagaaaaatgcaggcgtaacacaggagtccaaatttagtattaagttaatagaattttagattctggaaggctggagtgtttttaggtttgagaaatgttagaaggtgcatgatggatgttagaggacatgaaggtgccgttcttgtctgatgtagttgttacgtagttattgggtaaaaatggattgctgaccacttagatggtttccaggattaggagaaatgattttcagaacacttctgtagtgcctcatgctaatgaaagcaaaaggcaaggtgttttcatgactgtaggtcatatatattggccatgtttatagttgccagtccttgctcttttttggcctgttgttgcaggtatgtctttgacttccagagggatgagctggcctcttttttgtccctcaagtcgctggaaaagctgtccaagaaattttctctgaatgcttggctcagtggcattgttccacatatgttggaataggtgactaggctgtgtttggaagaagatctagattggggtccccaacctccgggttgcacagcaggaggtgagtggctgtccagtgagcattactgcttgagctccacctcctgtcagatcagcagtagcattagattctcacaggagtgtgaaccctatggtaaactgtgcatgcaagggatataggttgcgcagtccttatgagactctaatgcctgatggtctgaaacagtttcatcctaaaaccattgcacccgcccatgtggggaaaatttgtcttccatgaaacccatccctggtgccaaaaagttggagactgctgatctagatgatctctgttttgtttctgtattaaaaataagaaattactaattcagcagcatgtacctgtgttggaccaggtccaacaggtatgcttgggttatggcagggaacaaatcagacaaagttgtgacatttaaacagagaactaaaaggtgaggcattagctggctgaagagtagaagtccagatagtggccacagtgtatgtggaggccctgaaatcagtaggagcttggggcctgtggagcaggaaggaagagacagtgaggctagagaatagcaagaaaggggggcaatggcttgagataagtctggattaatggatggaaaacccaactacataggacttgaggacgtgttaaggattttgaagtgatatgccatttatttggaagatgacgtagggtttttgttaggaagagaatacattggagggggtcaagaggggctttaggggtataaggcttttgttaatattatcaccactaataacagctaatattatttgttgctgtagaccaagcactgtgctgtgaacccttttcccacatcatctcatataaacttcagaacatctcagcgaggtggtgttttctctactttatagatgagggaaccgagacagtgaggttaagcaacttggccaaggtcatatagctagtagtggcagagctgggatttgaacccagacagtgtaagattgtaaattctgagactctaaatcctgtggtgtttgccactgggcctgtatttttcattgcgtaggtgatgcgcctatgtgggtcttgaaattgagtggatcgcaactgggatttaaaaaaaaaattgaatggagtagaaagtatcagactacttgcaagtaataagcataaatattgatatgtgaaactttattttatgtaagtaaacttgtacatttgtgagcttgtgagctgttatagaaggttaaacagcatttttccaggcaggagctgatgatggcttggattagagttgtgctgatgccgatggagagaggtggaccccagtgctaagaggcagaggcagcaggactcagtaagagattggatagaggtgcccagctgaggaaggaatgaggagtgagtcccagatttcttgtatgaacagcatcagtcatggtgcatgctgtgctcaatccacttgaagggagactgatccttcttagaggggtcctcctggatggctgttttactacctgaatttctagtttctctcagctgcagctgacaggacttggggttggcatctcgcccaggggcagcaaatctgtaagctagctctcaacccatgagatgatgtgttactgaaaactgcctaaacagatgttgagccaataattaattctctggaatttgaggtgagtagtcagccagctggtggcaggatgagaagcggtgggccacagatgtatgtagttgactactagcagctctagggtgaaggtgtaggaattatttgtgtggagtcaccttgagattcaaagaacctttagatttccgtttctaaggcccagagtcattctctttctgaagctcaggtccaattttttttttcttgctctctctgcggtccatatctgtattctcaagcataaccttttagtcatatccagctccccacattgctgcagtgaatctccatactgtgcgttcagctagtactaactggagacagaatgatggagtagttaaaaaaaatgtctggtggcaattctccatctttgtcttattggtcttttgatgttggccaagatacttcttactgagccttggtttccacatctgtaaaattgggatgatagaggagcatcacagggctgttttgaggcataaacgagagaaactctatctagcacttagctcagtgcctggtgaagaattacagcttaataatcttgccattgatagttaacatctttaggatagtctctggagagacttaaacgtgttcattaacaaacattatgggaaggagccagcatagagggagaggttggatatctatgagacagggtcttaagagaaggtattggatcccagagaagcaggcatggcacgggattaagagaatacattacagattgttttcaacagaagagggaacctgatggaggtggtaggaggactgttttttctgaggttgggtcccagtcatggtgatttgctaggagagatgctgatatcaggaggagaaaagtggcaaggtggaaagctattatagagaacaggagacagggacataccagaaaactggtgaacagtaccaagagcctgcgactgcacattgtaaatttataatgacaccagtctgtgtatttctacagtgttttctggcagtgctgtgttcaaaagaatgatgagctatagaagtaagattagtatagttttgaagggtgtgcatcctagataccaggaaagaataaggaggctgggagcgtgggtacagggacatagtagggcaggtggtcagccatggagtccggcttggttgggagggcagtgtgctctgggcagggtatagtcttgaagaaagaagagggcagtggtctgtgtgtggtgccacccacaaaagatatataacttctttgattgatggttttccctgttattcttaacactaatttcttgtgttgataactgaagtattaagactaattgctaaaaataaatttatattctcgtatgggccaaaactggagttagttctagtgtttaattttgaagttaccagtgatttcgtgtggtatgctgaatcagtaaataagttgtgatccttaaccttgggactgaacttcagtagtccttatttctcctttcatttttgtttggagtgtgtagcaaatctgaaagcagtaccatttactcattcactgaccatttgaaggcttcccatgtgtcaggagaacagaagtgaatgacgcagggatgataccgtgaggcatcacacggataaaggccaataagctcctcacagtatcatcctttccggccgtagggtgctggaagacaatattagaacttctcttttaacctgttactttgaacttctgtgtttctcagaacatatatatcagaatagtagcacatgtctgaaaaatatagataagcatacacgtattgggggtattcttgtttttggcagtagtgtgtatgtgatcaaaaaatatttggaggctattatatgttagtatgtattttaaaaaaatataaaattataactttttcttagcattttgagaaaacctagtttctgcatgtaattaatgaggtagttttacttgcctgtatttgtagtgtgaagtaaatcttactgtataaaaagacttactaccaagatctggcttgacacatttcagtcattttcttcttggtgctggaggaactttaccttttgtagaacagtgtcccttgttataaaacactaaattcacttgccatctatcagatgttgaggaatggggtgtggagaatgtggaacagcacatgcctgttttactatcagtctcatcccaaggtgtgacctctggggaccttccttcttacctctctggctgtctctcctgccttctctctctctctcaactgtctcaaaacaataggattgggatgccaccagaaattccctgctcccatctgtttgctcagagtaggtggttactcagtgtgtaatgtctcactttcagagagccatgaaatccttggttcaaaaagttccctcacaccaagaatcttttccgtaaaattagttagaaaaactgctatcaagaacctattttaaatgaagtatattgaataaatgcctctaggttgttcctctggaggttttttattttcatttttgttttaatgagtatgtatcttagcctgtatttgacactgtcattttttaacaagatgttatttaagtgaaatcttgcatgtgtgtttgcaggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgagagatccatgtttttggcaattttaatctacttttacttaagttttttatggttcataatgttgaaaataaagcacagtctccttgtcaggtggctatggagcatttcccaggttctgtgcaaccccttttttttttttttttagtttttttaatgtaaaatcattaattttgaatgttggttaacattactgagcagttggatataacataacacccactgttatgttatttttgatgaaatgaccaaatcaggacacgcccagtggattgtaggcaattggaaaagtcatggttttgagagtctgtgctgtgtgacattctcttctaggggccctttccagtgatcagcaattgtagctatgtgtgttagtctgttctcgtggcgctaataaagacatacctgaaactgggtaatttttaaaggaaagaagtttaatcggctcacagttgcacatggctggggagacctcacaatcatggtggaagacgaaggaaaagcaaagggacttacgtggtggtgggcaagagagaacttgtgcagtgaagctcccccttataaaaccatcacatctcgtgagacttattcactatcaccagaatagcactggaaagacccgcccctgtgattcagtgacctcccattgggtccctcccatgacgtggcaattgtgggagctacaattcaagataagatttgggtggggacacagccaaaccatatcactaggtttagggttctgtaaaacgtccgttttcccaagacatctcctatgaaaaggaggcactccatgagtgttctgtctccccttctttcttgacttagtctttatgtattgattagaaaaaataaacagtgttgcgtcatttttatatagccttatttttacatacatctttttctctggtctgttgtggagctcaggctaacaaatatttgggtccttgttaatgtcctgcctttcagaggaattctcttttgggtggggatgtgctggctgtgctgactcctagcagcatcccttgctttagttagtaactgctactagcagagtatcaaggctgtggcattgggacacaaatagaagttaggaggaatatggagaaagaatgtagaaatcatttgagtatgacaggtctatgtgggatattcccagttggatacggttggataaactgtaaactaagtctacagtttagcttgttgctgtccatgcctacttctgtgaaactgcagctacggttttgggaacaggttgtctgttagttttgtagcagaggtcagagtcaatggtgcaatatcaagaaaatggtaaaaaaggccaacctatgaactagccattgttttaaaaaaagaacaacacattttataatggagatgtattaactatggttcatattttcaaattattgaatgagactttacaagtaaagcaaagtttgattcgtggatttaggaggaaaggtatgtgcatacatgcatgtgtgtatgcattcattcattctttctaatgtgtaaatcataagttttcaaatatttgaagtgtttcattatagtgacaatgtcaaaataccttataactcactatcctaaagacctttttagattattttaacatatttaaaaattttaattgaaatttttatcgagtgtattagggttctccagagggacagaactaataggatatatgtatgtatgaaggggcgtttgttaaggagaattggctcacatgttcacaaggtgaaggcccattataggccacctgcaagctgaggaggaaggaagctagtagtggcccagtccgagtccaaaggcctcaaaagtagggaagccaacactgtagagccttcagtctgtggccaaaggcccaagagccctcggcaaaccgctggtgtaagtctgagagtccaaaggccaaagaacctggcgtctgatgtcaagggcaggaggcatccagcaggggagaaagatgaaagctggaagactcagcaagtcacctatcccacctttttcctcctgttttgttccagcctcgctggcagctgagtggatggtgcccacccatattgagggtgggtcttcctctcccagtccactgactcaaatgttagtcttctctagcaacgccctcactgacacacccagaaacaagactttacagccttcaatccaatcaagttgacatttaatattaactgtcacactgatgttttcatgtacagatgtaagaaacaatgcagagttccttttcactttgtccagtgtccgccattgataacattttgcaaaattgtagtatagtattacaaccaggatattgatacaatctcccatagcgttcagattgccacaattttgcttgtactagcatgtgtgtgtgcgggttaagttctatataattttatcccctgcgaaggtttgtgtatccaccaccatagttaagataacagccgggcccagtggctcatgcctgtaatcccagcactttgggagggcgaggcaggcagatcacctgaggtcaggagttcgagaccagcctggccaacatggtgaaaccacatctctactaaaaatacaaaaattagccaggcgtggtggcgggcacctgtaatcccagctactcgggagactgaggcaggagaatcacttgcagtgagccaagatcgtgccgctgcactctagcctgggtgacagagagagactctgcctcaaaaaaaaaaaaaaaaaaaaaggaactgaacttgccaacacaaagatcccttgtgttgtccttttataaccacagacatctcctgcctacactccatgccctcatccccttgcccccttcctccgtgcctaatccatggcaaccactaatctttcttccttttctaaagttttgtcattctaaaaatgttatataaatggaattatgcagtatattacctcttaggattgatgttgtttgacttagctgagattatccagcttgtgtgtatcagcaatttattcctttttattgctgagtaatattctgtagtatggatgtaccttgtgtgtgtgtgtgtgtgtgtgtgtgtgtgtgtgtgtgtgtgtgtagctttttacctattgaaggaaatcaggctaattctggtttttggctatcacaaataaaattgctgtaaacatttgtgtactggtttttgtgtgaacataaatttgcatttctctgggataaaagaccaggagtgcagttgctgggttatatggtagttgcatgtttagttttataagaaagtttttttcaaagtgtctgtaccattttacattcccactagcaatatgtgagtgatttagtttatcggcattctcattagcatttgatggtatcactgctttttattggagcctttaaaaagcctaaacatggtttagcatgtttatgtttttaagaagatcacagccgggcgcggtggctcacgcctgtaatcccagcactttgggaggcctaggcgagtggatcacgaggtcaggaaatagagaccatcctggctaacgtggtgaaacccccgtctctactaaaaatacagaaaaattagccgggcatggtggcaggcacctgtagtcccagctgctcgggaggctgaggcaggagaatggcgtgaacccgagaggcggagcttgcagtgagccgagatcgcgccactgcactccagcctgggcgacagagcgagactccgtcttagaaaaaaaaaaatcacaaatattaatattatcttgaccactcttataagaactcagtggtttcaaattaattttgtgcttttaatccaggatgatgccttctgtgtactggagttggttccatttgcctctcactttaagaggcaggtttaatgtaaatgtgcaagtttctacttaaaagttttgttacttcgagtccatgaatttttgctgaaacagtaccgaggcatgatttttataacttctcttagatcacttttaaaaatctgaatctttaaaacttttactgttaggaatttttgacagtaaagttaatagttaccagttagtatgcatttaccatggatcaagactttgtaactgctttacaaatactgttttatatcctttaaaattctgcttttgtagcttgtagcagttggagttgtttggaatacagtggccatgtggagctgggctagcagtagactcactatgtgtggcaggtagtgttcatcctgctctaattcatagatgattttttttttcactatcatgggaaaattgtggtaatgtcttacatctttaacttatgtgagtaaaccataattcatgtgcaattaagagaggactctataaaatagtgtgtggtccctgtgaaaagcatgcttttccaggatctttttcttttacatttcttagaagaatatgttttcttcaaattaaagtacatattttataattatcacaaataagttacatatctctctattcctcttctacttattttgtttttatgtactagacagctttcaaatgatgtgtttgtttttattttgtgtatcaacaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtgagcaggaatatgttcttaattcattgttttaataaccattaattgggatttactgtggatcagctccctttgcatcattagggatataatcaggttcagggagtggggaggaaactcatacaaaattaattgtaagactgtgtgatagggctgggcgcagtggcccacaactgttaattccagcactttgagaagccgaggtgtgggtggatcacctgaagtcagaagtttgagatcagcctggccaacatggcgaatctccgtctctacaaaaattagctgggtgtggtggtgggtgcctgtaatcccagctactcgagaggctgaggcaggagaagcgcttgaatgtgggaggcggaggttgcagtgagccaggtttgcaccactgcactccagcctaggagacagagcaagactgtctcaaaaaattttttaaaaacactgtgtgataaataccaaaagagagagatgaagtttgaaggacttctgttcattcgtttccagtagatatattaaccataaagtaggttcacacattggctgtgttcacacatcggccatttaattgtttaaatcaaatgccatgctgcaagacaaaaaagaataatgattctatgctcattatttgataactcctggaaaaatgcagcatatattcagtcttgctcattgccaacaagaacctctagacctgggacatgtccctgagcagtggtttaacagtgattagttgtaggaatgtgacttctagtggagtaaagtttattggatctagtttttcatggccattgatttttaaattttcctttggccatttcaactattgatgaatgtcttaatttagcatgagttacatgtagctggtatgatattaatcaaagcaagcttgatttgtatattctgtttgtatttgatagatcctttctgtaaaatattacttataagtccaataatgacaagggcctgttagttccttccaaaaatatattaattaaaatattttttcttttttttgtttttatattttatgattttttttgcctttcaatagttggcttttctctttataatcacaatttacattctttttaaaaattatttttctattttatccattgcattttttcccctttcttgggctttatttgttttttgtaagaatacttaacatgggatctacccttataacaaaattttaagtgtacgatacagtattgttaagtataagcacaatattgtacagcagatctctataacttattcttttatgactgaaacttaacccatccaattgcaattccccattttttccctctccctagcccctggcaaccaccattctactctctgtttctgtgagtttgactgttctgtctacttcgtataagtgaaatcatgttggatttactctcctctgtgtctggcttatttcacttagcatgatgcctcccaagttctccatattgtaggcaaatggcaggatttccttctttttatcaggctgaatggtattcctttgtgtatatacaccacgttttctttatccgttcatccatccatggacatttaggttgtttccatatcatggctattgtgaataatgcggtaacgaatatggcggggagtacagactgggcacagtggctcatgcctgtaatcccaacaccttgggaggctgaggtgggtagattgcctgagcccaggagtttgagatcagcttgggcaacatggtaaaaccccatctctacaaaaaatacaaaaattagccaggcatggtggcatgtgccagtagtcccagctacttaggaagctgaggtgagaggatcgcttgagcctaggaggttgaggctgcagtaagccatgattgtgccaccgtactcctgcatgacagagaccctgtctccaaaaaaatatgtgtagatcagtgcagatatccttttgagattgtatagaaattgggatagaggcctatgttttctttaatgtaaaataagttctctgaaaaacttagatgtataccttcatcttcctaggtttgactataattataaaatacagcaataattagtaatatttatttcatattctaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctggtaagtgtaaaagtttcttgttactatttaaattccaccactttcttttttgtcaaggaaatagtttttaaatttctaggtcagatataatgctcaattacttattttaatatgtatcaattaccattttatcatttttaccatgatatgctgtgatatgtaagtgctttttaaaaagaaggttttcaaattaagaatgactttactgtctacctaatcattagtggttgtgaatagattcaagaaattataaagcactttaggttctctgttttgtgtctatagaagttaatattccaggtgttcatttaaatgaactgtggacctgaataacttgttttggttgataccaaaaccagaccaaccaggatctttcatctaaggaaaaaaattctgatagatatggtgatatgaattgaaaatattaatatctaatgggatcctaagtgagaacaatgcttgcttttgaatcttttctttttcttttttgagatggagtcttgctttgtcgcccaggctggagtgcagtggtgcgatctcggctcactgcaagctctgcctgctgggttcatgccattctcctgcctcagcctccggagtagctgggactacaggcgcctgccactgcgcctggctaattttttttttaatttattttttgtatttttagtagagatggggtttcactgtgtgagccaggatggtctcgatctcctgacctcgtgatctgcctgtctcggcctcccaaagggatttcaggcatgagccaccgtgcctggcctgaatcttattttctattccagcatcaagacacaaattaactgaaaattgattagtttactcctctttcttttttccgttggtggaaggaagcattgtatgaaagaggacaactctgatagtacaggccagctaaagctaagatatggtaaaagatagcaaggaaacagcctagaagtagtaaaaacattgcttgaatattcaattttgtgtctattaattgttgaaagtttaaaagttgggattgtggcaagttttcaagcgtgaacattctagctatgaatggcaattaaacagcaacaatttagggaaaaaaattgtgcctccaggagaagttgaaaaataaaaaattattatttatatattgtacatatactttgtgtaaaaagataaaaaatcataactatattaaagagatgaagcataactaaataaaaaatagaggaactagatgttttacaaatagaggcatgagagatgttaaaaaaaaaaacaaaaaacccaaacaccgacatgatattgctgaatagttaaaattgttaaaaccaaggaggaaaagttttcaattctatagtacttagtacttttagagtgtgtatcagtaatacctttaataaacactggtgttctttcttattcagttttgaattaaacccttacctgcctttagaaggagtatagcattttgagcttcagtttttattctgtgctgcaatacagagatgctttttacactgttaggttatgcgaagctagtggaatgaaatctacataaaattgtactactgaagttcttagttatgcttcttagttctttttcttgctctttctcgtctgccagctataatttatagtagttcatagagtttatccagttttcttactcctctaaaaataaaaataaaagcgaaacaagactattctagtttatttcgtaactttattttataaatggatactaagcaaatatgtttgagagtagctattatcctttagaactactctatttcttggctcaagggttttatttttttgatacaaatcagacattggtttgctagattattgatattgctactaaatttcagatatctaggatgaagaagccttgctatctttgggctttcttctccctctgcctttccttcttagagaggtggcagatacagtggttaaaattgtgggctctcaatcagatgcttagtaactttgggcaggttaatttctctgtgacttggggttttcatcggaaaaataggataatactagttcctactttatagattaggtgcttatttgggggaattaattgagttaatccatctgaagaacttagaacaatgcctggcacgtagtaactactcaataaatactatgtattttttattattttccattttctactttttaaaaaattttatttggtttatttatttatttatttttagacggagtcttgctctgtcacccaggctggaatgcagtggcatgatctcggctcactgcaacttccgcttcccgggttcaagcgattctcctgtctctgtctcccgggttcaagcaattctcctgcctcagcctcctgagtagctgggattacaggcacgtgccaccacacccaactaattttttgtatttttagtggagaacaggggcttcaccgtgttagccaggatggtctcgatctcctgacctcgtgatccgcccgcctcagccttccaaagtgctgggattacaggtgtgagccattgcatccggtctccattttccctttcttaattgaccttcttcctaatgtctctgcctaaactgtaaactctgtgtttggtatattgcttctgtcatcatagtaaggttcctttcatatggtcagtgaataactactggttaattttcaatacaaagtaatattttgtttctcaacagtttttatgaaatccaaaatctgaatggtcagtatcctgtttaactattacattaatttggactctttggcttcaagaaacagacttttgattgaagaatgaatgaatgaatgaatgaatttgttgtagggagataggtacctctcatttagaagctagacaatggagccaggcctcataaataacagggaacagaagtggaagactcctgggaacccagggacttctctgtgcacccgcttcgctctctatccgagagtggctttgtgtgtcactaagtgcacatgggaagggtggctgtggcacaatgcctgaataatttcactctctccagggactaatccagtcagagactactgttttagtcagttctgaattcccaaggagagcatcttactggctgaattcactcaggtatcctcttctgtgactagcgagcaagaacaaaatagaagagtcaagaccctcctttctgggcaggcacagcagacatctgatagtgtctcctgcacctagataggcgccagtctgacttctaaaataaccccagagaagttgtgttggaatttttgtatcagagtgactcatttgtgtttcatcttccttgaagtctctactcagtccttcacactgctctcagttctagtgatttgtactggcaaactccagttgcagcgtgaggggtacattacaaatttctgtactgcgtagatgtctttctcagataaacataaacagaaaatatgctgcttattagctaatacgaataagaaagctggcccgtctagaaggaaaagaatttgacgtttaagatagttattatggtaagaagtttacttggaccctggttgttgggtgatgttatggatcttgtcttttgtaaacagaaaactaggagggttacagccagaggtttatacttagtagcatggagagttgagaaagaggaaggaatgtgaacagatatttgtgtatattttaatctcattgagatgttactttttgaaagtaacatggccaataaacaagcagtattcttagtctttatagtctaaagattataacaaacctatttaagggaaattgcttgtttaataattaaacagccatttgcacatagtgaatgactggttggctttaacatattaatagattcacagtatttattgctcaggtctaaaaatattcatgcagagggccctatattctagttagtttggtcttaggctattggctgtttgttttcctagaaagaaatcttggaactttttgcagttcgtcctgagggcaatggcataatagattctggatggatcagcatgtgataaaaaggggtttgattacaatagaataattattctaaaatgtttgcaaagtgggttagtattataattatgtataaaggaataaaggacacttttattaaagtctcagtgtgttgggacaaagggagatgtgagttagcatttagtaaataaggtatttctcaacaagaagttctgtcagagtctaatagaacctttgaagaaaaggtgtttatttatttggtggaaaaatggatggtattgactttagcatttattttgaattttatagtatgttagaggttaagcattaatttagcattgcttttattacaagaactgaatgcgcataatgcataagccagtaacatgactttggttttttttgttattttttttattttttttatttttttttttgaggcagagtctcgctcttttcgcccaggctggaggtcggtcttggctcactgtaagctccgcctcctaggttcacaccattcacctgcctcggcctcccgagtagctgggactacaggcgctggccaccatgcctgggtaatttttttatatttttagtagagacggggtttcactgtgttagccaggatggtcttgatctcctgacctcttgatccgcccgcctcggcctcccaaagtgctgggattataggcgtgagccactgcgctcggccgacttttaaaactaacaattataaagtctttggattcagcttctgttcagtgtttaacttatgaagctcttgtctatgtagctttctttacaaggtccaagtttattcttttctggaagattaattcagaagttagaaaatatacatatctctgataaccattttaacctcagaggtaccctgaaatgaagggagcctcgctttttgcagaaaaatatttaccaaaatgtatttcttttagaaagtatcaaatattgttttcgatatcaacttgtaagtgatcagcaatcagaatattcacaaacacttgcgctcagggttgaggtgttcagacaccattttatttcattacttttgtccattatgatggcacagaagtaaaacgacctcatccgtccttagtgatttgcattttgtggtgaagattatattttattaaaaataaacctgtcctattcacaactagtcacaatttactggctgctcaaccaaagcgcaccccagtggcccttccggaacctgccctctgtcattccgtgttgtcgttgagcagcatttcttgaaatgtggtgtgtgtcccattggcatcatagttatcttggggtgccccttaaggtggacatttcttagtctataccagagctgttgttaaggccctggaccttgcatttgatacaagtccaagataaatgtcatgtacgttttaaattctgagaactcactgcatgatagcactgaggtcagacggaggctttggagacaaatgactggaaagcctgcctggccactgggtagctttgtggtctggggcaattgcttaacctccagtacccacattcccccgttactaatgtgggataagagtaacagccacagcggggttgatgcaaggatctgatgagatcagggatgaaaagctgtttgtactgcccagcacgtgttcagggctcaatatgtattagttgtactttaaataaaagtggttctctattcttcctataagtatttgctggtgaccctacatgttaaatgttgtgcttggtaccaggatgtcagaaatgagtaagacagaatcctcacttacttacagtctcatagggagtcaagttcaagtgtgttcattttttcttgagcttcatgtcagcaccccccaccccattctaaaaatttcaagctttcagaaaagttaaatgaatgggtaccataagcaaccatatactctgcatgtagattctttgatttttgacattttgccacatttgctttatttctctatcttgatctttccgcctttgtctctccacctcagatcatctgtctatacctgttggtttgtcagtctttgcacctctatctccgtctatccatcttggtccttttttaaccccacttggttgatcttggtctctcaccccttggtgtcactgttgttcctgtcctgctgtcttgctggctgtcattcctcactctggctctcttcctctccttttattttctgaattgtttgaaagctaccatattatgacacttcatccttaaatgtttaaacatgcatcttctaaaaagaggcattcttagatatgactaatacctttattatgcctgagaatttcaacacatcctaaatattatatctagtttttattcaaattactctgattttcccatctttcatagatgcttttttttcaaacgaggatacagtcatcgtataatgcatttgattaaacctgtttagtctcttaatctagaacaagtactctcattgttttaatgacaataactttttgaagtatccaggctggatttctcataaatgtcttactttaagttatttgtctgattgcttccccatggctttaagtcatttctccatccctttacttcccgtaaactggaaatgtttgagttgaggagactgagtttaaacattcactggtgttgtcctttatattgtgtcgcctagggaggcaggaggtccagtgtcagtattgtcgtacctgggtagctgggaagtgccagattgctccattttcaaagtaatattttttcaacctgtgttgcttagttatctatgatgtgttacttgggcactttataattatcccgttccccaatactcctgcatcctttagaatatgttgatgaccttcactgtgattaccatgattacaaaatcatgatttttctaaatctttcattctatttacattattttagttggtattcctgattaaaaaggattgttcttcctttctttctcttttatttttttatttttttttgaaacagagtctcactctgttgcctaggctggagtgtggagtgcagtggcgtgatctcagctcactgcaacctctacctcccaggttcatgtgattctcctgcctcagcctcccgaatagctaggactacaggtgcccaccaccacacctagctaatttttgtatttttagaagtgatgggttttcatcgtgttggccagcctggtctcgaacacctgacttcaagtgatctgctttcctcagcctcccaaagtgctgggattacagacatgagccaccatgcctggccttttcttgttttctcttttccctccctcccactctttggaatcacagtggactcatggattaattttttctgattcaatttgttaggataagtaatagtcattattctttttgatgttgacatttttcaaatttggcctgggagagcccgttcaagccagctcctgtcctgttgacataaccatctagcacttgccatggtctcactttttaacctctattgtttcaagatttggaatcacccatttctttaaaactcctggtttcttctagcagttatattggactttggaaagcctacctgctgctggagtattattccttctgggcctttttcagtggacagagctaggaaatatatgcatctgtgtataaaataaagttcattatatcatgaattcatatatatcaggcttcagtaaatgaaagtaaaaagtacattagaaatcctgagtttatgtagtatttccagtccaaatttagcagtatagagcttttgtcttcacttctgtgtttatgtttaatctctcatcatttacaggaaaaattttggctccaattacattagtgtattgtttcctttataatatacagtaagttctcacttaacatgaaatgatggataatgaaaccagtttttttcctcatcaactttataatgaaaggatgttgtaaaaatgagaacacttggacacagggtggggaacatcacacaccggggcctgtcgtcgggtgggggagtggggagggatagcattaggagatatacctaatgtgccgggtgcggtggctcaggagttcgaggctagcctggccaacatggtggtgcaaacctgtaatcccagctactcgggaggctgaggcaggagaatcgcttgaacctgggaggtggaggttgcggtgagctgagatcatgccattgcactccagcctgggctacaagagcgaaactccgtcttaaaacaaaaacaaaaacaaaaacaaaaacaaaaaaaacgagttaatgggtgcagcacactaacatggcacatgtatacatatgtaacaaacctgcacgttgtgcacatgtaccctagaacttaaagtataatataaataaacaataaaataaaaaagaaaggatgtggaacaaaatgtttattgaggacctggtgtgcgttgtttctcttaaagtcagtttccaaaaacctgtcgatgattttaagtgagggcacactgtataaaaagtaagaaaattagacaatcagtattactattaacagtaaacaaattgagcagaatttgagatttatttgcttttttatgcttaaatatttcccagtgtgaagctttaaagttatttgaaatatttgtgttaccaatttggcatacaattaatttttttttctatttatattactgggatttactctacattttttgagacagggtttcactctgtcacccaggctagagtgcagtggcacagtcatgactcactgcagccttgacttcttgggatcaagcaaatcctctcatatcagccttctgagtagccaggactacaggtgcgcaccaccatgcccgggtaatttttttgtgaaggtgaggtttcgctgtgttgcccaggctcctctcaaaactcctgggctcaatcgatcctcctgccttggcctcccaaagtgctgagattttaggcatgagccaccatgcctggcctacatttttaatttgttttattttgaatgtaaaacgtttatatggttcaaacattaaaactatattttaaaaaatatatactccaaatcttgatctcatcttctccttataccctattcatagctacttcctataggtaaccattttcattagtttctggatttttttttccctgtgtttcttttctaaaaatgtgttaacattttatgtctactcttattatccatcctgctgcatggaagtattttatatacatttttctgtactttttaaacttaagaattgatttataggaaatattttttcttagttcagagaggttgtcattcgttttccagctccatagtactcagtagtgactgtaatacagttcaaaccagtcttctgtgggtggacagttgggatcctgcagtgaataactgtatactgtttcatgtttaaggagctgtgtctctaggacacattcctagaagtgggattgttggatcaagggtaaatacatacataattttattagatattaacagattcccctccttaggaattgtcatatttggccttccagcagcagtatatgtgtgtgtgtctgtccacaccctcagtcaagatttgttgtcagcttttgggttttttccagtctgatagtgagataccatgatatctcgtggtagcttttatttttatcttatgagtgaaaatgagcatttttgcttatatttctcagtgccatttgcagatttctctgaactgccgttcagaggttttacttactaaggaactattagtgaccattttctaacagtgagtactctttaccctatcataaaattgtcacttgtacttttggtgccaaattcttctatatctttattgggtgagttatatttatgatctttaaaaaaattatatttgaataaatattgtgcactagctattcaaaataaggatttagatgcaaaggtttttttttttttttttttttgagacagagtcttgctctgtcacccaggctggagtgcagcggcacaatctcggctcaccgcaacctccgtctcccaggctcaagtgattcccctgcctcagcctgcccttttagctaggtttacaggtgtgtgccaccatgcccagctaatttttttgtatttttattagagacagggtttcaccatgttggctaagctggtctcgaactcctgacctcacatgacccgcccacctcagcctcccaaagtgctgggattacaggcgtgagccactgtgcccagcctgtaaagattttttgttggtataaaatccagaatggtaccagaatgccaattttattcctttttaagaaatagctctaattaaaggtgcagcacttcaaacgtgatttatacagttgtttttataggaaaatggaaatatattgtagggataggtagcaggacactaatagtgagtcccactcatgactgtaagtagtgactttgggaggtatcttaaatactgatgtcattaagtaattaacttgaattacttgtattttacttttagttattaagctgactgctattatagtaaatatgtgtcttaaacttagagtgaaatggaaactgcttagaagcttagctgtgtaggagttaaagtgcaggggaacagatgggaacatttaatttatagaaataattctggtggagttctagggctgtgcctatttgttttagttgttgtgaagaagcaagccatcttgtatacttaaagaatgatgtcatccctaatttagtggggtgggaggagtgagagtatttaaagatcatgtggatattaagatacagaagtcataaaatatttgtaatcttcatagtatctgtaggttaagtagtggttctaatttctgggaggaagctcaagtactccttattttgttgaaccatatttaatttaaaagaccaaccagcagttgaaaattttctattgctgtttagaatagattcatcccaactttggtagaggagtccatggctgaatattgccatgagtgaagaaagattctttctcactttcttctggaagctttgttttcatcctcctttggattggcttctgagagaccataaaaagaaatgggtgttgattgcatttaatggttcctactgtgaacaagcagtaggtaccgttcttgccctttcagtatctgcagactcattttatcagaagagtgcaactgataaactttgcataagagaaaatgtactggccaaacattgattttgcttacatacacatacttaacacgcacattcttgacctacatctatttaaaaaaaaaaaaaaaaagaacttgtatataaaaatctgaacagattggagaatactttgccatataaaaatttagtattttgtatttattgtatattttctcaaaatattacaaggctttaaaatattttagaaataacaataattggattcatacataattttatagtaatacttttgtataaaaccataacaatacttttgtataaagcaaaattcgttttacccttttagtgacttttatgtcataaaagactaaaggatggcacttatagattagcactatgaactaacttgtctcaaggttaactggcagcctcaactctccagaacctgtcaatgaacagaaagcaaacagaacaacactgacttgttgagagttgtgataaatttcataagaaaaacgtttgactttctagcaagtgtttatttactcttttcttataaataccttgattatttggtttcctggctcataatagattagaagcaataagatgttagaacaagaaggatgaaatgggatgataatagaaaagacatgctgtcagcagtgataagtgacatggacaggaaggcaggaaccagaaaaacttttgaaaaattctgtggtagactttcttataggggtaatatcttaaaattataataataacaaaaatggtaattagcaagcacaaaattacccccccgaattcttcacactttagtaactcacccaccggctgtctctaggcatcttaaattcagtcccatcccttcagtgggtttgatgttgcttaaatcaagagaggtgttgtgtggattacatagctgagattgcatgttggaaaacatttagcacaatatctgtcagagaatctgctcaacaaatgctggtcattagttgaatcttgcaatgctttgagtctcagtaattaagttatgctaactgtacttttactttttttcttgtatcccatccaaaatgccatccatacctgttatgtacagtctgtaaatccagaaagctccaaaaaccgtatgtttgtcacaaactcttttgaccgaaaaactgccccaaattgacattagactacatagtctttatcctactttcttcattatttgctattttaatgtttacctagaaatgtaaagatagttgatagggaagtgctgccccaggcctgctagagaaattatgtgtgcacccatactgtctttccaaaacctgaaaaatgctttgtgccaaaatacatctgccccaagagttttgggtgggagattctgggcctttagtatttaatgtataattgaatggaattgaaaggataaactccatgtgatcttacttgatgagaagcccctgtatattatttgatcgccttggaaatgttgattgagctaataaacacaagccattgtgttctctttccccacttcacagcaaagtgaaaaggagagcttgttgaaggaaagagatcacattttgtcaactctgggtgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccataagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacacccaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgttcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtagaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaa

SEQ ID NO: 424 - DNA, 46733 bp, Homo sapiens
  source 1..46733: mol_type = genomic DNA
gtctactcagcccggtggctgtcgcgcgtggaatcgcgtaagaaaagccgagtttgtggctggggagagaaggccaccgtgctgagctggatttagcgaagactggttttggggaccggagagcccaggactccctttgttggagttttgcccacgcgttgtaattaagcctcgcacaatatggtgagagtgggcgttgattctggagacaccagctttgtgctcgtgtaatgtaacacgagtgccgttgctttctcattcttacacggcagtttcatgtcattgagtagaattgtgcggaatgcttttatggagtgaggcttctgcgttaaacttgtgctgattccaggtaaagtgtagtagtaattgtgaaagaacgtgtatgaggaaaacgagctacaatgtcatgcttggaggaacaaagaatgttttgtaggatgctttgctttttggagaattgtgtaggggtagggactgttacccatggatgatgctatgggaatttgatcatgtatttgaacaccctttacatcagagggtctgcattgaatgcagttcagaaggataaagggtggaaatcccagatgtgttagtggcagagcacttgagcgcttcacatagtcaagcagagaaatgggaagaggtcggcttgcttcttcctggtctttgggtagtggtgcaagggctgggctgggcttgaaggcacttgccacttctgcctttggacatcttgaagaagcttagggaagaaaggctcccggtgagtcagcttggagtagggtgactttggcgtagtgattcttgtattgttgtttaacctatgtttctgtcaagtggtttactgttgttcggtatgttggttggttaacaaggtaggatgactctctaaaaagttgggttgctgagtcattcgccccagcttgagaggtaattagaaacagctggtgcaaatactctcatcacatgcctccactataaaaggccaaagagcgctctagagaggttgcttcagaaggctgaaggggacccagctggggttgttttgatacaggttatcagtgggtgaagtggaagagcactcttaggcagtggccaatagcactgaggcgggtttaaagacggagcctcgtgacctgctgtctgagaataaatttgcgctggagagagctaaaactggggaagaaatttgcagctaggggtaacccaataaaaaatattgtaacaaaaatatttactactcttactggacttagtttcctttttgtggtttctgttacgtggtctataagtttcaagcagtgagcttaatttgtgcgtcataaaaatttggttatgagtacacagaagggacttgctctgtttctcatggcccttggcttttcatgcatacacaagaagtttcaggagtcagaggagggtaagcaccatatgggtggaattaataggtctcattgggttaagtctcgaaagagctgtttaataaatagccaaccgtaaatacctgtctcattgtcttgattatatgacaccactgcctttacacctggtgtcattgcttcttgctttaaaaaggagcacacaacccaaatatttatatgagtcctcattgcaaacaaagtttaggaatgggaaatgtagagctgggaatttggccctttggtgaaaaaaatgatgattcctattaatggtagttcatttaaaatattctgtattaggaaaaacgatttattttgttcctttaagtctgggactagaggagattagaaatcatgaattttgtaagtattagggcctccaaggtggggtgcaaggaggttcatttggaaggaatatattaaaacttttaaaaactttaatataagaaagacattaagcttaaagatgcagactaacaatcgtgtattcatattatataatgcgcgtgcatgtcctccacccctttgttgctgggggaacatagcctgttaaccactgtcagtaacattctttcaacaaccggaatgctttttcttttaacttacggtttcctcctaagagttctttcagactgttaatattccatttaagttttattttataggtagttctattgtctgtatgttttactttagaagcttgagtgtaaatttcttgttacattgttgatactggggatggaaatacaaaaaatacagaatttcatttgataacctgtattttgaatttggagacaagcccagcggttggtttaatgtatgtgatctgaagtgcagtgatgtgtaaaagggtgcagtggaaatacttgaagataatctacacattggagtgtaatatgtatagcatatgtaaaaattagtttgtactgttactccttgaagtctgtttttttttgtttgttttttgccaagcttatgttctcttaagattaataagacgacatattcagtaaatcccttgggaagtggcatttattcagaatatcaacctcctactagtgctgggggcgggtggcggcggtgagggtggttagtatttaccattcagttaaatctcatgtgccatgtgccttctacacccctgtactgtgagaggtgatgctcagaataacagttgcaaagcccgttaaaattaccacttgtcagattttctcttcatagtgctgatctctccatgacttacgttttaggaatcaccacctctcttctaattttctgactaatgttctgttaatgagagaattgtcttaaccctaaaacctgcattccctgagcattctagacagagggtttattttatgtggtggaacgatgatttttgagattgttttgatttaaaatatatgtcaaatgaggtaatgtaccgatggccaaggtatgggtaatttgagtgcaattcgccagaatccgtgccccttggagggagtaaacatttcaggactgcagctaaaacattgacttacactctcctgaagcccaggcacctggcttacacagtgcactaacataactgaagtctgggtttgatcactgtacagttgacaaagaagcagtaagcagaatggttaaaaagtagttctggagccagactgcttaaggtcaggttctggttgtgtcacccactttaaagccttgggcaagctcttctacctggtaactagtgcctcattgtttcctctgtaaaacaggggtggtgatagtagaatctgtatcagagaggttgttgtgaggattatatgcgttaatacggggtaagtggttagaacagtgccagctttataagaaacatcaagtgttaggtgttattatctgttgttcagaatcagggaagtacttagttacacagtagtgttttatagctgttgagagctgaattgccggcattgatcacaagtgagactggaaaaacaacccggggaacactcttatgttaagtcagtagcaccatctcaaacatacatccaacttctgagggcaacgaacacaggacatagctttttacttaaaggaatcttaacagtctcagcggagtgcttgaggtagtcactaaccagttaattgaaactggcttttacgaaataaaaacacttgccattctttggctagtcttttccacgttgtagttgacattgtggcctggcagctttagtaacctgtccacccctcccttcttgttaataccagaacagaactagtttctcagtacatattcctgggccctatccagtttgttggaaacatttagaatgtaaatttgtaagctaattagtttcttctaagtattatgttttctttagatgatatgcctgtactaatacagaaaaattatccatgaaatggatatgaatacaatggacatatttatcgtatagctttttgtacctgttagtaattcagaaaggttgtgttattttgaccattctttcagccagattgtaagtttcctgatggtgagaatctgtgtctttctgttttatctcctatggcactctgaatgtgccttggctgtgtttctttaataaactgttggttgctgaactgggtggtatgatatgcgttcattctagttctgtgattttgaaacttgggaatgtttaacagattgaaggagagaacatcgtgtgtggtaccttgtaagtgtgcactgagttgaaattcttttgattatttagctttctactttctgtttttatcattggtgtgattattgagaaggcagctggaattaagtaattctagttcatctcctaagatagacataaaacttgtcttgtgacttatttttacccataattggattagaattgaattgagcaaaatataatttggttttctagatgttaaatgtcttatatgtctaatactttgaatatcactcctctagaacaggttctttgttttatttaggatcagggacaggttagaaaatattcaaatattcataggataataaaaaactgccctgaagcaaacgtgaggaagaagaaatagtggtagccagaatcttggttgttaatgaccagtgtagaaacacagtgggcatgcagtgaaattggctggcagctggttccttctcagtacgggcacaatttagaaaatgttacattaatgcagctgaaattttgtgcagatcatgttatttgaaaaataaatgtaaacactttttgcagtgccttaggaaagtcatcgttcaaactaatatttttgtaataaactagttattcccagttttttttttcttttttttttttttgagatggagtatcactctgtcgctcaggctggagtgcagtggcgcgatctcgggtcactgcaacctccgcctcttgggttcaagcaattcttctgcctcagcctccgtagtagctggaattatggggcaccccccaccatgcccagctaatttttgtgttttagtagagatgggtttcaccatgttggccaggctggtctcgaactcctgacctcaagcaatccacccgccttggcttcccaaagtgctgagattacaggcgtgagccactgtgcctggcccctaattattcccagtttctttcaggtaaagtttttttcactttttaaatttatcatttttttagatcagatcagtcagtggacagttgcactctacttccccatccctcattaaagtggaattacactaaaaaaggttttcaattcctttgtagcctggacattagtaatagcctacctctaaggctgtagagtaaatagtatagtaagggaaatgtccctccctccccctacacaccttttttccagttatctcttctttttattgatttgtctgcctccaggaccctagggaggtgtttttgtcctaaggaggtgaactcctgagggtcctattgaagaaatagggcgacctatccacccaacttcctctttactgatatcttcacatgcttattgccttattcattttctaaagtgtgccagcgtctttcagaagtcagctaaattagtgcagttgctcatccatcagacagttttgttataaaatatgtggctataaaagattgaataaatttattaggttgtaatttcattaatgtgtattttatatttaaatattattttaaaaaatgtacagtggttatctgatcttggcccaggcctcttcaatttccagtgtacctgatgtctctttatcaactgtttttctgaggtgtatctcagcctggccttgggtactcccctaggtaagagtcataattcaggttaaaagaggtaagaaaaaaaaaagcttttggcttttgtaatcttgtttttttttttttctttcacattagcaaaagactgttgaagtagagagcattttgcccagctcactcggattctttgctggcatgccttcagtttcagttgtcatccagagaagtcaaaggaaatgctgcttggggatgagcatgtaattacgattaactttccctacttcgttgtctctttgtggtaaaagactgtcacaagtgctattcaaactataggtatttttttttagatttctaaaaagtatattttgtctctgagggcctcctgtctttggactagtttgtctttttccagaccccagaaaggctgggccaccttttcttctttgagcaggttggcaacagtggtcacaaatagcagaggagctgagattctagagagctatcctaccactgcttctcagatgccagtgtggaaacagcctcttcttttttgttgaattagcttggaacagctctctaatctctgaagagtgaggaaaaactgtgtttttaagtttcaaggctaaggcactgtgttctcttttctccctgttcctgctgctgttctcccccaactcacatgaacgcatacttaactttcagtgtatgtggacagtagggttgctaaattcatgtcaatatttgtggcattcctacatgttaggcatttggtttacatttaacttatgaaacaaatgtttaggcttttataagccaggaacttttccagatattggcaataatgaacttttcagaagttacagtctaatagacaggcaaactattcccatagcatgctatagtagcaacatgtaaaatgtgctgtggaaccacagactattaaaagcctaagttttgggaaatcaagaaagccttagggatgtttagtgatgaatgcataggttagtggaggaaacaacttgtatcaactcaatttgagaagcttagctgtgaataagaggagagagaaatagattttagtagggagaagttgggtcaggaagagtgtgtgtgtgtgtgtgtgtgtgtgtgtgtgtgtgtgtgtgtatttaaaaatccagtcaatggaaaaaggttgaagatgcaggcaacgtccttgttttgtccttggcaagttcctcttatggttgcaagatggctgccacaagttcaagtgtcacaagaaaatatgacttaagtttcctggaagaagacacactttttttttttttttcctaggttgttgctatcagtgagaaaaatttttccctaaagcctcatagcagatgctaccttgtccctctctcctctcttcataggtcagcattgcacacaagccagtgcctaaatgagtcaaggtcaaggggaatagtaccgctgtgattggcataaatggatcgtgattcatcttaggttgtggctggggtctacttccttggaagttgatggcctcgggttgagagtagatacgtgagcacagtcagggtttggttagaaagtgagggggtgaatggtgttgtgcagttaacagtgacatccttgtctactagttctgccaccactacacttagatacaaacttcggaggagaaaaagaaaatgtgcttgcctttggatttggaattttaggtgactttttttcctcttatatgccatttccttctatgatcaagtagcacttttacaatcaaatcaaatcaatggtttatttaaaaattatttaaaaattgaaaatgccaattttgtcaataaatatatatagaagaaataattttttttttcaatgctttaaacatttcaaaagttccctgccattgtcttattcctttcagggagaggagaacatataattatatcttgtagtttctgattatgtgtatactaagaggactactctgtccctcagtccatagtgcacacccacctgtggtctctatggcttgcactgagtgctgaggccagcctggctcagatagaattgttagttcattggctagatgggtcaggattctttagaatgcaaattcttgaatcaggagtacaaacaggaacatcttcccttttctacacactcattcccctcctcgaagggaaagctgtcccgtagttagcttattcgtcattcttttcagactttaaaattaatgccaccttaagtttatacagtattcttgtagtactcctaacttttctgttttgctgtatgtgtacattgtagaaagattaaatcaagctaattaacatgtccattacctcacttacctttgtgtgtgtgtgtgtgtgtggtgagaacctttaaatctactctcttagcaattttgaaatacagtaggatccccacccactgttttactttcagcagtttgttacctgtggtcagatgaagtccaaaaatattaaatacaatagatattttgagaaagagacaaacatcacattcacataacttttattacagtatatggttataattgttgtattttattattgttaatctcttactgtgcttgatgaaaaagcatagtatatatatagggtttgttactatctgcagtttcaggtatccactggggttcttggaatgtatcccctgtagataagggggacacctgtgtatgttgttacaagtatgatcactgtgtaaaagcacttttgtatttcattcttgttccttctcaatcgcaggtctgggtgctttctgtgctgtgaaaggcagacaaataatgtaaatcctaaacacttgagtgttgtaaatttacaaaatgagaattgctcaatggttgtttctttttgagagtaacaaatagactgtgataaatggccagagtaggcttctgaactggtattagttttttggatagaatttagaaagacttgtactaccaatataatttttgtctcagataaatgcaatagtatttccctactcagtagttcctcagatgctatttaaactgagctatatttcagctttatttataggctgcaaattgttccttatttggctgaatcttgtggttatgatataatgaaaagtagttactgagatcactggtgcaaatctgtagcttggaaatcctcattttagaaatgattattttgactcccaagttaaatagtaaaaaatagacttatgtttttagttttagctatgtatattgagaaactgtggccctacggtggctgttagggattagtggattaggttgtttttaaataagacatttcagtttagtatctctacttgaataaaacagtttcaaatttgtgattcatatgatatactgattgccctacggtaacttctgttttatttaattaaaattgttaacattcttttttatactcttaagcacctccctccaccctcacccccctttttgactcaaattttattgtgagttggtgtatagttaggaatttgaagagcactttttttgtttattttatcttttcggttactatgcatactatgtgtgtcaactcttaaacctgcagggggtcattttggccatcaactagttttagggctttcgcctcctaaagaatatgaattatggttgtaatttttacagtttaaaaaacaagatggcatatgaagaatctttatttcattatgaaaatagaacatggatgcttaatcctctgtattgaaagtaacttgtagtgaaatacttcctagtgttctcttcttctagttgtccatatgtagtatgtataactatagaccttgatgatttaagttgagcacagtttagtgtcaggttcctttcagtgatgcatgagattggttatatgatctagtgagtgttatttagaaattaattcaccagacccgggtgtggtggctcatgcctgtaatcccagcactatgggagggcgaggcaggcagatcacctgaggtcaggagttcgagaccagcctggccaacatggtgaaaccctgtctctactaaaaatatgaaaattatctgggcgtggtgatgctcgcctgcaatcccagctacttgggaggctgaggcatgagaattgcttgaacctgggggacaggtgttacagtgagccaagattgtgccactgcactccagcctgggtgacagagtgagactctgtctcaaaaaaaaaaaaaaaagaaagattcaccaaatattgattaataaggggaaatttgttgttccacaaatgcccatttaatctgtttgtgtaatagtgttccttctcatcacacacaggatacttggggtatttcttgaactccttgttcttccatccctcctcagttttacctattcttcccccacataccacttgagtcatgtaacatgaattgaaatgtaatatttggacctgggagcagagactttttcagtctttaaattattgcccttctcaagcctttagtttccttatctgtaacagaagcgggtcatcctggatgaatgtgcttttttaattggaaattctttaggtctgtgaaattagccattattttgggcagacttgtgcaattttaatattttcattttatcttgagatccttattaagcttaactgaatttttattataggaagtgttaagccaggtaatttacagaagatcacatggttgatgatatcagtagagcgttaatctgattatccacagctgctggtagccttaaaataacctaaaacttgatttcctgttgtccctaataattctgtgtgtttaacacttcatatttttcagagggcttcgtgagacagatagggtgggagctacctacttaggctatctattcagtttcacacatgcacatttgcccttgttcacatggctagacttgacttgatgggtctttcctcctcattttcctatagcagggttctctcattttttttaaacaccaagtcttctttttattttagatttctataaaatttaatttattctttagtaatttattgtgaagaatctgctaagttttagagcccatcaacttatcatgtagtgacaaaccaattatctgctgatgactgtaggaaatatctactctaaagggggaaaatgtaattggcaatctttgggagatttcacgacaatcaaaataattgtgaactatctttttaaccaaggcacattttttgtttgtttatagttatttattccaacatttttctgattataaagtagtatgtatttatggttaagaatttgaatgcagaaacaaaaattacctagatcttaccatgctaatattttaattatatatcctaacaaggcatggtgatggtgatgagggtggcaaccaagatttctggacatactgaattggtgatgcctattagacatacaggtagtaatttgagtatgcagttggctatatgagtatgaaattcaagagagaagtcaagattggaccaaatacgaatatgagagtgttcagcaagtcagtgaagtgatcgtgtctccattgtgggtccagatgggttcacctagggagtgtgtgcaaagaagaaaccagaggattgtggtatcctggaagccaagtgaagacaaggtttcaggaaaggaatgatcaacttgttaactattgctgagatgctgtgtaagaagactgaacatttgccatttggtgatgtggaagctgttgagcttcactaaatggtttccacggagtggaggggaaaaggcttgtttgagtggcctcaaatgaaattgggaagagagggaagagacagtgtgagtataaatggttccttttggaaattcagtacaggagagcaaagaattatagatcgaggggtataaggagggtcaataaattttaagagaggatccattattcatcagttccattaaaggcaaatgcaaaattttattatgtgcgtggttttctggtggaagttcaatagatttcatcagattctgtaaggcagagaaccagtgctctagtgatttggcagttcaacagctcatttttctggaggatacccttaaaattttaactgatttaaattaatattcaccagtattaaatagtatgtgtaacatcgtacccaaacaagatgtctttctgtatttttttctttccttctcttagttttgttaaaatctttttagttcagaatattctctatcaaatgccttttctatttgaagactctcctaaaaagttatattaatacttgcaaccaagtgatcaaccatttacatttaactaaattttgctacttttgtttactatctatttaaacattttaagtttgtgtttttagtcaaagtaatacttgttggtttttgtttgtttgtttttttaagtacagagaacaaccttatctgctgcacctcaccccctaattctgcttcagagttatgtgcaatgtttactggtttctgctatttaatttttttggtggatacctctgtctaaaatgtttacacctcagtttatttatcaacctaagatattatctgttgacttggtattactgtgggtgatgatttcgtttactctactatccccccacatgtatttgtaatcttattattccacttctactgttgatcacctctgcaactccagctctaaacactttttttctatttctttttcttgtctcattaatctgaggcagtgccttttgactctgcacattgtaagttgtatggaaataccattcccattcttcctgattctgtctcccagcctgctttattttgtcaaggttaataatatttacattctatgctatagttataattaagtctctcattatttgtctattctaaaagttgaaaaaagtcacagagatgtaaagtgacatgcttaactgacagtggagtcctcaagttataaagtgctattaatcttttgtgctgtccacccataggtatccctagagcagcgctagctgctgtttggcagtttctggagaagtctttatgtccttacttgtgctccctgataacaactctgtcctcatcttcagcccctgattgtgggattttaggggtatctgagatgtaagcatttagaaagtggtgtagacaaaccgtggaagaggctgagttgggaaattttacgtgttgggggaattttcattctttgcttttttcccctcccctctttcttgtgggagccttaactgggatagtaacaattgcacccgcctctctgcccattagttgctcatcttagaaaatctacagttaacatatttagtggcgaaatacttaacactttccttatatgggaatgagatgaggatacccactgtcaccactctcactattcggtcattgcaataagggaagaaaaagaaataagcataaagacgggaaagaagtaaaatggtctctgtttgcagatgacatgattgtgtgcatagaaaatcctatggaatccacaaacagctatccgaactagtaagcaaattaaggttgcagaattcacggttgatatttaaaacgataattttgtttttacacaatagcaacaaaacaaaacaaaagagaaaatgaagtttaaaaaaaccaactctgtatgcagtaactataaacattaaatgctgaggaatatagcaaaagcttcacaagccctctactaaaaagatcataataatgctgagataaagaatgcctaagtaaatgaagagagatgccatattcatatactggaggactcagttttttagatgttggttctccccaaatagatctatattttcattgcattcctaatcagaattcaactagctcttacagtagaatttaataagaattaaaaagcccagaagaattagacatttcacaaaagaaggtatacaaatggctaataagcacatgtaaggaggctcaacatccattacttatcaagaaatgcaaagtaaaaccacagtgagataccaccatacatatcaggataggcaggattaaaaagatgacagtaccaagggttaatgagaatgtagagcacggctgtccaaccttttggcttccttgggctgcattggaagaattgtcttgggccacaaataaaatacactaacactaacgatagctgacaagctaggaaaaaaaaaaggtccatgcatgattttcatgctatctgccaccgccgatgaaacaaaacagtcctcacgttcaaagggatggacacgtcttacgtagagcattctaattaattgccatacattggaattgtcatacactgctggtagcaagataaaatgatacagtcactttggaaaactattcagtaatttctaaaaagttaggcatgtgcctataatatgacccagctcttctactcctaggtgtttacccaagaaaagtgatacacgaaatatatgtccatgcaaatgttcatcaaagctttattacaataatcccaaattcagaacaatgcaagggtacatctttattatagtagtccatcagagtcaaatggataaacaaattgtggcatatccatgtaatggagtgttattttgtaatacaaaggaacatctgatgtatgcaacaacatgaatgaacctcagaaacattaagaagtaatgtttctgagtaatgaaagaaacccgaagtaagagtacataatatgtgattctatttgtataaaaagaaaatgcacattaatccatagtgacataaagcaaattattggttacctggaatcaggcacagggaagggtacatgtcaatgcccttggaggaaggggcgtgtgaaattttgaggactgatggaaattttgtcttggttggggggggtggtggtggttttatgcacatatacagttgttaaaggtcattgtattgcatgctttaaatagatatggtttattctatataaatcatacctcaaagttgcttaacaaatagtgactgacaaaggcatgacagaaaatatgtattcagtaaaaaagctttattgatgtggaccaattctagttactagttcacattttcatagcagataacaatcctattcagaatcaagtagcagccaaatatgttaagcaaataaaagacttcattgtttcttaagctctttgtagtaagaaggtataacagtggaatctgttagtcttgttttggttctggagcttggatttcctgtgttccttctcatctttgttccagtatttacttccaagctcttctaagcttatgacctggaattatcaaagttggttttcatcatttgggaagtaaaacaccatttatttttgagctttgaggagtctataactttaacaaacttccctaacagttcacagtcttctcctctaagcttaactttagtttcataatttcgaatatggatttagacccagcaactataacaaaaggtccatgacttaactatatagtttttaatgttaggaaaagtaaatgaaaaatcttgcctgtatgggacctcacatgatgttgtaataatcatgagctgcaaaaattgtagtgattccctcccaccccatttttaaaaaagcggtggcatctttagttatataacagttctaatgtaaattaccaggttatttactcctctaacaatgtcatcatttttggtgttgctgtaagctcctctgctacttaccttagttcaaacttttttttttgtttcccattttcattcagccttttcaaaatatatttgtcagtgtaccttatccaataatacttaaggattttcttaaggctgagagaaataactttagaaaatgtgactatcaaatacagatgtttaaacagttatgatatttaagcctgtaaacggttaaagaaaataacagcttggtcatggagttactcttccaggctctcctggcaggtgagtcgggtcttaggaccttgggaagaatgttgtcttaaattactgtcctgaattaagtttccacagactttctgatgttaagtttttttcagaattacagaatgatgaaaagccatgtctttagaatttttcttatgggaatctccaccttaaatttaaaatcatttttaaaataaaggcccttaaaggagagttaagggtgtagacacaggatactgttggatctttgccatccacttgaaaaattgaatgtaaggttcacctaatttcagaagaacactcaaactttgggtatcttaggtgtattgtaacaggaactgactggcttaggggagtttgaagcttgggcttagggaggttagctttcttagcttagggagctcagaaagatgtcatagtagaggaatttccctgtcttctgagccattgaataccctgccctgaaattgagtgaggtgaaagtaattgacaggttgatgaaggtgatgttaggcagaaacagtgaggaggcaaaggtggaaattccaaatagccactagaaatgcgagaaggcaggttttgaggaatggactgggctgcagatcagggcactgcttttataaaaaggctggcacttgcccatatgcaccgttcctgatgtccactggccaccacttgtggccaaccacacacacacacacccttgactaacagaactatttgtgaaataattgttctcattaattgaatattatggttaaatgaaaattgaccaggaaagtagtttttgtttgaagacttacttcaaataaatacctttccagatgtccacattcctgtgtaaattgattataatgatcattattatcttttttacttgaggcatcattctcattttgaacatatctaggttatgttcttgaagggacagtcttttatttgtgttttcttggcacttaatgcatcatatggcccagctaacacttgtaggaagaacatttgtcatttttcaatgaagataaaaaatgtatggtagcctttttttaaaaaaaaaaatttgaggtgttatttattgtacccttctacattgagaattaaaacacaacatataatctattgaaacttgaggtagataaaattctagctctttttcacacatggaactttatacaaagttatcttctgactttctgttagatgaaatattgtagacctggttccatgatcacatgttcaccttaggtttttaagagttttttttcctttaaataaattatataatgtgataaagccacagcatcttgttttctgtatgattttgaaagcaaaaatgtcaagtagtaactatatcaaaacttaaattatgtgcattcagcagagagcagaagttatttccaaattgaggtgtaggaagctttaaaatgcttattcatcctttatcagcactagtgaatgaattggcaatttcctaaggtcagcaaacttttattttgaatgataacaatagtattatttctaagaatatagaaaaatgcaggcgtaacacaggagtccaaatttagtattaagttaatagaattttagattctggaaggctggagtgtttttaggtttgagaaatgttagaaggtgcatgatggatgttagaggacatgaaggtgccgttcttgtctgatgtagttgttacgtagttattgggtaaaaatggattgctgaccacttagatggtttccaggattaggagaaatgattttcagaacacttctgtagtgcctcatgctaatgaaagcaaaaggcaaggtgttttcatgactgtaggtcatatatattggccatgtttatagttgccagtccttgctcttttttggcctgttgttgcaggtatgtctttgacttccagagggatgagctggcctcttttttgtccctcaagtcgctggaaaagctgtccaagaaattttctctgaatgcttggctcagtggcattgttccacatatgttggaataggtgactaggctgtgtttggaagaagatctagattggggtccccaacctccgggttgcacagcaggaggtgagtggctgtccagtgagcattactgcttgagctccacctcctgtcagatcagcagtagcattagattctcacaggagtgtgaaccctatggtaaactgtgcatgcaagggatataggttgcgcagtccttatgagactctaatgcctgatggtctgaaacagtttcatcctaaaaccattgcacccgcccatgtggggaaaatttgtcttccatgaaacccatccctggtgccaaaaagttggagactgctgatctagatgatctctgttttgtttctgtattaaaaataagaaattactaattcagcagcatgtacctgtgttggaccaggtccaacaggtatgcttgggttatggcagggaacaaatcagacaaagttgtgacatttaaacagagaactaaaaggtgaggcattagctggctgaagagtagaagtccagatagtggccacagtgtatgtggaggccctgaaatcagtaggagcttggggcctgtggagcaggaaggaagagacagtgaggctagagaatagcaagaaaggggggcaatggcttgagataagtctggattaatggatggaaaacccaactacataggacttgaggacgtgttaaggattttgaagtgatatgccatttatttggaagatgacgtagggtttttgttaggaagagaatacattggagggggtcaagaggggctttaggggtataaggcttttgttaatattatcaccactaataacagctaatattatttgttgctgtagaccaagcactgtgctgtgaacccttttcccacatcatctcatataaacttcagaacatctcagcgaggtggtgttttctctactttatagatgagggaaccgagacagtgaggttaagcaacttggccaaggtcatatagctagtagtggcagagctgggatttgaacccagacagtgtaagattgtaaattctgagactctaaatcctgtggtgtttgccactgggcctgtatttttcattgcgtaggtgatgcgcctatgtgggtcttgaaattgagtggatcgcaactgggatttaaaaaaaaaattgaatggagtagaaagtatcagactacttgcaagtaataagcataaatattgatatgtgaaactttattttatgtaagtaaacttgtacatttgtgagcttgtgagctgttatagaaggttaaacagcatttttccaggcaggagctgatgatggcttggattagagttgtgctgatgccgatggagagaggtggaccccagtgctaagaggcagaggcagcaggactcagtaagagattggatagaggtgcccagctgaggaaggaatgaggagtgagtcccagatttcttgtatgaacagcatcagtcatggtgcatgctgtgctcaatccacttgaagggagactgatccttcttagaggggtcctcctggatggctgttttactacctgaatttctagtttctctcagctgcagctgacaggacttggggttggcatctcgcccaggggcagcaaatctgtaagctagctctcaacccatgagatgatgtgttactgaaaactgcctaaacagatgttgagccaataattaattctctggaatttgaggtgagtagtcagccagctggtggcaggatgagaagcggtgggccacagatgtatgtagttgactactagcagctctagggtgaaggtgtaggaattatttgtgtggagtcaccttgagattcaaagaacctttagatttccgtttctaaggcccagagtcattctctttctgaagctcaggtccaattttttttttcttgctctctctgcggtccatatctgtattctcaagcataaccttttagtcatatccagctccccacattgctgcagtgaatctccatactgtgcgttcagctagtactaactggagacagaatgatggagtagttaaaaaaaatgtctggtggcaattctccatctttgtcttattggtcttttgatgttggccaagatacttcttactgagccttggtttccacatctgtaaaattgggatgatagaggagcatcacagggctgttttgaggcataaacgagagaaactctatctagcacttagctcagtgcctggtgaagaattacagcttaataatcttgccattgatagttaacatctttaggatagtctctggagagacttaaacgtgttcattaacaaacattatgggaaggagccagcatagagggagaggttggatatctatgagacagggtcttaagagaaggtattggatcccagagaagcaggcatggcacgggattaagagaatacattacagattgttttcaacagaagagggaacctgatggaggtggtaggaggactgttttttctgaggttgggtcccagtcatggtgatttgctaggagagatgctgatatcaggaggagaaaagtggcaaggtggaaagctattatagagaacaggagacagggacataccagaaaactggtgaacagtaccaagagcctgcgactgcacattgtaaatttataatgacaccagtctgtgtatttctacagtgttttctggcagtgctgtgttcaaaagaatgatgagctatagaagtaagattagtatagttttgaagggtgtgcatcctagataccaggaaagaataaggaggctgggagcgtgggtacagggacatagtagggcaggtggtcagccatggagtccggcttggttgggagggcagtgtgctctgggcagggtatagtcttgaagaaagaagagggcagtggtctgtgtgtggtgccacccacaaaagatatataacttctttgattgatggttttccctgttattcttaacactaatttcttgtgttgataactgaagtattaagactaattgctaaaaataaatttatattctcgtatgggccaaaactggagttagttctagtgtttaattttgaagttaccagtgatttcgtgtggtatgctgaatcagtaaataagttgtgatccttaaccttgggactgaacttcagtagtccttatttctcctttcatttttgtttggagtgtgtagcaaatctgaaagcagtaccatttactcattcactgaccatttgaaggcttcccatgtgtcaggagaacagaagtgaatgacgcagggatgataccgtgaggcatcacacggataaaggccaataagctcctcacagtatcatcctttccggccgtagggtgctggaagacaatattagaacttctcttttaacctgttactttgaacttctgtgtttctcagaacatatatatcagaatagtagcacatgtctgaaaaatatagataagcatacacgtattgggggtattcttgtttttggcagtagtgtgtatgtgatcaaaaaatatttggaggctattatatgttagtatgtattttaaaaaaatataaaattataactttttcttagcattttgagaaaacctagtttctgcatgtaattaatgaggtagttttacttgcctgtatttgtagtgtgaagtaaatcttactgtataaaaagacttactaccaagatctggcttgacacatttcagtcattttcttcttggtgctggaggaactttaccttttgtagaacagtgtcccttgttataaaacactaaattcacttgccatctatcagatgttgaggaatggggtgtggagaatgtggaacagcacatgcctgttttactatcagtctcatcccaaggtgtgacctctggggaccttccttcttacctctctggctgtctctcctgccttctctctctctctcaactgtctcaaaacaataggattgggatgccaccagaaattccctgctcccatctgtttgctcagagtaggtggttactcagtgtgtaatgtctcactttcagagagccatgaaatccttggttcaaaaagttccctcacaccaagaatcttttccgtaaaattagttagaaaaactgctatcaagaacctattttaaatgaagtatattgaataaatgcctctaggttgttcctctggaggttttttattttcatttttgttttaatgagtatgtatcttagcctgtatttgacactgtcattttttaacaagatgttatttaagtgaaatcttgcatgtgtgtttgcaggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgagagatccatgtttttggcaattttaatctacttttacttaagttttttatggttcataatgttgaaaataaagcacagtctccttgtcaggtggctatggagcatttcccaggttctgtgcaaccccttttttttttttttttagtttttttaatgtaaaatcattaattttgaatgttggttaacattactgagcagttggatataacataacacccactgttatgttatttttgatgaaatgaccaaatcaggacacgcccagtggattgtaggcaattggaaaagtcatggttttgagagtctgtgctgtgtgacattctcttctaggggccctttccagtgatcagcaattgtagctatgtgtgttagtctgttctcgtggcgctaataaagacatacctgaaactgggtaatttttaaaggaaagaagtttaatcggctcacagttgcacatggctggggagacctcacaatcatggtggaagacgaaggaaaagcaaagggacttacgtggtggtgggcaagagagaacttgtgcagtgaagctcccccttataaaaccatcacatctcgtgagacttattcactatcaccagaatagcactggaaagacccgcccctgtgattcagtgacctcccattgggtccctcccatgacgtggcaattgtgggagctacaattcaagataagatttgggtggggacacagccaaaccatatcactaggtttagggttctgtaaaacgtccgttttcccaagacatctcctatgaaaaggaggcactccatgagtgttctgtctccccttctttcttgacttagtctttatgtattgattagaaaaaataaacagtgttgcgtcatttttatatagccttatttttacatacatctttttctctggtctgttgtggagctcaggctaacaaatatttgggtccttgttaatgtcctgcctttcagaggaattctcttttgggtggggatgtgctggctgtgctgactcctagcagcatcccttgctttagttagtaactgctactagcagagtatcaaggctgtggcattgggacacaaatagaagttaggaggaatatggagaaagaatgtagaaatcatttgagtatgacaggtctatgtgggatattcccagttggatacggttggataaactgtaaactaagtctacagtttagcttgttgctgtccatgcctacttctgtgaaactgcagctacggttttgggaacaggttgtctgttagttttgtagcagaggtcagagtcaatggtgcaatatcaagaaaatggtaaaaaaggccaacctatgaactagccattgttttaaaaaaagaacaacacattttataatggagatgtattaactatggttcatattttcaaattattgaatgagactttacaagtaaagcaaagtttgattcgtggatttaggaggaaaggtatgtgcatacatgcatgtgtgtatgcattcattcattctttctaatgtgtaaatcataagttttcaaatatttgaagtgtttcattatagtgacaatgtcaaaataccttataactcactatcctaaagacctttttagattattttaacatatttaaaaattttaattgaaatttttatcgagtgtattagggttctccagagggacagaactaataggatatatgtatgtatgaaggggcgtttgttaaggagaattggctcacatgttcacaaggtgaaggcccattataggccacctgcaagctgaggaggaaggaagctagtagtggcccagtccgagtccaaaggcctcaaaagtagggaagccaacactgtagagccttcagtctgtggccaaaggcccaagagccctcggcaaaccgctggtgtaagtctgagagtccaaaggccaaagaacctggcgtctgatgtcaagggcaggaggcatccagcaggggagaaagatgaaagctggaagactcagcaagtcacctatcccacctttttcctcctgttttgttccagcctcgctggcagctgagtggatggtgcccacccatattgagggtgggtcttcctctcccagtccactgactcaaatgttagtcttctctagcaacgccctcactgacacacccagaaacaagactttacagccttcaatccaatcaagttgacatttaatattaactgtcacactgatgttttcatgtacagatgtaagaaacaatgcagagttccttttcactttgtccagtgtccgccattgataacattttgcaaaattgtagtatagtattacaaccaggatattgatacaatctcccatagcgttcagattgccacaattttgcttgtactagcatgtgtgtgtgcgggttaagttctatataattttatcccctgcgaaggtttgtgtatccaccaccatagttaagataacagccgggcccagtggctcatgcctgtaatcccagcactttgggagggcgaggcaggcagatcacctgaggtcaggagttcgagaccagcctggccaacatggtgaaaccacatctctactaaaaatacaaaaattagccaggcgtggtggcgggcacctgtaatcccagctactcgggagactgaggcaggagaatcacttgcagtgagccaagatcgtgccgctgcactctagcctgggtgacagagagagactctgcctcaaaaaaaaaaaaaaaaaaaaaggaactgaacttgccaacacaaagatcccttgtgttgtccttttataaccacagacatctcctgcctacactccatgccctcatccccttgcccccttcctccgtgcctaatccatggcaaccactaatctttcttccttttctaaagttttgtcattctaaaaatgttatataaatggaattatgcagtatattacctcttaggattgatgttgtttgacttagctgagattatccagcttgtgtgtatcagcaatttattcctttttattgctgagtaatattctgtagtatggatgtaccttgtgtgtgtgtgtgtgtgtgtgtgtgtgtgtgtgtgtgtgtgtgtagctttttacctattgaaggaaatcaggctaattctggtttttggctatcacaaataaaattgctgtaaacatttgtgtactggtttttgtgtgaacataaatttgcatttctctgggataaaagaccaggagtgcagttgctgggttatatggtagttgcatgtttagttttataagaaagtttttttcaaagtgtctgtaccattttacattcccactagcaatatgtgagtgatttagtttatcggcattctcattagcatttgatggtatcactgctttttattggagcctttaaaaagcctaaacatggtttagcatgtttatgtttttaagaagatcacagccgggcgcggtggctcacgcctgtaatcccagcactttgggaggcctaggcgagtggatcacgaggtcaggaaatagagaccatcctggctaacgtggtgaaacccccgtctctactaaaaatacagaaaaattagccgggcatggtggcaggcacctgtagtcccagctgctcgggaggctgaggcaggagaatggcgtgaacccgagaggcggagcttgcagtgagccgagatcgcgccactgcactccagcctgggcgacagagcgagactccgtcttagaaaaaaaaaaatcacaaatattaatattatcttgaccactcttataagaactcagtggtttcaaattaattttgtgcttttaatccaggatgatgccttctgtgtactggagttggttccatttgcctctcactttaagaggcaggtttaatgtaaatgtgcaagtttctacttaaaagttttgttacttcgagtccatgaatttttgctgaaacagtaccgaggcatgatttttataacttctcttagatcacttttaaaaatctgaatctttaaaacttttactgttaggaatttttgacagtaaagttaatagttaccagttagtatgcatttaccatggatcaagactttgtaactgctttacaaatactgttttatatcctttaaaattctgcttttgtagcttgtagcagttggagttgtttggaatacagtggccatgtggagctgggctagcagtagactcactatgtgtggcaggtagtgttcatcctgctctaattcatagatgattttttttttcactatcatgggaaaattgtggtaatgtcttacatctttaacttatgtgagtaaaccataattcatgtgcaattaagagaggactctataaaatagtgtgtggtccctgtgaaaagcatgcttttccaggatctttttcttttacatttcttagaagaatatgttttcttcaaattaaagtacatattttataattatcacaaataagttacatatctctctattcctcttctacttattttgtttttatgtactagacagctttcaaatgatgtgtttgtttttattttgtgtatcaacaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtgagcaggaatatgttcttaattcattgttttaataaccattaattgggatttactgtggatcagctccctttgcatcattagggatataatcaggttcagggagtggggaggaaactcatacaaaattaattgtaagactgtgtgatagggctgggcgcagtggcccacaactgttaattccagcactttgagaagccgaggtgtgggtggatcacctgaagtcagaagtttgagatcagcctggccaacatggcgaatctccgtctctacaaaaattagctgggtgtggtggtgggtgcctgtaatcccagctactcgagaggctgaggcaggagaagcgcttgaatgtgggaggcggaggttgcagtgagccaggtttgcaccactgcactccagcctaggagacagagcaagactgtctcaaaaaattttttaaaaacactgtgtgataaataccaaaagagagagatgaagtttgaaggacttctgttcattcgtttccagtagatatattaaccataaagtaggttcacacattggctgtgttcacacatcggccatttaattgtttaaatcaaatgccatgctgcaagacaaaaaagaataatgattctatgctcattatttgataactcctggaaaaatgcagcatatattcagtcttgctcattgccaacaagaacctctagacctgggacatgtccctgagcagtggtttaacagtgattagttgtaggaatgtgacttctagtggagtaaagtttattggatctagtttttcatggccattgatttttaaattttcctttggccatttcaactattgatgaatgtcttaatttagcatgagttacatgtagctggtatgatattaatcaaagcaagcttgatttgtatattctgtttgtatttgatagatcctttctgtaaaatattacttataagtccaataatgacaagggcctgttagttccttccaaaaatatattaattaaaatattttttcttttttttgtttttatattttatgattttttttgcctttcaatagttggcttttctctttataatcacaatttacattctttttaaaaattatttttctattttatccattgcattttttcccctttcttgggctttatttgttttttgtaagaatacttaacatgggatctacccttataacaaaattttaagtgtacgatacagtattgttaagtataagcacaatattgtacagcagatctctataacttattcttttatgactgaaacttaacccatccaattgcaattccccattttttccctctccctagcccctggcaaccaccattctactctctgtttctgtgagtttgactgttctgtctacttcgtataagtgaaatcatgttggatttactctcctctgtgtctggcttatttcacttagcatgatgcctcccaagttctccatattgtaggcaaatggcaggatttccttctttttatcaggctgaatggtattcctttgtgtatatacaccacgttttctttatccgttcatccatccatggacatttaggttgtttccatatcatggctattgtgaataatgcggtaacgaatatggcggggagtacagactgggcacagtggctcatgcctgtaatcccaacaccttgggaggctgaggtgggtagattgcctgagcccaggagtttgagatcagcttgggcaacatggtaaaaccccatctctacaaaaaatacaaaaattagccaggcatggtggcatgtgccagtagtcccagctacttaggaagctgaggtgagaggatcgcttgagcctaggaggttgaggctgcagtaagccatgattgtgccaccgtactcctgcatgacagagaccctgtctccaaaaaaatatgtgtagatcagtgcagatatccttttgagattgtatagaaattgggatagaggcctatgttttctttaatgtaaaataagttctctgaaaaacttagatgtataccttcatcttcctaggtttgactataattataaaatacagcaataattagtaatatttatttcatattctaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctggtaagtgtaaaagtttcttgttactatttaaattccaccactttcttttttgtcaaggaaatagtttttaaatttctaggtcagatataatgctcaattacttattttaatatgtatcaattaccattttatcatttttaccatgatatgctgtgatatgtaagtgctttttaaaaagaaggttttcaaattaagaatgactttactgtctacctaatcattagtggttgtgaatagattcaagaaattataaagcactttaggttctctgttttgtgtctatagaagttaatattccaggtgttcatttaaatgaactgtggacctgaataacttgttttggttgataccaaaaccagaccaaccaggatctttcatctaaggaaaaaaattctgatagatatggtgatatgaattgaaaatattaatatctaatgggatcctaagtgagaacaatgcttgcttttgaatcttttctttttcttttttgagatggagtcttgctttgtcgcccaggctggagtgcagtggtgcgatctcggctcactgcaagctctgcctgctgggttcatgccattctcctgcctcagcctccggagtagctgggactacaggcgcctgccactgcgcctggctaattttttttttaatttattttttgtatttttagtagagatggggtttcactgtgtgagccaggatggtctcgatctcctgacctcgtgatctgcctgtctcggcctcccaaagggatttcaggcatgagccaccgtgcctggcctgaatcttattttctattccagcatcaagacacaaattaactgaaaattgattagtttactcctctttcttttttccgttggtggaaggaagcattgtatgaaagaggacaactctgatagtacaggccagctaaagctaagatatggtaaaagatagcaaggaaacagcctagaagtagtaaaaacattgcttgaatattcaattttgtgtctattaattgttgaaagtttaaaagttgggattgtggcaagttttcaagcgtgaacattctagctatgaatggcaattaaacagcaacaatttagggaaaaaaattgtgcctccaggagaagttgaaaaataaaaaattattatttatatattgtacatatactttgtgtaaaaagataaaaaatcataactatattaaagagatgaagcataactaaataaaaaatagaggaactagatgttttacaaatagaggcatgagagatgttaaaaaaaaaaacaaaaaacccaaacaccgacatgatattgctgaatagttaaaattgttaaaaccaaggaggaaaagttttcaattctatagtacttagtacttttagagtgtgtatcagtaatacctttaataaacactggtgttctttcttattcagttttgaattaaacccttacctgcctttagaaggagtatagcattttgagcttcagtttttattctgtgctgcaatacagagatgctttttacactgttaggttatgcgaagctagtggaatgaaatctacataaaattgtactactgaagttcttagttatgcttcttagttctttttcttgctctttctcgtctgccagctataatttatagtagttcatagagtttatccagttttcttactcctctaaaaataaaaataaaagcgaaacaagactattctagtttatttcgtaactttattttataaatggatactaagcaaatatgtttgagagtagctattatcctttagaactactctatttcttggctcaagggttttatttttttgatacaaatcagacattggtttgctagattattgatattgctactaaatttcagatatctaggatgaagaagccttgctatctttgggctttcttctccctctgcctttccttcttagagaggtggcagatacagtggttaaaattgtgggctctcaatcagatgcttagtaactttgggcaggttaatttctctgtgacttggggttttcatcggaaaaataggataatactagttcctactttatagattaggtgcttatttgggggaattaattgagttaatccatctgaagaacttagaacaatgcctggcacgtagtaactactcaataaatactatgtattttttattattttccattttctactttttaaaaaattttatttggtttatttatttatttatttttagacggagtcttgctctgtcacccaggctggaatgcagtggcatgatctcggctcactgcaacttccgcttcccgggttcaagcgattctcctgtctctgtctcccgggttcaagcaattctcctgcctcagcctcctgagtagctgggattacaggcacgtgccaccacacccaactaattttttgtatttttagtggagaacaggggcttcaccgtgttagccaggatggtctcgatctcctgacctcgtgatccgcccgcctcagccttccaaagtgctgggattacaggtgtgagccattgcatccggtctccattttccctttcttaattgaccttcttcctaatgtctctgcctaaactgtaaactctgtgtttggtatattgcttctgtcatcatagtaaggttcctttcatatggtcagtgaataactactggttaattttcaatacaaagtaatattttgtttctcaacagtttttatgaaatccaaaatctgaatggtcagtatcctgtttaactattacattaatttggactctttggcttcaagaaacagacttttgattgaagaatgaatgaatgaatgaatgaatttgttgtagggagataggtacctctcatttagaagctagacaatggagccaggcctcataaataacagggaacagaagtggaagactcctgggaacccagggacttctctgtgcacccgcttcgctctctatccgagagtggctttgtgtgtcactaagtgcacatgggaagggtggctgtggcacaatgcctgaataatttcactctctccagggactaatccagtcagagactactgttttagtcagttctgaattcccaaggagagcatcttactggctgaattcactcaggtatcctcttctgtgactagcgagcaagaacaaaatagaagagtcaagaccctcctttctgggcaggcacagcagacatctgatagtgtctcctgcacctagataggcgccagtctgacttctaaaataaccccagagaagttgtgttggaatttttgtatcagagtgactcatttgtgtttcatcttccttgaagtctctactcagtccttcacactgctctcagttctagtgatttgtactggcaaactccagttgcagcgtgaggggtacattacaaatttctgtactgcgtagatgtctttctcagataaacataaacagaaaatatgctgcttattagctaatacgaataagaaagctggcccgtctagaaggaaaagaatttgacgtttaagatagttattatggtaagaagtttacttggaccctggttgttgggtgatgttatggatcttgtcttttgtaaacagaaaactaggagggttacagccagaggtttatacttagtagcatggagagttgagaaagaggaaggaatgtgaacagatatttgtgtatattttaatctcattgagatgttactttttgaaagtaacatggccaataaacaagcagtattcttagtctttatagtctaaagattataacaaacctatttaagggaaattgcttgtttaataattaaacagccatttgcacatagtgaatgactggttggctttaacatattaatagattcacagtatttattgctcaggtctaaaaatattcatgcagagggccctatattctagttagtttggtcttaggctattggctgtttgttttcctagaaagaaatcttggaactttttgcagttcgtcctgagggcaatggcataatagattctggatggatcagcatgtgataaaaaggggtttgattacaatagaataattattctaaaatgtttgcaaagtgggttagtattataattatgtataaaggaataaaggacacttttattaaagtctcagtgtgttgggacaaagggagatgtgagttagcatttagtaaataaggtatttctcaacaagaagttctgtcagagtctaatagaacctttgaagaaaaggtgtttatttatttggtggaaaaatggatggtattgactttagcatttattttgaattttatagtatgttagaggttaagcattaatttagcattgcttttattacaagaactgaatgcgcataatgcataagccagtaacatgactttggttttttttgttattttttttattttttttatttttttttttgaggcagagtctcgctcttttcgcccaggctggaggtcggtcttggctcactgtaagctccgcctcctaggttcacaccattcacctgcctcggcctcccgagtagctgggactacaggcgctggccaccatgcctgggtaatttttttatatttttagtagagacggggtttcactgtgttagccaggatggtcttgatctcctgacctcttgatccgcccgcctcggcctcccaaagtgctgggattataggcgtgagccactgcgctcggccgacttttaaaactaacaattataaagtctttggattcagcttctgttcagtgtttaacttatgaagctcttgtctatgtagctttctttacaaggtccaagtttattcttttctggaagattaattcagaagttagaaaatatacatatctctgataaccattttaacctcagaggtaccctgaaatgaagggagcctcgctttttgcagaaaaatatttaccaaaatgtatttcttttagaaagtatcaaatattgttttcgatatcaacttgtaagtgatcagcaatcagaatattcacaaacacttgcgctcagggttgaggtgttcagacaccattttatttcattacttttgtccattatgatggcacagaagtaaaacgacctcatccgtccttagtgatttgcattttgtggtgaagattatattttattaaaaataaacctgtcctattcacaactagtcacaatttactggctgctcaaccaaagcgcaccccagtggcccttccggaacctgccctctgtcattccgtgttgtcgttgagcagcatttcttgaaatgtggtgtgtgtcccattggcatcatagttatcttggggtgccccttaaggtggacatttcttagtctataccagagctgttgttaaggccctggaccttgcatttgatacaagtccaagataaatgtcatgtacgttttaaattctgagaactcactgcatgatagcactgaggtcagacggaggctttggagacaaatgactggaaagcctgcctggccactgggtagctttgtggtctggggcaattgcttaacctccagtacccacattcccccgttactaatgtgggataagagtaacagccacagcggggttgatgcaaggatctgatgagatcagggatgaaaagctgtttgtactgcccagcacgtgttcagggctcaatatgtattagttgtactttaaataaaagtggttctctattcttcctataagtatttgctggtgaccctacatgttaaatgttgtgcttggtaccaggatgtcagaaatgagtaagacagaatcctcacttacttacagtctcatagggagtcaagttcaagtgtgttcattttttcttgagcttcatgtcagcaccccccaccccattctaaaaatttcaagctttcagaaaagttaaatgaatgggtaccataagcaaccatatactctgcatgtagattctttgatttttgacattttgccacatttgctttatttctctatcttgatctttccgcctttgtctctccacctcagatcatctgtctatacctgttggtttgtcagtctttgcacctctatctccgtctatccatcttggtccttttttaaccccacttggttgatcttggtctctcaccccttggtgtcactgttgttcctgtcctgctgtcttgctggctgtcattcctcactctggctctcttcctctccttttattttctgaattgtttgaaagctaccatattatgacacttcatccttaaatgtttaaacatgcatcttctaaaaagaggcattcttagatatgactaatacctttattatgcctgagaatttcaacacatcctaaatattatatctagtttttattcaaattactctgattttcccatctttcatagatgcttttttttcaaacgaggatacagtcatcgtataatgcatttgattaaacctgtttagtctcttaatctagaacaagtactctcattgttttaatgacaataactttttgaagtatccaggctggatttctcataaatgtcttactttaagttatttgtctgattgcttccccatggctttaagtcatttctccatccctttacttcccgtaaactggaaatgtttgagttgaggagactgagtttaaacattcactggtgttgtcctttatattgtgtcgcctagggaggcaggaggtccagtgtcagtattgtcgtacctgggtagctgggaagtgccagattgctccattttcaaagtaatattttttcaacctgtgttgcttagttatctatgatgtgttacttgggcactttataattatcccgttccccaatactcctgcatcctttagaatatgttgatgaccttcactgtgattaccatgattacaaaatcatgatttttctaaatctttcattctatttacattattttagttggtattcctgattaaaaaggattgttcttcctttctttctcttttatttttttatttttttttgaaacagagtctcactctgttgcctaggctggagtgtggagtgcagtggcgtgatctcagctcactgcaacctctacctcccaggttcatgtgattctcctgcctcagcctcccgaatagctaggactacaggtgcccaccaccacacctagctaatttttgtatttttagaagtgatgggttttcatcgtgttggccagcctggtctcgaacacctgacttcaagtgatctgctttcctcagcctcccaaagtgctgggattacagacatgagccaccatgcctggccttttcttgttttctcttttccctccctcccactctttggaatcacagtggactcatggattaattttttctgattcaatttgttaggataagtaatagtcattattctttttgatgttgacatttttcaaatttggcctgggagagcccgttcaagccagctcctgtcctgttgacataaccatctagcacttgccatggtctcactttttaacctctattgtttcaagatttggaatcacccatttctttaaaactcctggtttcttctagcagttatattggactttggaaagcctacctgctgctggagtattattccttctgggcctttttcagtggacagagctaggaaatatatgcatctgtgtataaaataaagttcattatatcatgaattcatatatatcaggcttcagtaaatgaaagtaaaaagtacattagaaatcctgagtttatgtagtatttccagtccaaatttagcagtatagagcttttgtcttcacttctgtgtttatgtttaatctctcatcatttacaggaaaaattttggctccaattacattagtgtattgtttcctttataatatacagtaagttctcacttaacatgaaatgatggataatgaaaccagtttttttcctcatcaactttataatgaaaggatgttgtaaaaatgagaacacttggacacagggtggggaacatcacacaccggggcctgtcgtcgggtgggggagtggggagggatagcattaggagatatacctaatgtgccgggtgcggtggctcaggagttcgaggctagcctggccaacatggtggtgcaaacctgtaatcccagctactcgggaggctgaggcaggagaatcgcttgaacctgggaggtggaggttgcggtgagctgagatcatgccattgcactccagcctgggctacaagagcgaaactccgtcttaaaacaaaaacaaaaacaaaaacaaaaacaaaaaaaacgagttaatgggtgcagcacactaacatggcacatgtatacatatgtaacaaacctgcacgttgtgcacatgtaccctagaacttaaagtataatataaataaacaataaaataaaaaagaaaggatgtggaacaaaatgtttattgaggacctggtgtgcgttgtttctcttaaagtcagtttccaaaaacctgtcgatgattttaagtgagggcacactgtataaaaagtaagaaaattagacaatcagtattactattaacagtaaacaaattgagcagaatttgagatttatttgcttttttatgcttaaatatttcccagtgtgaagctttaaagttatttgaaatatttgtgttaccaatttggcatacaattaatttttttttctatttatattactgggatttactctacattttttgagacagggtttcactctgtcacccaggctagagtgcagtggcacagtcatgactcactgcagccttgacttcttgggatcaagcaaatcctctcatatcagccttctgagtagccaggactacaggtgcgcaccaccatgcccgggtaatttttttgtgaaggtgaggtttcgctgtgttgcccaggctcctctcaaaactcctgggctcaatcgatcctcctgccttggcctcccaaagtgctgagattttaggcatgagccaccatgcctggcctacatttttaatttgttttattttgaatgtaaaacgtttatatggttcaaacattaaaactatattttaaaaaatatatactccaaatcttgatctcatcttctccttataccctattcatagctacttcctataggtaaccattttcattagtttctggatttttttttccctgtgtttcttttctaaaaatgtgttaacattttatgtctactcttattatccatcctgctgcatggaagtattttatatacatttttctgtactttttaaacttaagaattgatttataggaaatattttttcttagttcagagaggttgtcattcgttttccagctccatagtactcagtagtgactgtaatacagttcaaaccagtcttctgtgggtggacagttgggatcctgcagtgaataactgtatactgtttcatgtttaaggagctgtgtctctaggacacattcctagaagtgggattgttggatcaagggtaaatacatacataattttattagatattaacagattcccctccttaggaattgtcatatttggccttccagcagcagtatatgtgtgtgtgtctgtccacaccctcagtcaagatttgttgtcagcttttgggttttttccagtctgatagtgagataccatgatatctcgtggtagcttttatttttatcttatgagtgaaaatgagcatttttgcttatatttctcagtgccatttgcagatttctctgaactgccgttcagaggttttacttactaaggaactattagtgaccattttctaacagtgagtactctttaccctatcataaaattgtcacttgtacttttggtgccaaattcttctatatctttattgggtgagttatatttatgatctttaaaaaaattatatttgaataaatattgtgcactagctattcaaaataaggatttagatgcaaaggtttttttttttttttttttttgagacagagtcttgctctgtcacccaggctggagtgcagcggcacaatctcggctcaccgcaacctccgtctcccaggctcaagtgattcccctgcctcagcctgcccttttagctaggtttacaggtgtgtgccaccatgcccagctaatttttttgtatttttattagagacagggtttcaccatgttggctaagctggtctcgaactcctgacctcacatgacccgcccacctcagcctcccaaagtgctgggattacaggcgtgagccactgtgcccagcctgtaaagattttttgttggtataaaatccagaatggtaccagaatgccaattttattcctttttaagaaatagctctaattaaaggtgcagcacttcaaacgtgatttatacagttgtttttataggaaaatggaaatatattgtagggataggtagcaggacactaatagtgagtcccactcatgactgtaagtagtgactttgggaggtatcttaaatactgatgtcattaagtaattaacttgaattacttgtattttacttttagttattaagctgactgctattatagtaaatatgtgtcttaaacttagagtgaaatggaaactgcttagaagcttagctgtgtaggagttaaagtgcaggggaacagatgggaacatttaatttatagaaataattctggtggagttctagggctgtgcctatttgttttagttgttgtgaagaagcaagccatcttgtatacttaaagaatgatgtcatccctaatttagtggggtgggaggagtgagagtatttaaagatcatgtggatattaagatacagaagtcataaaatatttgtaatcttcatagtatctgtaggttaagtagtggttctaatttctgggaggaagctcaagtactccttattttgttgaaccatatttaatttaaaagaccaaccagcagttgaaaattttctattgctgtttagaatagattcatcccaactttggtagaggagtccatggctgaatattgccatgagtgaagaaagattctttctcactttcttctggaagctttgttttcatcctcctttggattggcttctgagagaccataaaaagaaatgggtgttgattgcatttaatggttcctactgtgaacaagcagtaggtaccgttcttgccctttcagtatctgcagactcattttatcagaagagtgcaactgataaactttgcataagagaaaatgtactggccaaacattgattttgcttacatacacatacttaacacgcacattcttgacctacatctatttaaaaaaaaaaaaaaaaagaacttgtatataaaaatctgaacagattggagaatactttgccatataaaaatttagtattttgtatttattgtatattttctcaaaatattacaaggctttaaaatattttagaaataacaataattggattcatacataattttatagtaatacttttgtataaaaccataacaatacttttgtataaagcaaaattcgttttacccttttagtgacttttatgtcataaaagactaaaggatggcacttatagattagcactatgaactaacttgtctcaaggttaactggcagcctcaactctccagaacctgtcaatgaacagaaagcaaacagaacaacactgacttgttgagagttgtgataaatttcataagaaaaacgtttgactttctagcaagtgtttatttactcttttcttataaataccttgattatttggtttcctggctcataatagattagaagcaataagatgttagaacaagaaggatgaaatgggatgataatagaaaagacatgctgtcagcagtgataagtgacatggacaggaaggcaggaaccagaaaaacttttgaaaaattctgtggtagactttcttataggggtaatatcttaaaattataataataacaaaaatggtaattagcaagcacaaaattacccccccgaattcttcacactttagtaactcacccaccggctgtctctaggcatcttaaattcagtcccatcccttcagtgggtttgatgttgcttaaatcaagagaggtgttgtgtggattacatagctgagattgcatgttggaaaacatttagcacaatatctgtcagagaatctgctcaacaaatgctggtcattagttgaatcttgcaatgctttgagtctcagtaattaagttatgctaactgtacttttactttttttcttgtatcccatccaaaatgccatccatacctgttatgtacagtctgtaaatccagaaagctccaaaaaccgtatgtttgtcacaaactcttttgaccgaaaaactgccccaaattgacattagactacatagtctttatcctactttcttcattatttgctattttaatgtttacctagaaatgtaaagatagttgatagggaagtgctgccccaggcctgctagagaaattatgtgtgcacccatactgtctttccaaaacctgaaaaatgctttgtgccaaaatacatctgccccaagagttttgggtgggagattctgggcctttagtatttaatgtataattgaatggaattgaaaggataaactccatgtgatcttacttgatgagaagcccctgtatattatttgatcgccttggaaatgttgattgagctaataaacacaagccattgtgttctctttccccacttcacagcaaagtgaaaaggagagcttgttgaaggaaagagatcacattttgtcaactctgggtgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccataagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacacccaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgttcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtagaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaa

SEQ ID NO: 425 - DNA, 89481 bp, Homo sapiens
  source 1..89481: mol_type = genomic DNA
caaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaaggtaggctttctgctggtcagcctgcagttggcacgtggccacggaggtcaccgttgggcaggtcatagcttgaggctgtgacgacgggggtgggaaagggtctgctgaccttgggggctcctgcccaaccatacctttgggagaacagaactggggagggtgatgcgtgtctcgtcttctgtgggttgcatgaccatttcccatggttggtctgattgggaaatcaccgggttaactcaaaaatgttgcgctagagtcctggaaatctgttacccgtgcttaccttgttgcataatgatttcacatcctttatccgattgggagggcctgggcctgggctagctttccccaaagccctggatacaaagacacaagtatgttgaaagcacatggcatcttgcagtccccttgccaggcaggcaggagggtggctgccctttttccgatggtgcaagatccaggtccccagatccccagcctccacgttttccaccacaccatgttgttcccaaggaaggtggtggtgctgtagaaactgtaaagtgcgcgcacattcaaaatggtcccaagaggaaatgatttcttagattcattcctccctcctgaatccccaccggagagtcttggcaaggtgcttctaatctttggctcagggtcgcgcaggcttccttccttcaagcaaatagtgtgaaagctcctcaaggagctcagatgtgtctccagggggctgggtgtgctctttcgaatgttggaagatctcagtgtgctgtctttaccttcagcaagaaagcctcagttcgtggattcctgaaaacatcaagaagaaagaatgcgtgtattttgtggaaagttccaaactgtctgatgctgggtaagtgacgtgatttgtgtgtaagacctctgacttcttccttccgatcccacatggagtagctgatcaggccaagacccctcagggcctcagtgaagggtcactggagatacctctgtctccatacgaggcttagagtccacagagcatttccacctaacccttgcaagcctcctgtcggggacagttgaccctcatcctgcctcgcaggtgcagggaccaaagtgcagagtttaggtgacttgttcagggtcataagggcactgtcgcgcggcgaggcccagtggtgtgaacacagatgcatcctctaatcctctcatttccacacctgcccccaccccaagagagagagtcccagggtccaggaactggaagggccttagggagagtccatggccagaagactgcccccctgcacagcttgccaaagccagaggcccgacttgcccccaggccccacagagccccctttgcccctcctccccacagagcccacgactcaggtgtggccaagacccccgcccaggcaacatggccactgtctctgagtggctggatatggccctccggagccgatggtgctccccgcagttggcgcccctttaggcacggacagagtgttgattcatgtttgtgtgccctccccgagcaacacccatttcatgctcttccacaaatgggccacacgcttcctccttttactccattgcctggtgagctcctacttatccctcaaggcctattgcagatgctgcctctgccgtgcagccttccgtgactatacaacctctaccaggaagtgagcttccctcctaccgcaccgtgtgtttctctttgatcccagctgtcgtgctgtaactgtgtggctttgtgttcatctttcttgctagctgctgagcttctggggggctgggacgaaagcagagtgttgtgttaattcccagagagtggccttcagctcatatttactgaatatggggagggagaagcatcctgtgcttgggaaatagaagaagactgtgttgccccagggtacctctagtgtactcggtacatcatcagagtttcacggtcaccaatacaacagctgtccctccgcatccctggggaattgttcccggacacccacggacaccaaaatcccatatctcgtatcagtcccaaaatctcatatcaagtcactgatatgagatggtgtggtatttgcatataaactatgtacatccttcagcatactttaaatcatctctagattacttataatacctgatacaatgtagatgttataaaaatagttatactgcatttaaaaaatttgtatttttgggccgggcgcggtggctcacgcctgtaatcccagcactttgggaggccgaggcaggtgatccacccgcctcggcctcccaaagtgctgggattacaggcgtgagccactgcatctggctatgttatttttaattgttttttttttcctgaatatttttagtctgcgtttggctgaatctgcagatgcaaaactcgcggccatggagggctggatgtagagacagtgatgaagagccccatgtggaaggagcggggtctgtagagcagtggtactccagcctcggagctcacccttgttactggaaaggggtcccgatccagaccccaagggcgggttcttggatctcacacgagaaagtatttggagcgagtccacagagtaaagtgaaagcaagttattaacaatgtaaaggaataaaagaatggcttctccataggcagagcagccctgagggctgctgcttggctattttttttttttttttttgagacggggtctcgctctgtcgcccaggctggagtgcaatggcatgatcttggctcgctgcaaccttcgtctcccaggttcatgcgattcaccatgttggccaggctggtctggaactcctgacctcaggtgatccaccagccttggcctcccaaagtgctgggatttcaggcataagccaccgtgcttggctggttggctatttttatggtagttttggatcatgtgcttaacaagggtggattattcatgagttttatgggaaaggagcggggatttcccagaactgatttcctctttctttcagaccatacagggtatttctgatgttgccatggcatctgccaactgtcatggtgctggtgggagtgtctcttacatgttaatatgttataattagcgtgtaatgggcagcgaggataaccagagcccactttcgtcgccatcttggttttggtgggttttacccagtgtcttgcaccctgttttatcagcagggtctttgtgacctgtgtcttctgctgacctcttgtctcatcctgtgacttagaatgccttaaccgtctgggaaggcagcccagcaggtttcagcctcatttcacccagcgcctattcaagatgggactcactctggtttgaacgccgctgacaccctgacctgctgtgtcctgagaagcctaggtgaggccccgtgggtctggggcctctgccagtcggctctgcgtgcttctcacatggaagtggaaacccttggggcagcagggcccagagaggaaggggtgctgacctggatcagatgtaagcaggacagacttgcttctggaggtccccaaagccatcccccatgctcaggggtttgctaggactcacagctgtgcacacagctaaggtttatcatggtgaaggcctacgtgatgggcttggcaagggagaaagacacaggccgagtctggagaatctgagggcaggctgctgcggctctcctgtgcaggcgccatgcatgctccttcctctagccgagaagcacgtggccacctgcaaagcccattcgaggctcagagcccagggcgtgcatcctgcgctggccacgtgggcccctctgcatggcaaccacccaaatcccagactcccagcaggaaagcagctgttcagcacaaacccattgcaggaacagtccaggcccggcaaagcactcctagcagtcaggggacggagagacgctccaaaagccccgttcccagacaccaccttgaaagcaggcccctctgagaaggcaacctgagatctgctgcaccgagtctgtcccgcacagaagccgctctcatctcaccaaccacggtggtcactgcagcaggatgggaagagggaccaggtgtgttcctggctgttccttcctgaggagtggatggaatgtccctccttcttgtggaaagaccagggcggaacgagtggtgagcatcgtctgccacaaacacagcttttcaagcagatttatttataccacttacatgtttccattaagcatggtagggtcttcctaccccactcgtccagacctggagcccctcgacacccgcccgggtaatcccactgcttagccccacgtcctggtaaccctcctcagctctgcacagactcgtctcatttccgtgtctgctgtggccaccctggtccagacctttgtgctcacattttgccaccatggatctcatgaccttgggcagatgacttctcttccctgggccaccaatcctcatctgtgagcgcagagactggaggggatgcctcagaattcacgcgcacatgcggtgggggtggggaggcagggagccccccttgggtggcaggaaggagcccaggttggagagaatacacctccaagagctctcatttcccgtggggtgccgggggtggtgtcccgtttacgcctatctgggccgagttccgagcgagctctccggcgatgtaatttctggatcagtgtccgcaatgcagtttccagcatcacatcaggcttgcaaacgccatgcaggttcaagttccaatctcatcagaggtgatcgttcaaggacaagagggacaggaggtagcttgtgataggctgttaggaacatacaaggacatttggggcagcattggagcaagacgggagagctcaggtccttgtctagggaactcctttccccacctccgacccaggtctctcatccataaacagtggaggtcacattgtgtccggagttggttccttcccgggggtcttggtctcgctgacttcaagagtgaagccggggaccttcgcggtgagtgtcacagctcttgaagatggcagggacccaaagagtgagcagcagcaagatatattgtgaagagcgaaagaacaaagactcctcagcgtgaaaggggacccgagcagtttgccgctgctggctggaggggtggccagcttttattcccttatttgtccccgcccgtgtcctgctgattggtccattttacagagcgctgattggtccattttacagagcactgcttggtccattttacagtgtgctgattggtccattttacagagcactgcttggtccattttacagtgtgctgattggtccattttacagagcatggcttggtccattttacagtgtgcggattggtccattttacagagcaccaattggtccattttatggtgtgctgattggcgcattttacaatcctcttgtaagacagaaaagttctccaagtccgcacccaacccagaagtctagctggcttcacctctcaacatcaggtgctcgcaagatccctgcaagtctgaagtgccttgagcgtgaccttaggggtttgtacggatttggatttgtagggtgcacatccgggaggaattattttttccattttaatgattgagaaactgagtgtagaaacatccgagatcacacagtcaatacgtggcggggaaacctgtttcctttctcactgctcagtggtctttcccctgtgccatctggttcaggtttcatctggttttagagtttttttgtttgtttttttttaattcccttatttgtccccgcccatgtcctgctgattggtccattttacagagcgctgattggtccattttacagagcactgattggtccatttttttcctgtctcatctgtgtatatatatacacatatatatgtatatatatatatattttttttgagacggagtcttgctctgtcacccaggctggagtgcaatggcctgatcttggctcactgcaacctccacctcccgggctcaagcgattctcctgcctcagcctcctgagtagcggggactacagctgtgcaccatcacacctggctaatttttgtatttttagtagagacagggtttcaccatattagccaggctggtctcgaactcttgatgttgtgacccgcccacctcagcctcccaaagtgctgggattacaggcatgaggcaccatgcccagcctcatctgaacttttctaggttatttgttaccagcaaaaaattggaatctaaaaatatggtggatttccaattaaacaagttacaaagaacacataaatttatctcttcttgccctgaaacaccaatgaattgcagtaaagcaaaaaaagacttcaacccacaaagaaaaaagagggaagttagcagttgaagaaagagattgccgcattcttgccagaggaaggggaggaggcagagtagcaggtcctgaaggctggcgactcgggcagctcctgccgtccccaggcgaggggaggaggtgggagaccttgggcgaggtgctagccccatgtcgtctgcttggagcctccatttgtgtgtgcttttaactttttattttgaaataattacagatgtacagaagttccaaagatactgcagaagggccccacggttccccctgtggctacattctgcataactgtagtacagtacccaagccaggaattaaagctggtagaatgcatgtgtttagttttatgtcttttttttttttttttgagatggagttttgctctgctgcccaggctggagtgcagtggcaccacaccagctcactgcaatctccgcctcctgggttcaagcaattctcctgcctcagcctcctgagtagctgggactacaggtgagcactaccacgcccagctaatgtttatatttttagtagagatggggtttcaccatgttggtcaggctggtctcggactcgggacctcaactgatctgcctgcctcggcctcccaaagtgctgggattacaggtgtgagccaccgctcttggccttatgtcatttttcacatgtgtatttgtgtaactaccaccgtggtcaagatacagcactgtccatctccaccgagctcttcctgtacttcctccgtatggtcagctcaccttctcccccatcatccctgatccctgcaaccaccagtctttcttcatgcctatcattgtgtcatttcaaggatgttacgtcaatggaatcatacgctacatgacccgtgtctttttccctcagcacagcgcacttgatatccatccaagttgctgcttgtgtcaatattattattattattatttttgatatggagtctcattctctggagtgcaatggcacgatctcagcttactgcaacctccgcctcccggcaactgggagtagctgggactacaggcatgcgccaccacgcctggctaatttttgtattttcagtagagacagggcttcaccatgttgtccaggatggctttgaactcctgacctcaaatgatccactcgccttggcctcccacagtgctgggattacaggtgtgagctaccacactcggcgttgtgtcaacattatttaactgctgaatattcctttccctttcgccttgcctgtgtcattacacttcaagtgagattttggtagacgtcaaataattgggtcctatttttttaaatacattctgtcaatctgttttttaattgtcatatttagaaaatttatatttagtgtaattattggtatgttagggcttatgtctgccattttattttttgttttctgtttgttctgtgttttttttttgccttcttgtgggttacttgaacattttttagaattctattttgattattcatactatttttgttttttggagacagagtctcactctgttgcccaggctggagtacagtggcacgatctcggctcattacaccctccacctcgctgggctcaggtgatcctcccacctcagtctcctgaatagctgggactacagacatgcaccaccatgcccggttaatttttgtatttttggtagagacaaggtttggccatgttggccaggctggtctcaagctcctgagctcaagcaatctgcccaccttggcctcccaaagtgttcggattacaggcgtgagccactgcttacaccatactatttttgagtgtatcttcttgtatcactttttcttaaaggggttgctctagatagtatattatataatacagcttatcacaatctgctgatgttgacattttaccagtttgagtgaaatatagaaacattatctcctttaacatctctgtccccttcttaatctataatataattgcttgaaatatttcttctacatatattgaaatgagggccgggcatggtggcttaagcctgtaatcccagcactttgggaagctgaggtgggcggatcacgaggtcaggagatggagaccatcctggctaacacggtgaaaccccgtctctactaaaaatacaaaaaaaaaaaaaaaaagccagatgtggtgatggccgcctgtggtcgcagctacttgggaggttgaggtgggagagtggcgtgaacctgggaggcggagcttgcagtgagcaaagatcggcgccactgcactctagcctgggtgacagagcgagattccatttcaagaaaaaaaaaaaagaaagaaagaaaaccatgtcagatagtgttataatttttgcttcagccatcaaacatcagttatgaaattcaaggggttactctttttgttattctttcttcctttcagatatttcaaaattccttttcttgtttcctttctgtttagagaatgtcctttagccattcttttagggtgtgtctgctcgtgacaaattccctagccttccttcaattaagaaggtccaaacttcctgtcttttctgaggtgttttttttgttttttttgaggagtctcccactgtctcccaggctggagtgcagtggcaccatctgggctcactgcaacttccatctcctgggttcaagcgagtctcctgcctcagcgtcccgagtggctggggttacaggctgctgccaccatgcccagctgattttttagattttagtagagacagggtttcaccatgttggccatgttggtctcgaactcctgaccttgtgatccacctgcctcagcttcccaaagggctgggattataggcgtgagccactgcgcctcgccgcttttaaaagtttttatttgtttttagtttttggaagtttaactgttgtgtgtcttggcatgtatctctttggatttatcctgtctggtgttcactcagattgtagcgtgtgtaggtttatgtcttttttgtcaaatatgggaaattttggccatgacttctttacatacattttcaggatcactgtctttttcttttccttctggaactctgagcatgaatgtatgatcttttgttatagtgctgcaggtcccagaggttttgtttacttgtgtattttttctttgttgttgtttgtttgttttctctctgttgttcttattgggcaatttctactgttatatcttcctgctcctgggttctttcctctgtctcctccatcctgctgttaggtccatcctttgagttttttatttcagttactgcatttttcagctctaaagtttgcatttggtatatcttctctttttttactggaaatttatattttttcatttgttttgagcatgttcatgattgcttgttgaagcatttctaatgtggctgctttaaaatcattttcagataattctaacatctgtgtcatcttggcgttggtggctgttagctgtcttttttcatcctggttgagattttcctgtctcttgttaaaactagtgatgtttgattgaaaccttgatagtttagattttatgttaagagactcaagatcttgagttttagctggtcctcttgacatgtctatggtgaaggaaggaggtccccccatcactgccccacaaagggtgaagtctaagcccccctgtagcctccactgatccactgacacttcctggggaggcttcttgttactgctgagggtgagaagagctccagcccaccattaggcctttgctgcctcccccatggctggaagggcaggtgctttgtttttgctgggtgggggaaggttgcggctttccactgggcctcctctgatgccttcacagggagcaggaagggcaccacactccctgggtgactggtgctgtgtctttgcaggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaaggttggtttccatcactctcgctctgaactgtaggtggagctgcatggccccacagtgacacgcggtggtcggcatttcctggggcaagagcaggaggctggcaaagctccagggtgcatagagcccactgcacagcaagggaagcggcggggaggggctctgcaaggcaagcaagacatgcaccccactctcagagtgcttggccatctgcaaagcagggtggggcacagtgagctttctaggaaggtgcaagctgggagtggtgagtgaattctggctgggtgtccttgggcggcatttgtcagggcctgggagggagtagggaggaaggagagggatgcaggacacagatgcgctcagggtgtgctgggagaatggtaggaagggtgtggggagggagggaaaagctgggggaaggggcccaggatagcagggaggcccatgtggcaagtctggaagcaaacgcgagagtccttgcgaggagtctgggccaggcatggcgggatccaggctgagcctggcctgcaggagagcgctgtgagggtgcagactgctggagggaggcccaggtgcagggttaggttctctcgtgcacaacctcactgaggtccctggaccagccatctctgaccaattctcaggccccatcccaggcctgtggagtcagaggctcagccccttgcatgttgaccagccttctggagggttctgagactcgcgtgttgaccagccttttggagggttctgagactcgcgtgttgaccagccttctggagggttctgagactcgcgtgttgaccagccttctggagggttctgagacttgtgtgttgaccagccttctggaggttctgagacttgcgtgttgaccagccttctggagggttctgagacttgcatgttgaccagccttctggagggttctgagacttgagtgttgaccagccttctggagggttctgagacagtgattgggtgccactgtcctggaggtggggagggtggcactgatctctgtgctggcgtctggagccctgaacttggtacctgtcgagtgtgacctgtccactcaatgcatggtgttgccatgaggtggccaaagaggttgagtggggcaggtcccggagacggggtcatgtggccccaggcttcctggctggcacagcccctgagccaccctgtgtcaccatgacacgtgggtgttctccaggcccctggacccctctgtcgctgtggtcacggggacagtcctgttgttgggtttcagatgagggattgaggtatggggaggccctacctaccctttgtctgatgccaccgtggccgtggcagtggtgggtttgaatccagctgtgtctgagcctggggtctggctgcatccctcccccaaccccccggcttctcccagccccctccctgcagctgccgacaggggccggtggtgtgagggagaaatgcctgtggcctgacagtgagggacgccagggacacagaccctgtactgcagcaggtctgcctcgaagcccgggagcgtccaccatgcaggccacagccctgctcctcccagggagaccagcacctccagatgcctggtggacccggtgggacccacgttctgatggtgacaggcactgtgcttgtgggttaactggaccttctttagtgacaatgccaccacatggttgttttgagggcacctaatggcatttctggatttcacccatcacctttgtgtctctgctaggccaatcccggcggagattgcagaccccgctgggtctcttcagacacagcccgcctagcggaacagggaaagtccgctgtgtacttgggagggtctcctggaggacggggggccagagtgacgacagaacctgggagagccgtgttcagacgggaggcagaggaagctgggcccactgagtccccaggacgggccagggcacaggggccacagagcagaggggatagggcagaggggacaggagaggggacaggagaggggacaggagaggggacaggagaggggacaggagagggggcagtgctgggtgcacaaggacagaagggcagagaccccggtgcaggagctgattagacccgggggaggcagggcccaggcgctacggcgggaattggagtctgtgctggcgcatgtttgggaggcgctcccaaaatcgagaggaagaggaaaaagtgggtcccgtgggggcacgagggctgggggaggtttgctgagggcgatcctggtccccaaaggatggcctgatgctcctggcttgggcctctctgcctccctcttctctcgtgatctgtgccctgcccacatggggaccccttttctgggtctgagccggaaaggtgtgcggtgtctgccgcccgctggggcctctctgcatggcctgtgtgggtcggtgctgtccctgaccactgacacacaggttccctccgccgttttccctttcccgcagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggtaactcggaggctggagggacacgaggccccggcgggtggggtgggctgtggaggcagtgctggggcaatcagggccatcaggacccaaaaagtccctgggagccgccgaggctgtgccccagcctgagtcggacccatgcacctctcacctgggcacagctgctccctgacgcccgatgctcccactggcttgcctgtgggctggagatggctcagtgcatggccctgctggtgcccagggccaagcagagatgagaaccttggtggcctgggaaccttggtggcctgagaaccttggtggcctgggaacctcggtggcctgagaaccttggtggcctgggaatcttggtggcctgagaacctcggtggcctgggtgcacggctggggccagcactgcaggccatttgtagggggtcagcgagagttcccagtcatcaagctttccattatcgtgtttttccatcaaaatcagggaaggagcattattatttccatctcttcacttaaggcaactgcctggttggagtcaaatcacctcccaaggttgcaccactggtgagagccaggcagggacccagtcctggtggatggtgtgagatcccaggtgccgtgacctggtgccccgccccaccctaattccatggggagggggccccaagtcctcaaggctccctgggcctccctggaggggactgtggatgaatagtgaggccctgaggtgactacttggcaatgttgcgtccggatgggcctagagtcaccctgctcttcctggggtctggggtctggtctttgcctcgcagtggagtcgtaactgagcctgacttggcctgcatggctcacagagtcctcagtttcattgtctgcctggtgagcgtgaggcacggctgcatcttttgacctgtgagtcccacagccctgcttgtaaaatgaccagaccttttctcagcctggtcacatgggactgggtttaacgcaggtcaccatcccacaggctctttctgaagctttgctgcctcaaataatgccatggatttgttcaggtctcacctgctccaggtcttgatgttgcatttttttagctttcaatatccgtgtccttgttgtccgcttcctggcccaaagccagtaccaccttttcaattgttatctttctatctatctatctccatccttccatccatccatctatttatttttgagacagggtctcagtctgttccccaggctggagtgcagtagcacgatctcagctcattgcagcctcgacctcttgggctcaggtgatactcctgcctccgcctcctgagttgctgggactagaggcgtatgccaccatgccaggctaatttttgtagagacaaggtctatgttgtccaggctggtcttgaactcctgggctcaagtaatcttcctgccttggcctcccaaagtgctgggataacaggcgtgagccaccatgcctggctgattggctgttttttttatttttttgttttttttttggagttggagtcttgctctgtcacccaggctggagtgcagtggtggtggcgctatctcagctcactgcaacctctgcctcctgagttcaagcaattctcctgcctcagcctcctgagtagctgggactgcaggcgtgtgctaccatgcctggctaatttttgtatttttagtagagacggggtttcaccatgttggccaggctggtctcgaactcctgacctcaggtgatctgcccgcctcggcctcccaaagtgctgggattacaggcgtgagccaccgtgcccggccggaggtgtgtttcttacaggggtggctgcaaaccaccagcagcagatggcaggtgggaggtgaggggcatccttcctagggaccaggctgagtgttgggagcgaggaagcactctgccgcacctgggtcctgaaagctgggaggaagagggaaagcaaaatacaagaatgcagagaggtgctgagaaccgcgatcctgagactggggcctgaggaggcggcagggaccgggagaggggcggggcctgctcctgttcccaccccacctgagcgcgtgggaacctcggttccttacacctgatgctggtttgaaagcccctgagtgaggagctctgcgttgttgggggcggggcatcgctgagcctagaagggctcaggcgtcaggctcctgggtgtcaggtgcccctcagtgctgtggggcctgcccacccgtgctccttccccaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacggtgagtgcggccccctagggaggggagcctaagaccaggggtgtgggtgaggtctgactgggcgctgtggggagcaggtggagtgtacgggggccggggtgtgggtgacgtctgaccgggcgctgtggggagcaggcggagtgtgcgggggccggggtgtgggtgacgtctgaccgggtgctgcggggagcaggtggagtgtgcgggggccggggtgtgggtgagttctgaccgggtgctgcggggagcaggtggagtgtgcgggggaggcggggtgtgggtgacgtctgaccgggtgctgcggggagcaggtggagtgtgcgggggaggcggggtgtgggtgacgtctgaccgggtgctgcggcgagcaggtggagtgtgcgggggccggggtgtgggtgagttctgaccgggtgctgcggggagcaggtggagtgtgcgggggaggcggggtgtgggtgacgtctgaccgggtgctgcggggagcaggtggagtgtgcgggggaggcggggtgtgggtgacgtctgaccgggtgctgcggggagcaggtggagtgtgcgggggccggggtgtgggtgagttctgaccgggtgctgcggggagcaggtggagtgtgcgggggaggcggggtgtgggtgacgtctgaccgggtgctgtgaggagcaggtggagtgtgcgggggaggcgggcacactcaggagattgggtgcaactcccggcccacccctgacccaggtgaccccggacaaacggctaacttggctggactctggtatctccctcaaggttgtaagaggggtccacgtgacagtcactcgctgcgagggttccgctaacagagcagagggagggggcgtggccagcaggcagctgggtggggctgagccagggcgatccgaccccgaaccggagcttttagcactttgagtccctgtactcagaggtctcctgcagccgggaatcccactgtgctgtggtccctggcagccagcacccacccccagcttctccgtcaaggttgaggacggagcactcctgcctctgattaactggacgcaggagaagcagttgctttaatccggagccttgagttgggacagataatgagtcattcaaccagattttccaaggacacactaactttggtatgatgcgtgtgtgcccctgaatccacgtggtcaggaaagcccagggaacactggcctgtgactcactgagcaggttcccttgttaccccgaggggtgatttactcctctgacagtgacacggacactgtgcgtccattccccgggcgggcagaggacactcccagatgcccacgaggggcccagcaagcactggccagccccagcccggccttcgccttcctttgcgtcagaatcatgaatgtgtccggcggggtcggactggaccagctgttgggctttgtttgctctttttacgaattgaaaaactgaagccaggagcggctgggtgacgtcccaggtcactccttactttcctccccacgctgagctcagacgacttcccgtgacaccactgttggtggcggaatgggactgtggctgcttccgctcagccacgctccctctctgtggacggcggagggtgtgtgtcccagcccggctgccgccctcccttaggtctgtctcccggggctgctgtaacccaggctcacaaacctggtggcttaaagcagcagaaacttagtctatcagatctggaatccgcgtcgattggccatcatccagccatcggtgttggcggggccacctccctctagggcctaggggaagagcattccttgctgcctccagcgtctgggtgctgatggcattccctggccagtggccacctccctccagtcgctgcctccgtgtcccatggccgcctccctccagtctctgcctccgtgtcccgtggccgcctccctccagtgtctgcctccgtgtcccgtggccgcctccctccagtgtctgcctccgtgtcccgtggccgcctccctccagtctctgcctccgtgtcccgtggccgcctccctccagtctctgcctccgtgtcccgtggccgcctccctccagtctctgcctccgtgtcccgtggccgcctccctccagtctctgcctccgtgtcccgtggccgcctccctccagtctctgcctccgtgtcccgtggccgcctccctccagtctctgcctccgtgtcccgtggccttctctgtgtgcctgtgtcaaatctcccccaagagttccgtaagaacactcgtgatggcgtgtaggtcccactagggtcatctagggtgatgccttcatatccagatctttaactgacatctgcaaagatgcttttccaaacaaggaaatgaggagcagcacttaccgggtccatgagcaggccttgatgtctttgggtggccatgattcagccaactgcggtcctccctctgacctcaaagatttctgtccactccacaggcaaaatatgttcacaccattgccagatcttggctgggtgtgggggctcacacctgtcatcccagcacattgggaggctgagatgggcggatcacttgaggacaaaagttcaagaccagcttggccaatatggtggaaaccctgtctttactaaaaatacaaaaattaactgggcatagtggcaggcgcctgtaatcccagctgaggcagaagaattgcttgaacccaggagctggaggttgcagggaaccaagatcatgccactgcactccagcctgggtgacagagcaagactctgtctaaactaaaccaaaccaaaccaaacaaaatgatcccctccaactacaaacctgttacagcagaaactccaagatcaaaatctcatgtaaatatcataagcttggccgagtgcggtggctcacacctgtcatcccaacactttgggaggccaaggcaggcatatcacctgaggtcaggagcttgagaccagcctggtcaacatggagaaaccccgtctctacaaaaaattagccgggcatggtggtaggcgactgtaatcccagctactgggaggccaaggcaggagaatcgcttgaacctgggaggcggaggttgcagcgagccaaggttgtgccactgcactccagcccaggtgacagagcgagacaccgtctcaagcaaaacaaaacaaacaaacaaaaatatcatcagctcaaaagtcccaaatgtcatcatttaagtcagggacgctgaagactctgggtctgatccattctggggcagaatttctcttcatatgtgcacctgtgagaccagaaaacaagtcacctatctccaaaatacaagggaagagcaggtgtagcatcacagctgcagacactctcattcccaatgggggaacacgggaggaacgaaggcatcaccagccccaggcaattccaaaacccggcaggcagaatgcactaggtgataagaccggggagacccctctgtggcttgggcaccccctaccctgctctgtgtccacggccctgccttcaggacgatccttttccctgaaggttatagcttttagtctgcttgaagattttaaggagtctgacgacctttcattttatcccgtctctgtccctttcagtccaaatttgcagtgttgttgttgatataacatttgtgaaaaccttgcagtcctcctttgaatgccataggaatttctgccagtagacaaaaagggctctgcagacctttcctgtgatgctgtctccactcctggcttctgagatggttgagtgaattgcagtctccttgcctggtctcttcatcactagcaggaggttgtttagacacacccttggccctctctcttttttctttttgttttttttttgagacagtctcactctgttgcccaggctggagtgcagtggtgcgatctcagctcactgcaacctccgcctcctgggttcaagtgattctcctgcctcagcctcctgagtagctaggtctacaggcacccaccaccatgcccagctaatttttgtatttttagtagagacagggtttctccatgttggccaggctggtctcgaactcctgacctcaagtgatccgcccgcctcggccccccaaagtgctgggattacaggtgtgagccactgcgcttggccgttggccttctctttagagtctgcttttcgaacagtgaatctcttttcattttctgcattatatgcgacctgcattatatgcgacctgcattatatgcgacctgcattatatgcgacctgcattatatgcgacctgcattatatgcgacccggataggctgagaatttcccacatcatcaagtcctggttccattttgtctgtcagtttttccctcaatttctctctttccttttgcattttgtgagaagcagcaagaaaaaaaagccaggccacaacttgaacactttgcttggagatctctgcggctaaatcttcaagttcatcatttacagttctgctctccacaaaactgcacagcacaattcagccaggctttctgtcactctgcagcaaagttggccttccctccagtctccagtaccacatttcccacttccttctgagccctcaccagaagaagcaactgtgatgttcatttttctgctaaaattctgttcatgccagtatatgtattctctctctctctctttttttttttttgagatggagccttgctcttttgcccaggctggagtgcagtggtgcgatcttggctcactgcaacctccaccttccgggttcaagcaaatctcccaccttagcctcccgagtagctgggattacaggcatgtgccaccatacccagctaatttttgtatttttagtacagacggggtttcaccatgttggccaggctggtctcgaactcctgacctcaactgatctgcccaccttggcctcccaaagtgctgggattccaggcgtgagccaccgtgcctggcccgtatatatattttctaaggcagcggtccccagcctttttggcaccaggaactggtttcgtggaagagagtttttccacagatgggggcggggtggtaagcggttggtttggggatgattcaagcacgttacgtttattgtgcactttatttctattattacattgtaatatataatgcagtaatcatacagctcaccataatgtaggatcagtgggagccctgagcttgttttcctgcagctagacggtcccatcatctgggggtgatgggggacagtgacagatcattaggcattagattttcgtaaggggagtacaacctaggtccctcgcatgcacagttcacagtaaggttagtattcccatgagaatctaatgccgcggatctgacaggaggtggagctcggacagtcacacacacgatggggagcggctgtaaatagggatgaagcttcgctcgttcacccaccacccacctcctgctgtgagcagcccagatcctcacaggccacagaccattaccagtccatggcccagggggtgggggacccctgctctagggcaacaaagccctctctgccctgctcctcacttccttctgagcccttactgcgagttgttttttttctgagacagggtctcactgttgcccaggctggagtatgttggtgcgatcctcagccttgacctcccgggctcaagtgatcttcccatctcagcctcccaagtagctgggactacaggtgtgcaccaccatgcccggctaattttttcatttttgtagacatgagatccgctatgtcgtccaggctggtctcgaactccagggctcaggtgatcctcccgccttggcctcccaaagtgctgggattccaggcgtgagccaccgcgcccgtctccgcaaggcctttaataccacattcccaccaacattctcttcaaggacgttgagacgttttccattcatggtgcttctaaatcctcccgtcgtctccccattgccggtttcaatgccacttccacatttttaggtgtttgttgcagcagcagcccacttcctcaccccagacctgtatccgtttcctgtggctgccgtaacaaatggcctcaagcctgaaacagcagcattgtggtctctcacgtgtctggaggacagaactctgaagtcagggtcacacgtctgtttccccgcctcctccactcctggggggtccggctttctccacttgtggctatgtcacttgcccctgcctctgtggtccctcggcctcctctcctgtgtgtgtcccccaccacctctctcctgtaaggacacctgtgatggtattttgggcccactcggatcatccaagttaatctcatgtttcgatcacatgtgcaaagtcgctttctccaataaggccacgtccacagattccagggactgggacctggtctctgtgagggccggtgttcagcctgctcgcgttagagaggcagagctttccagaagcagtgtctgacgcttcctggccatcccagggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtaggggagcttgctttcgagggtgattgggcagagagcacagtgggctggtcagagtgtcaggtacagctggtcacgaccaggacgttcaacaggcctggcgtttggcagagagtgcagtgggctggtcagagtgtcaggtacagctggtcacaggtcattcgtggcactcggcagagagcgcggtgagctggtcagactgtcaggtacagctggtcacaaccaggatgttcatggtactcggaacgtcctcagaacacacctgggtttctttcccgtgtctctttatactttgttccaggagggtcatcttctcttgcccattttagccagtgggagggcggtctggggggctggcagctcacctgtgtgctcgcaggtaatgggccaacctacattttttttgggacagggtctggagcgcagtggtgtgatctcagctcactgtagcctcgaacttctgggctcaagggatcctcccatcaccctcccaaagtgctgggattacaagcttgaaccactgtgcctggccctacaattattttaaaccttgatcatggtctgctctcaggttcagaaatcagaatgtacgatagtcaaaacttaggatttgatacctttttcctcataggtgggatgggatgggtttgaggacgtcgggaggtcaagtgcggggttttgcatatcacttgaggagggttcaaagaggagatggtgaacgggaggtgtctgacctgtggctgggtgggctggggtcccttgcagggttccttgtgcatcgaactcccctggagggttcctcaccagcttgtgggccccagccccagggtccaactcagcagctccaggtgggctgagaacttgcattaggagcacgttccctggtgagggcgatgctgcagttcagggaccagggaccacactttgagaaccctgcttgactagtaggagcacgttccctggtgaggacgatgctgcagttcagggaccagggaccacactttgagaacctgcttgactagtaggagcacgttccctggtgagggcgatgctgcagttcagggaccacactttgagaacctgcttgactaggacatctggggtgggatgtgtgggtgagtgtgtgaagacgatgggcccatggggggctcacagacagagtttgctgcctggggaaaggggttgccaagtccttctcaggctccactgctgttgggctggatgaagttcagggtggggctgggcggatggacacaggatggacgtgccgcatgctgctcgcatccacgcgtggcaggttgtgccacctgcttggggcctcagctctgattgtccatagcccctctccctccctcccaagaaagcaggcaggggtggatgggaagcaagcgagcggggaagtgtgggtggcggggggctcttgagtctgctcattgatgtggaacaggcaggtcccctgggaatgtggagctttgactttaaacggcgactcagcactggcaagaggcctcccagcaggtgcttcagtgtgtggttaggctggagccagcagggggcaggggagagtgccctcagtgcagggtcttgccccccacctctgtcccctcactcggctccatgctttgttcaggtgtggccctcactcggctccgtgctttgtttaggtgtggccctcactcggctgtgtgctttttctaggtgtggccatcaagatccccatcgtgtgcgtggtgctggagggcggcccgggcacgttgcacgtgagtatggccaggtgggagggggcatgtgtgggcccgtcctgctgcaggcagatgactgtccaaaagtgcttgtctcagaactcaagactgttggcaagagggcgatgagctttcccaccagaagaagagaaagagcatctacgctgtgtcggggctgcttctgggtgggtggaggacgggtcggaggaaggtgcctggaggaggaggctgggcttggctatgactgggccattgaccggcgtggaaggaaagggtggggccccagggcctggagtgagtggggcgcctctgctcccaggacctgctggggaggctggggggtttctacaactctgcccccaagattcctccaggaagcatttttcaaagtacagggctgtggcccccatcccagatccgtggtgccagcagctgtgtgactgcagatttggcaggcagcttgaatgcgctgctctgccggccttccttcccgaccctaaccctaactgctttgtggcgtgcagggtgcgaggtgacctcacctgctgtaggaatgtacgaggacatatagcctgaggatctggagcaagagtatgggcttttgtgaaggatgggatcacaggcaatgtcccgtttatgtttcatgattgcaggaggtcaaaacagagccttgggggcttgaggctggatgggaatccatagagcactgggtcctcactccctatgcgtgccgagtacccttcacggctcttctgctggggcggctgcacccgcctccttaccccaggccgatgctcatgcacacggcagagtccttcctgccagacagctttgtgtccagtcccttcccgaagtccagcacaccctggagcccaggtgccctcctcatggctctgctcttactgtgggcttttatgaggtcggtaactccaggtccatgcagcgtcccctttgctgcgaggccctcacgtctgcaggtccatgggcaaaaatgctgggagtctttgattctgctggagctgaggcctgagaggtgccaggtgtgcagcccccagtgtgttggggcagctccctcttcccccagagcaggggacgccacgaaactaataagtgctttcagtggatctcggagtagtgttagccagctctgcccttagctggccttggagaattctccatttcagaaagcatcggagcggtgaggacccagtcccgggctcacacccccacctgccttgcagaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaaggtgaggctgacgggcacgacggtcaccagcatgtggctgctttgcagagacactgtcagcctggtgggcaggaccaggactcatggaccgatgcggagaacccactgggtctgagtgggtgccagagcgatttgcagagggcagggcccaggtggtaaacctcctggctgggttccggaggtcagatcccaagacagcatgtgaaaggagggtgtgaacctcacccgcagcacaccagggcgggctgggaacgctgcggggctcagtggtgctgtgaaaagggtctgctggattggaggggtgggaggcaggcgctggggaggcctcagccgagtcgggcagcagggcagctgctgagcaatggctgtgggtcgcagggtccagtccagattgtagcctcataggtgagttaatggaggcatgtagagtggcctcaggaggggccattgccccagtccaggggtagattttgggtggcccctgccatgaccccagcctccagagggggtccgttgtgaagggccgtggttggccagccctggccaccccaccaagcccttgaccaggggggtgggctccagtggagagcctctcccctccctgtgcctgctgcttccagggtgacctgactcaattcctggcaggattctttgcaggggctggcactggggccttttcatcctcagtttcccagcaagccagggccggcagagccctctgtctgtgtctttcctgcagacccgggacatctccaggttctgagtggctgacatgcgctttccactgtgttgaatttgggttctgtgggcagtggtgacccccagctgcaggccgcagggacacacctatttggccagattgggcctgtggagagtggattaaaaatgagcaccctcaggaaccacgggtgtcggaagggctgggtggaggtcttggccccgttggccgattcagaagcagagtttctctgactggtgatttgtgggtggcacagtgaccttgtttccttctgtgctttgcgatggtctcagagtgacctcgttctgcacagatgtcttctgagagcgtttttgtccggcaggagaataacatgatgtagctgcaagcgtcagatcagtttgtgaaaacatcgtggtccggctgtgagcggccgctcagctccccatgtcagggcggctttccttccttcccggtgccattgggacttgtcgggcgggccctggagccctctctctgctggttgataaattattcaggcaattctcagaactgagtttaatctgctgttgttgaaaggtgcctatttttaatgcactctccatagccaagccaaggccctgaaagtggtgctttcacacacagccgtcaggcctcagcaggggctcggcattcgctgatgctcctgctcagtggggaggggcccagccatgcagccagggtcagtgcgctcctttaacacgccttctcagagtgtccgtctacactgtggaggagttgcagagctaccctcgggtgctgctgctggtgggcggccccgtcagaggggcccggggacctccctgcaggggctcacagctgtggccaggaagaagttgcccaccctcgctcagccttgcctttctcatctgttaagtaggggtactgagtgctcgactcagacgaggaaacgaggccctggcgtccatatgggctcagacgctgggagctgcttcaccctatgaggacagggcgggctgaagtccaggagacttttatgggctcagacgctgggagctgctttacggtatgaggatgggggtgctgaaagccaggagacctttggctgctggatgagggtggagttcgccagggagctcaggatgtgttttggagttgtcatgaaagctggaccccgagggatggggcaccgttggggtcttaggcatggaggtggagtgtgaggagccctccaggtgagggcagagtctatgtggaggcaatggggccaggctgcggacgaggagagaagcaggggaggccaggtgtggctggcctggggagccagagggagaaggctgaggcttactttgggagcagtgggagccatgggaagatgcgtttgtggagttgctcgccctggacacagggggaaggtgcttcaaggaggagtaactgtagtagacatacctgctagggatgccatgatggatggatggatggatggatggtgggtgggtggtagatagatggatggatgatgggtgggtgtgtggatggctggatggaaagatggatggatgaatagatggatggatggatggtgggtgggtgggtgggccatgtggatggatggatggatggagggataggtgggtagctagatgataggtagattagatggatggatggatggatagatagatagacagacaggtgataaaatggatggactgggcactgtggctcacaattgtaatcccagcactttgggaggttgatgcgggtggatcacttgaggtcaggagtttgagaccagcctggccaacatggtgaaaccacatctgtactaaaaatacaaacattatccaggcatggtggtgggtgcctgtaatcccagctacttgggaggctgaggcaggagaattgcttgaagccaggaggtggaggttgcagtgacccaagatcgtgccactgcactccagcctgggtggcagagcaaaaagtctgtctcaaaaaaaaaaaaaaaagatgaatgaattgatatgatagatagatggatagatagatagatagatagatagatagatagatagatagatggatgatagatagatagtgggtgggaggtagatagaaagataagtggatggatgaatggttggtaggtgggtgtgtgtatggatggatggaaagatggatggatggatggatagctagacaatagatagatacatgtggatggatagatggatacatggatagatggataggtagatagatagatacatacatatatacatagatgaaacacacacatggatggatagatagatttatagatggatagattatgtagatagatggatagatgcatagatggatagatagatcagattatgtagatagatagatggatagatgcatagatggatagatagatagactgatcgatcgacagacagacagataaataagtagacagatagataggcaggtaggcaggtggtgaggagtggcctgggcttagcaggagggctaggaggagcagcctcgcatgaagctgcactatcgtcagggtgaagatccgttgcccttggattgtgttttccacccaacagactctcacgaacatgatgtatttggtccccatggatcttcatctgcaccatctagggcaagaggagatgtggtggtgtcctggccacaagcgcaggcaggacccaaggctctggctgtgtccggggcctcaattctatgtgtcctggaggaggcaggggttcaggagtcactgtgtgtctcacttagaaaatgcttgttgcagatccaagatatcgtccggaggcggcagctgctgactgtcttccgggaaggcaaggatggtcagcaggacgtggatgtggccatcttgcaggccttgctgaaaggtgagggtcagggaacatgggggcaatggggtggaggccagaacgtgagctctgaggacgccaagttctagtcttgaagtgccatgattctgggaaccagaatattcctccttggtcagaaaccctggccagagggcagctggcgacgtgcaggtgggcgcctgcctgtcacctgatgttagaggtatgagctcctttatttgtaactggaatccgagtgcagcctgtgtcatttttacctttgtagtggtcataatttctcataaaacttcagggtggaaagaaagagtgcagaagttgcctctctcaacttcctgcttgctggctgctttagctcctctacctctgatgcaggaaagagtgtagaggtagagcagggcctcaggaatggtgtgatggacttgagctgtagtggctctctgtgtaacttctgttgcttagcctggcccattctccaggccacaaacatcactgtcctcttctcatgccacaggagagaaggcttatgcctctttgtcttacccagctggcacctgacactgggaagccttggtcttatatgtgctcctcccgcccgatgctgggcttctcaccctccagggtcggaggccccaggctgattctgaagggctcagcagagtgggcccaggctgggatcagcagggaacttttgtgataaaggccagactttcatcttgtttctgtgttgatttgagactccccttatcaaggacttgatgttgtgcataaaacctcacacaaacagcgagatgatagactacatattagaccacaaattaagccttaatttatctctcaatagatttaagatagatattatacaaattatcttctctgacaacaagatgaagttaggaattaataatggatgtaaaagtggaaaattcacaaagttgtggaaactaaacgacactaccttacacagccaatggatgaaagaagaaatcaaaaaggaaatcaagaaaccaatgaaaacaaaagcacaatatatcaaagcttatgggacatagcaaaaacaatgctaatggagaagtttatagctataaatgcttacattaaaaaataagatcttaaaccaacaacctaactttacaacttaagtaattagaaaaataagaacaaatgaaatccaaaagtagcagaatgaaggaaatagtacagattagagcagagatcaatgacataaagaatagaaaattgcagagaaaatcaataaagtgaaaaattggttatttgaaaagatcaacaaaattgacacacatttagctaactggactaagaaaaaagaaagaagattcatattactaaaattagaaatgaaagtagggacattactcctgactctacagaagtaaaaggattctgtgaataattgtatgccaacatgttggataacctagatgtgttagtctgttttatgtgactaaaacagaataccacagactaagtactttataaactacctagtactttataaatcaatcactgaccatccttgccttcccagaggatggtcagcatctggcaaaattgaggggccagcatctggcaagggcctgcctcatgtcattccagaatggcagcacatacatgcccttccactggaaggcagaagggtaagggagcacacagatgcatgaaagagagtaagaaagcaagagggagctaaacttgctttttataacaagcccactcttgaaataactaacccactcccaaaataagacattaatccattcatgaaggctttgccctgtaatggatcacctctattaggccccacctcccaacattattatactggggattacatttacaacacatgaactttggggaaaacattcaagccatagcactagatgaaatgaacacatttctagaagcacaaaacctaccaagactaaatcataaaaaaatcaaaactctgaatagacctataagtagtaaggagactgaatcagtaataaaaaatctccccataaaagttttagggctgatagcttcactggtgaattctaccaaatgtttaaagaactaacaccaatccttctcaaactttccccaacaattcaagaaggaaggcttcctaattcattctgtgaggccagcattattctgataccaaagacagacactacaagaaaagaaaactacagaccaatatccattatgaacattgatacgaaattcttcaacaaaatattagcatacaaaattcagtagcattaacaggattatacactatgactacatgagatttattcctggaatgcaaggatggttcaacatatgaaaattaatcaatacaccacattaacagaatgatggggaaaaaacatgattatctcaactgatacatttgacaaaatttgacaccctttcatggtaaaaacattcaacaaattaggaataaaaggaaactaccttgatgtaataaaagccatatatgaaaaactcccagcgaatatcatgttcaatggtgaaagactgggacatagcaaaaacagtgctaatggagaaatttatagctatacatgcttacattaaaaaataagatcttaaaccaacaacctaactttacagcttaagtaattagaaaaataagaacaaatgaaatcttttcctccaagatagaaataagggaaggatgcatactttcaccacttccattcaacattgcgttggaagttcaagccagagcaattagacaagaaaaagaaataaaacttataaattgggaaggaagaagtagaattatttgttcacagatgatatgattttcgtatttgtccattttcacactgctataaagaaatgcccaagactgggtaatttataaaggaaagaggttaaattgactcacagttcagcatgccttggaaggcctcaggaaacttacaatcatggtggaagatgaaggggaagaaaggcactgtcttcacaaggtgacaggaagaagaggtgccaaatgaagaaggaagagccccttctaaaaccatcagatctcatgagaacttactaccatgagaacagcataggggaaactgtccccacaatccaactacctccacctggtctctcccttgacacatggggatcatagggattataattcaagatgagatttgggtggggacacaaagcctaaccatatcaattttctatgcagaaaactaaagattctacaacatacccctgaactaagaaatgaattcagcaaagtagcaggacacaaaatcaatacacaaaaatctgccacatttgccaggtgtgatggctcatgcctgtaatctcagcactttgggaggcggaggtgggcggatcacgaggtcaggagattgagaccatcctggctaacatggtgaaaccccgtctctactaaaaatacaaaaaattagctgggcgtggtggcgagcacctgtagggcatggtggcgagcgcctgtagtcccagctacttgggaggctgaggcaggagaatggtgtgaacccaggaggcagagcttgcagtgagctgagatcatgccactgcactccagcctgggtgacagcaagactccgttcccccaccaccaaaaaaaaatctgctgcatttctatacactaaaaatgaataatcagaaaaggaaattgtgaaaacaattctatttacagtagcatcaaaaagaaaaaaaatactgaggaattaattaaaccaagggggtgaaagacttgtacaatgaaaactgtaaaacattgctgaaagaaatgaaagaagacataaataaatggaaagacatcccatgttcatgaattggaagccttaatattgttaagatgtcagtactactcaaagcaatctacagatccaatgcaattcctatcaaaaccccagtgatttttttttttttgcagaaatagaaaagcccatcctaaaattcatgtggagtctaaagggatcccaaacagccaaaataattttgaaagggaagaacaaagctggaagactcacactttctgatttctaaactcactacaaagctatagtaatcaaaacagtgtggtaatggtgtaaagaaagacatagagggctgggtgtggtggctcatgcctgtaatcccagcactttgggaggccaaagtgggctgattgcttgagctcaggggtttgagaccagcccaagcaacatggtgaaaccttgtctctataaaaaatataaaagctgggcaaggtggttcatgcttgtagtcccagctgtgtgggaggttgaggggagaggatcacttgagcccagaaggttggggctgcagtgagctgtgattgcaccactgcactccagcctgggcaacagagcaagaccctgtctcaaaaaaatcccaaaaagatatggagaccaatggaatagaatagtgagcccaaaaataaaccctcgcatatatggtcaaatgatatttgacaggaatgcaaaaatcattcagtgaggagagggacagtcttttcaacaaatgatgctggataaactggatatccacatgccaaagaatcaagttagacccttacctaacaccatatacaaaaactaactcaaagtagatcaaggacttctgaatataagacctaaactcttagaagaaagcacagggcaaaaacttcatgacaaaggatttggcagtggtttcttggccatgacacctaaggcacaggaaacaaaagaaaaaatagataaattggactttatgaaaattaaataattttgtgcatcaaaagatattatcaacagagtaaaaaggcaacccatggaatgggagaaaatatttgcaaatcatacatatggtaagggattggtatccagaatatatagagaactcctataactcaacaataaaaaaaaaacacaattcaaaaatgggcaaaggacttaaatagacatttctttaaagaagtcgtacaaatggccaataagcacgtgaaaagatgctcagcatcactaatcattagagaaatgcagatcaaaactaagagatatcatttcaaacacattaggatagctactatagaaaagaacagaaaatcacaaatgttggccagtgtgtggagaaactggagcccttgtgcactgttggtggatatgtaacatggtgcagctgccgtggaaaacaggatgacagttccttaaatatttaaaaatacaattcctatatgatccagctattccactcctcagatacatatgccactccccacccccaaatttaaagcagggtctggaagagatatgtgtatactcatgttcatagctgcattatccacaatagctaaaaagtggaagcagcccaagtgtccattgacagaagaatagataagcaaaatgtggtctatacctacaatggaatattactgagctttaaaaaggaaggaaattctgacacatgctgcaacatggttgaacccttaagacattatgttaagtgaaataagccagtcacaaaaggacaaatactatatgattccagttacaagaggtccctggagtagtcaaattcatggagacagaaagtagaatggtgggtgccaggatctgggggagaggtgaatgaggagttaatgtttaatggggatagagttttagtttccaagataaaaagatatatggagaaggacagtgatgatggctgcacaacattatgaatatacttaagaccagtgaactgtacgcttaaaaatatttggctgggtgagctggctcatgcctataatcgcagcactttgggaggctgaggtgggaggatcacttgagcccagcctaggcaacatggagaaccctgtcactacaaaaaaaaaaaaaaaaaaaaactagtcaggcatggtagcacacacctgtactcttagttactcaagaggctgaggtgggaggattgcttgagcccaggacgttgaggctgcaataagccttatgattataaatatgatcacagcactgtgctccagcctgggtgacagaggaagaccctgtctcaaaaacaaaaacaaaaacaacccaaaaagttaagatggtaaattttatgctacacgtattttaccacagtttaaaaacataatgaattttaaaatatcaactttatgaaggttcagcttagagacaataagctccctcaattctaaatgtactgtataacaagcacagacaccgtgacccaccacagtctccatacaggacatctcccctatcctgaatattccctcatggccctttgtagttaagcctccctccagactggctctggaaatcatctgtctgctttctgtcactctagattagttttgcccattttagaacttcacgtgaatgaaatcatacatgatgcattctttcatgtcttgtttcttttgctcagtgcattgtttttgagattcatccatgttgttgcatgtgtcagaactttgttcttttttgtctgtgaaggagtgtcctgttgtgtgaatacaccacaggttgtttttccattcatctgttggggtgcatttaggttgtttccagtttggggctattatgaataaagctgctatttgtcttcatttctcctgggtcaatatctaggagtggaattactggcctttatggtaagtgtatgttttactttgtaaaaaactgacaaacttttctgaaaatattgcattctttttcctgtgtgctggcagtggatgagcgttaccctacatccttgtccacacttggtgttgtcagtcttttaaactgtagccatcctagtggatgtgaagtgacatctcattgtggtttgaatttacattttcctgaggactactgatgtggagcatcattttaaggactttttggccatttgcctgtcttccttctgaaatgtctttcagatctcttgtccatttttatttgattgtttgtcttccagttttcgatttgtaagagttatttatatattcggatacaaatcgttcgtcagatattattttctcatggtgtgtagtttcctttcatattttcttcaagatgtctttgaagagcaggaggcttaaaatttttttttttttttttgagatggagtctcgctctgttgcccaggctggagtgcagtggcgcgatctcggatcattgcaagttccgcctcctgggttcacaccattctccagcttcagcctcccaagtagctgggactacaggtgtccaccaccacgcctggctaattttttgtatttttagtaaagacagggtttcgccgtgttagccaggatggtctcgatctcctgacctcatgatccacccgccttggcctcccaaaatgcgggattacaggtgtgagccacctcgcccagccaatttaatcaatttttctttatggttcatgttctttgtgtcatagctaagagatctctgcccatcccaaggttgcagatattttcttctgttttctgacggcagttttgtagacatagcctttatgtttgggcctaagaaccgctccatgttgattcttgtgtatggtgtgaggtaagggtcaaagttcttttttctttttccccaaataacaacccatgttttaaaaagttaaaccagaaagggaacacagaaactacttgagcaaaataacttgtcctgagaaccagtgaggtggttgttactgttgaacatttacaggcagttgaggcaggaaaggaaatgtgatggcttctgagtcctgagttttggatgttagtgtaagatgcctgccctccagagacctatgtcttcttaaaacagtgaggcccttttcttgcttactgcccacctgtcgcttaggggccagggcatggccaggaggagggcaggggaaacaggagtgagtggacgtgatgaccaaagccccaagattcactgattctgactccgaaatggaacatgcttttgcaaggctgtgtgtatgggaggaggtcactgggtgctgcgcctgtcactttgaattgttgagaggcaagggctcatgacacatccctgactctgacatcatttccctggagggaaatggctttgagctccagatcgaggcccaatatgcacctgttcatctgcagcctcacggagccaagaccactttggccacgagaactgggaccaccagctgaaactggcagtggcatggaatcgcgtggacattgcccgcagtgagatcttcatggatgagtggcagtggaaggtaagtcttccagagcaccccgtggaggggcctactgggcccacatgcattgcaccactgaagcaagggcaggcaaagttcgcattgtctggatcccagcccttcccttgagggtgggtgacctgggcagctttcatcctccccaggttggggacaacagcagcccccatctccagggtctttgagatcaggatgacatggggtgatgaccaaatgcaaccgtcactgcacaatgcttgctctcagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcgtgctggtaacggggcccatcctggactcgtcttcgcgggctactgctatgttcttagagctctctgtttttaaaattagcttttatttttattagaaaagacacatgctctatcttaggctgcttgggctgctgtaacaaaattccacagatggggcagaaactaccagtttattttctcgaagttctggaagcccgaagtcccagattaaggcaccagcagggctggcttctggccagggcctcttcttgcttgcacgtggctgccctcttgctgtgtcttcacgtgacagagagagaagtctctggtgccacttcctcttctttttcttttatttattttttatttttttgagacagggtctcactctgtcgtccaggctggagtgcagtggcgtgatcttagctcactgcagcctcaacctcccaggctcaagcaatcctcccacctcagcctcccaagtagctgggactacaggtatgcgccaccacacctggctaattttttatttttttgtagagatggttttgctattttggacaggttggtctcaacctcctggcctcaagtgatccgctctcctcaccctccaaaaggctggaatttacaccctccagccaccgtgccttgtctatttttatgtttgagacagggtctggctctgtgacccaggctggagtgcagtggtgcaatcatggctcaccgtaccttccacctcccaggctcaagcaatcctcctgcctccgtctcttgagtagctgggactataggcatgtgccaccacacccagctttttttttttttttataatattttgttgagatggggtctcattatatggcccaggctggtctcaaactccggggctcaagtgatcctcctgtcttggcctcccaaattgctggcattgcaagtgtgagcctccgcacctggcctcacccctctttttataaagagaacacacctatccacttaggaacccacaatgtggcctcgtttaaccttaattaccttcttaaaggccctatctccaaatgctatagtcacactgggggttagggcttcaacatatgaattttaggggggacagagttgcgtccataacataccctttctaaaagttccaaacagtacaaaaggttctgcagggagcgtgatccccctgccctgagccccactgctgcccactgtgtatgctggttttttccgacagtcaggtcagtaacattccaccgtatttttgtgagatgcccagggtgcactgcagctgtgggagagtggatgctgtagtctgcaccctgtgattcaatgggagccctgctctagtctcacctttatttaatggtgagactgccccagtctccaaccttattcaagggaaccctgctctaatctccacccttatccaatgggaaccctgctctaatctccacccttattcaataggaaccctgccctagtctccaccctgattcagtgggaaccctgccgtaatctccaccctgattcaatgagaatcctgccctagtctgtttaccctttttcagtgggaaccttgcagtgactcaatgtcaggaatgatgctggattttgtatttgtatttcctcttgggagtatttatctctgattcattaaggttttacaaagcaaagcatcgatgcctttgagaagattgagctccttttcttctttgacctatgaatttggtgaattattttaatagattttctgatagtgaaacatgtttttatccctgttttgaatttcagcttggcctcagtgcaagtttaatatactggattctcttggcaacattttcaggatgtttgcatcagaatgcttaaggctttgattgcagttttatttggggggctatatttgtcaggctctgatatcaattttatgttagttttgtaaaaaccatttgggaagctttctttccttctccgctccaggacagtttatgtagctggagttaactacttcttataagcttggtcgactcccctgtgagtccatctggacccagtgccttttttttttaattggtaatagttctagtaactttctcagtttcttttctgattatttttctgtttaggttctctatctcttctaagatcacatttttttttttttcctgctagaaaattgtctgtttcctccaggttttccaatcgatccattgttccaggtgagctctgtctgactcttgagaaagacatgggtatgacttggtttctttgttttttgtttttgagacaaagttttgctcttgttgcccaggctggagtgcaatggtataatctctgcttactgcaacctctgcctcctgggttcaattgagtctcttgcctaagcctcccaagtagctgggattacaggcgcccaccaccatgcccagctaattttttgtattagtagagatggagtttcaccatgttggccaggctgatctggatctcctgaccttaggatccacccatcttggcctcccaaagtgctgggattacaggcgtgagccaccgtgccaggccgggtatggcttggttttatacattcacgatctgcacttcttaagtccagtgcgtttatttaagacgctcagttggaatatgcttaggaaggtccaaagcagaatctcaagcttatctgtacctgtggtttaggaagaaaaacacatttcttttttttttttttttttttgagatggagtcttgctctgctgcccaggctggagtgtagtggcgcaatcttggctcactgcaacctccacctcctgggttcaggccattgtcttgcctcagccttccgagtagctgggactacaggtgtccgccaccacgcctggctaattttttgtatttttagtagagatggggtttcactgcgttagccaggatggtctcgatctcctgacctcgtgatactcccgccttggcctcccaaattgctgggattacaggcgtgagccaccgtgccaggccgggtatggcttggttttatacattcacaatctgcgcttcttaagtccagtgcgtttatttaagacactcagttggaatatgcttaggaaggtccaaagcagaagctcaggcttatctgtacctgtggtttaggaagaaaaacacatttctttataatgaaaaaccttcaggaaatttctaggatcacttgaggtgtgttttgtacagtatgtgatgtgggagatggttttttttctacttctggggagcgtttcccagctacctgagtacgtgtttcctggtccggggaaaagcctagccatgcagggaggtgggtctgggcaaggtgccctgtgcttgctcgtgagtgagccatattgcccacctgacagatctttcctagtggcctctctgccagagacactgcaggagagtccctcagggagaagacagtcactgacctattaacatactccactgtgctagaattttgcttcgttgaaagcagctttgatgccatcagataagactggggaacttgaagtgcctggcatgaaacaagagtctacacatgttggtaaaggagttagacgggcgtttcactttctagatgtctccagaacagtgttttaaaaaacttcagtgtgcataagaatgatctagggtgttgctgaaaatgcaggttgtagttctccagggacagtgagatcctgagaaggtcggggctggggtcagggcctgcacctctgacaggctccgccagtgactctgagccaggcggcccggctggggctctgacagttcactgctcaccaggtgcagggagtgagcctccggtccctctacaagcgttcctcaggccatgtgaccttcaccatggaccccatccgtgaccttctcatttgggccattgtccagaaccgtcgggagctggcaggaatcatctgggctcaggtaataagactggcttctcagtctcagcagacacagctataggccagcggccagctggggagtgtggctggagagagtggctggagagcctgaggccaagtgcacgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggaggggtgtggagactgtggaggggtgtggaggctgtggaggggtgtggaagctgtggaggggtgtggaggggtgtggagggctgtggaggatgtggaggggtgtggagggctgtggagggatgtggaggctctggaggggtgtggagggctgtggaggctgtggaggggtgtggagggctgtggagggatgtggaggctgtggaggggtgtggagggctgtggaggggtgtggagactgtggaggggtgtggaggctgtggaggggtgtggaggctgtggaggggtgtggaggctgtggaggggtgtggaggctgtggaggggtgtggaggctgtggaggggtgtggaggggtgtggagggctgtggaggggtgtggaggggtgtggagggctgtggagggatgtggagggctgtggaggctgtggaggggtgtggaggatgtggaggggtgtggagggctgtggagggatgtggaggggtgtggaggggtgtggaggggtgtggagggctgtggagggatgtggaggcttgtggagggctgtggagggatgtggaggctgtggaggggtgtggaggggtgtggaggggtgtggaggctgtggagggatgtggagactgtggaagggtgtggaggctgtggaggggtgtggaggctgtggaggggtgtggaggctgtgaaggggtgtggaggctgtggaggggtgtagaggggtgtagagggttgtggaggctgtggaggggtgtggagggctgtggaggggtgtggaggggtgtggaggctgtggaggggtgtggagggttgtggaggggtgtggaggggtgtggaggctgtggaggggtgtggagggatgtggagggatgtggaggggtgtggaggggtgtggaggggtgtggaggctgtggaggggtgtggagggatgtggaggggtgtggaggggtgtggaggctgtggaggggtgtggagggatgtggaggggtgtggagggctgtggaggggtgtggagggctgtggaggggtgtggaggggtgtggaggggtgtggggggttgtggagggctgtggaggctgtggagggttgtgggcgtctccaacactgggaaggacttggggcacctggagttggagaacaaagaacttagctctaggcaggaaaggaattttttttttttttgagacggagtcttgctctgttgcccaggctggagtgcagtggcacaatctcggctcactgcaacctctgcctaccgtgttcaagcgattctcctgcctcagcctcctgagtaactagaacaacaggcatgtgccaccacgcctggctaattttttataatttagtagagatggggtttcaccatattggccaggctggtctcgaactcctgacctcatgatccgcctgcctcggccttccaaagtgctgggattacaggcgtaagccactgcatccggcccaggaaaggaatttttaaattaaaagttctgctaaaaaaaactggttctgtggttatgtccagggccgagtctcactgggcacgcacaggccgggtggtgccgccctctgcagctcacacgggttccgatgggggctggtgcatgtgctgggcccgtgctgtccgtcaggctttgcagggcaagcagacccctcccacaggccacgcaggagcctgggccatcatcagaggttgtgtattgactggggtggggcttaagttgtctgtatagatgtggtcacacacagtgattgcccagtggcccgcactgtccccgggcctcgttttcatcacctggggcagtgtgttgggttcctcaggctgggttgagcctggctctttagtctcacggtggctcctctggtccccagagccaggactgcatcgcagcggccttggcctgcagcaagatcctgaaggaactgtccaaggaggaggaggacacggacagctcggaggagatgctggcgctggcggaggagtatgagcacagagccatcggtgagctctgccgggcacgggctgcaggccatggctcagccgtgcatgccctcacctggagttcccatccctgggtctcagccccatgtgccctcaccctggggtcctcgtccctgggcctcagccctgcacgcttaccctggggtcctcatcccggagtctcggccctgtaaccacccagtgggttcgtcttgcctgctgctcagatagagcccatttgttaagacagcgagattgcaatagagaaagagtttaattcacacagagccggctgaatgggaagctggagtttcatcacccaaatcagtctccctgaaaatttggagactgttttttttttttgagatggagtgtcgctctgttgcccaggctggagtgcaatggcacaatctcggctcactacaccctctgccctctggattcaagcgattctcctgtctcagcctcccgagtagctgggattacagctgcctgccaccacaactggctaatttttgtatttttaatagagatggggtttcatcatattggtcaggctggtctcaaactcctaacctcagatgatccgcccacctcggcctcccaaagtgctgggattacaggcgtgaaccaccacgcctggtgagactggggttttttaaggataatttggtgggtagggggccaggcagcggggagtactgattggttgggccagagatgaaatcacagcgggtcaaagtgggttcttctcactgtctactattcatgatcacaggggtcgaagtgggttcttctcgctgtctgctgtttctgcgtgtggtcacagaactggttgcaccagatctccagtcggggtggcgtcagtgaagcatcagaatgcaggctttcaaaatatcctgggttttccaatagtgatgatattcctaggaagagttggggaggtttggaatcttgtggcctctggctgcgtgactcctaaaccataatttctaatttgtggctactttgttagtcttacaaacgcagactgctcccaggcaagaagggggttcgtttcgggaaagggccgctatcatctctgtttggaagttaaactataaacgaagttcctctcaaagttagtgtggcctatgcccaggaatggacaagggcagcttggaggttagaggcaagatggagtccattaggtcagttctcggtccctgtctgagttttctccctgttgtcatttttgtagaggcagttccagccctacgtgccctctccctggggtcctcgtccctgggcctgggtgttttgagacaccagccccacatttgccctgtgcccttccctgtgtcctggtggtgctgtcccgagtggttgccctctgacccgtccccagggctcagtgattgtgacctgctgctctgacggggctctcatatctccgcccaggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggtgacctcccaagagccccttccagaaacagacgcctgtggtgcctgcagggcggacacagcctcctgttcgtgcagttggcacgcacactcacacaggcttcagggccctcagcagctcggggacagcgcctgacccctcggccacctgctccaggctctggcctcccattttgcagatggggggaagctaacatgaagcaaaagcaggagctggtggccatggagatcgcaattcacctccccatggatgttcctacctgggagcggcaggcagaagcccaggtggctctgggaacggcgtctgccctctctccctggagggataagcgggacacggcgtgtcctccctggagcagcaggggctcccaggcatggctgccctcagcatcgccctggaacccccggcagggcctggctcccagcgagtgccccttgcacgctgggcttccttggagcgccgagctattgccaagtccatgagctcccgtcatgtcctgggctgtgccaggcctagggaggcctggggaagggtcctgtcccccactgcagagctcagaggggccagtgctctacagcctgcaactgcggggccttcgaagccagcagagatggggtcccatagcttgaggtcaggtgaaaggcgggattggacacccaaagccccagggcaagctctgtgtcttcaccactttctgctgtgagactgcaggctagctctgtccactaggcaccccgagtcctcagcagacagctgacgggcaccatctggggcacagggctgggcactgccatcctgagactgcccccatccgcaggccttcctgaccaaggtgtggtggggccagctctccgtggacaatgggctgtggcgtgtgaccctgtgcatgctggccttcccgctgctcctcaccggcctcatctccttcaggtgctgcagggctgcggggctgcgggactgtggggctgcggggctgcgggagaggctcctgggggctcaggatcttccctagatcccctcgctgggagcaagtcatgtgtcctcagaattgtccctggatcctggggctgtagagatgggggtgggaagcagagcagggccccacgtgctggaagcacctgccttgccccagccccagcactgatctcatgatgctgatgagcccgtccctcagccacatcagcctggggttggggaggccaggaaagatggtctcctgctcctgccggcactgtagacctgagccagtctgcggcgtgggcagttagtgcaggtctgggatgcgagcagcgagctgcggctgagtgcctccctgtcctcgcagccgcagagcctgtattgatggaatcgctttcccttatgaaggaggaggacacggctggccatggttgaagacctggcctggcctggtgtccccacctgcacctcctcagaggcttgctggggcgttgtgggatctgctgtgttttactgagggctggatggaggctcagggtctcctgggagtcagggcagattcaagaccccagcgaggtggctgagccccttctgcaacccgcagtccacactgcctgcctccttccctttctcctcacggccaggatgggtacttgagtgttcaggaatcctggtgggaaactgaggcagggaggagcggctcaggtgtcctaaagcagtgctggcttctctcctgctctcccgaggatggcagagccgtgtcactgatggccgcctctgctcccgttccagcggcccggggatagggacctgggatcagggcacaccacagggggagtgtggtcagccccacccccattgaggacggcaaggaaagcctgtccccatttacaggagggtgactaaggcctgagcgtccactgagcactgggagctctgaagctggggcccacccaaggctgggcttggggcaggctgggcctccctgtttgcagccattaaggtcatggccatgggcagggcgtcagcgggcatccctgtgtcctcactttgctgggctgtggggtccagccccaccccggtggctgtgtgtgaggctcccaggctgtgctgtgccggctccgcctgtagctgccgttatggccccggatccctgagtgcttttgcctctaaaagcacatctctctgaggggcacgggggatcacggggtggccaaagcctgtggaggtcaggaccctggccctggtggtcactgtctcctctctgctgtgacggccgcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcaggtacagccccacccgcttttccacgccccagcccggggccacccacttggctgcattctcataggggacccatggcttagagcccaccccatctagcctgcccagctccctgcaagctgagcagagccggtgtttcctccccaaaatgggtggctggggcgctgccctccaagcccctccctcctcatgccccctgcgcctgcttccctgctttccctcggcccaggcatccttccctcctggagaccggctgatcagctcaaggtggatgccctgaccttgtggactatgagtatgtcccttcccccaggaagagcagtgcaaggtgtggggtccctaagacccctctcacgttcaataacgagccagaaggacccacagacgctggggagtggcaatgctcacttatggtttattaagcaacagtctacagactaaaccagccagggggagggacgcagctgcatccaggacagctctgagcccagggcatccggccagtccctccctgtggaggtgtgggtggcactccatcctcccggtgatgatgtgtggcctcatgcatggaggcacgtccccagagaggctcgcgggccttggtgtctactggaggtcagtcacagaggcgaggctgacaccacatggttgacctcagtctccagccctccaaaggtcaaactgaaaactgcccggggccccaccccaaatcacactgtgggaccacctggcatggcccaggccccaggaacaaagacaccctcatcaggcggacattccaagggctcagaggctatctccctggagctgggcgaggccaagctgccccccaggtggggcgaatcccttactgtgtggggtctccactgtgcccccacggtgcctgcacctgctggcagccggtgaatgggaactaggtccttggaaccctcagggcagtggtgagggggtggggtcagcccacggggcagtggtcctggcttagacttacctctgctctctaaccttggtggaccaccaggcccccagttaccccagttagaaagcagtgtgcactgtgtaaataccactgcctactggggccctgggggaggcaccggcgtccccaggaaggaagatcaggtccaggacttggcggggcctgggagctgtgctgtggccctggctctgctgggctctccttggctctcctcttgccacagggcttctgccaccagaccctctctacaaggggccagaggcctccatgcacccccagccccagccccatgggcagcagcctgagagcagagggggcacttccttctccctgcatctgtctgtgatccagggagggccctggttggtcctgctggtcacctgccccacctgtccagctgctgggtcctggggcctggggctagggagggtgtggggactcctgccaagtaggccaaatgggggctcccacagcccctgccaggtcctgcactcttggcctgctaaagaaacagtgtggcccctgacagaacaaagatccttgtgggaaggcagctggcgcctgacattgagggcgctgctccaacacacacacacatgcacacacatgcatacacatacaggtacatgcacacacatgtacacatgcacacaaatgcacacacacataggcacacacacatacatacatgcatatgtacacacatacatgcacacacatgcacacagtacacacataggcacacacattcatgcatatgtatacacacatgcacacatgcacacacatgcatacacacatgcatacacatacatgcacacatatacacatgcatacacacatatgcatggacacacatacatgcatatagagatgcacacacatgcatacacatatacatgcatgcacacatacaaatatacacagataaacacatgtatacacatgcacacacatgcatacacacattacacgtgtgcatacacacaaatatacacatacatacacatgcacatacatatacagcacacacatgcatacacacatacacatgtacacaatatacacatacacatatgcacacatacatacacacatgcacatacacatgcatacacacatacacatacacacatgcacatacacaaatatacacatcacccaagcacatatacacatatacatacatatgcacatgaacaaacatgtacacacatacacacacatatatacatatgcacacatgaatgaacatacacatatgaacacacacatacagacacatacacatatatacacatgcacacacaaaaacatgcaaatacacatatacacagagacacacagatacacatacacatgcacacacacaaacatgcatacatacacaatacatgcaaatgtatgtgcatacacatatacatgcacacatacatgcacatacacatatacacacatgcatacacatacaaatacatgcagacacatacagaatgcacacatacatacacacacatatgtgcacacatacatattcacacgtatacacacatacatgcagaatatatgtacatacacatatatgcacacacaggtgctgagtgagcagggggccgaggtagctgctgccagcgctattctgcattgttcctccacgtcctgttcccatctccctcactgacccagctctcttcagatcagaaccaatgttcggatttgctgaccgtgatgatagtgatgatagtgatagtgatgatagtgacagtgatgatagtgacggtgatagtgatgatagtgacagtgactgtgattgtgatgatgatagtggatagtgatatgacagcgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatagtggatagtgatatgacagtgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatgatagtggatagtgatgtgacagtgacagtgaggatagtaagagtgacaacctgtctgccttcctaccgcccctcttcccagtagctcttctatgaccctgacgagtgcgggctgatgaagaaggcagccttgtacttcagtgacttctggaataagctggacgtcggcgcaatcttgctcttcgtggcagggctgacctgcaggtgagtggcctcaccccgatggcgggcccgtctgaggcagccagccctgcaggggatgagcacaggccgggcccagaaccagccacaccgggtgaggctcagctcgtctgtgaaccctggattgtcatctgtccaatgggtgtccaggcaacagcgccccacctacccttgggattgttgagggagcacagaaggggcatgagagctcctggcagagctgagattgtccatgtgcaaggggccatagatggcaacctctggaattgtcccagctccacggacacgcggctgccgctttctccctctgcctccctactgtgggctcactgcactgcctgtgatgctctcgtgtctctgcgaggccgcggccccctttctcggaggcaatagggccctggctaactgctggctctccaggtgcccccatgccaggctgccctgtggggctgggcgtctgaagaaaagtgggaggctctattcctcaatctcatgccagctttgaacacctgggatgcagggcccaccagagccctttgcctccagggcccacctgggctaggacaggtggaggggcgacgggggacagctctgggggctgctgtgagcaggtggctgagatgtgtgtgcttctgcccggcggccaggctcatcccggcgacgctgtaccccgggcgcgtcatcctctctctggacttcatcctgttctgcctccggctcatgcacatttttaccatcagtaagacgctggggcccaagatcatcattgtgaagcggatggtaagggggcgggggcaccggctccatcgcggcctgcagcccagggtgggcctcggggagggcaggccccttgccagtggctcggactggggcttaaacacacctgtaggttccccgtccctgctttgccccttgggctcccaagaatgcccttctcgtatctttgcctgtacgtcacctcttccaggaagccttccctcattctcccctctgatccccactcattcctggcctctgattcagctctaggagctttcctccttggtcacggttatgtctgaccgcactcattcctggcctctgattcagctctaggagctttcctccttgggtcacggttatgtctgacccctcttgcactttgtggtgctagcacaaagatgtcggcagtccacgagggtgtgggggcagccccaggactgctcctgggagcctcctgcatgccgtgtctgtgctgtgagtggcagtgctgtctccaccgctgctgggcctgcctctgggcccagtgagcatcgggggccaggagagtgtagcccacacactctctgtcctgcagatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtaggagccgggcgccatgggagctcgggtggtgctgccgggaagcaggagagaggctggaaaggggccgcatgagtgggagtgaggccggctccatcagggggtcctgcggttcccacctggccggtgtcctccctgggggcattcattccccagctcctgtggcaggaagtagaaggggccccaccaggggagggaggaggggggcctggtgggggtgagtggtgccacgcagaggtcagagtgggccgagggcacctggggcatcagctgacagccccctgaaatggaatgtcaccctgtatcccctttccctctcacctcaatcagaaataacttccttcttctcttgatggaaataattcattcctcccttcctcccttccttccttccattttttgacagggttttgctctgtcacccaggctggagtgcagtggcacgtccacctcctgcgctcaagtcctcctcccacccgtctgctgagtagctgggactgcatgtgcacgccaacacacccggctaatttttgtattttttgtagagatgggggtttcagcatgtggcccaggctagtatcgaactcttgagctcaagtgatccacccccttggcctcccaaagtgctgagattacaggcgtgagccaccatgcctgccagagagaacacttttcatatagaaggttttttttttttttttttttttttttaacagcttcattgagagaaatttcacctggataaagtgcacctgtcagtggttttcagtatctttacagaatctaactttataacatctgcatcaccctgaaaagaccctgcatactcacagtcactcccgttcccctcccctcagccacagccacccacgaagctacttgtgagctgccttttctgggcgtttcatagaaactggatgatgtaataggcagtctttggtgtctgacttctttcacttgatgtcccgttttcaaggtttgtcaccgtgtatcagtatttacttcccgtttatggctgaagaggaccccgctgtgtggacacaccacattttgttcatccattcatcagttggtggacatatgggttgtttccacttttccttttttttaaaaaaaattaatatttaattttttaattaaaaaattttaaattaattaatatttaattttttttttcccctagagggagtctcgctctgttttctttttcccgagagggagtcaggccaaagtgcagtggcacaatcttggctcactgcgacctccacctcctgggttcaagcaattctcctgcctcagcctcccgagtagctgggattacaggcacctgctaccacgcttggctaatttttgtatttttttgtagagatggggtttcaccatgttggacaggctggtcttgaactcctgacctcaggtgatccacccgcctcggcctcccaaagtgctgggatgacaggtgtgagctaccgcgcagggccgtttccacttttcacatgctgtgaataacgtagcatgaacagttatttacagggttttgtgtgggtatgtttttatttctcttagacacctaggaatgcacggctggctcatatgggaactccatgtttaagtttttgtggacgtgctgggctgttttccaaagaaccggccgcattccacattcctgcctgcccagtcccaggattccaatttctctaccttcttgtcaacatttgttattgtccattaaaaaaacaaagctcgcatcccggtgggtgagaagtggctctccttgtcgctttgacgggcatttctctaaggacccgccatgctgagcatctcctcctctgctaacctcgtcgtctgtaagtcttctttcaagaaatgtctctccctctcctttgccctttttttttttttttttttttccgacagggtctcgctctgtcacccaggctggaatgcagtggtgcgatctcagctcactgcaacctctgcctcccgggctcaagtgattctcctgcctcagcctcccgagtagctgggactacaggcgcacgccaccacgcctggctaatttttgtatttttagtagatacagagtttcaccatgttggccaggctggtctcgatctcctgacctcgtgatccacccgccttggcctcccaaagtgctggcattacaggcataagccactgcccccagccatttttgcccatttttcaattgagttgtcttttatattattgagttgtcttttatattattgagtcgtaagagttctttacgtaaggatgccagtctcttaccaaaggtatgatttgaattttttttgtcaatctgtgcactgacttgttattttctttatggtgtcatttgatgcacgagcttttgaaattttgatgatgttcaacttatcaatctctttgatcattgtgcttttggtgtcctagcgaaaaccattgccgtgatttatgcctgtgttctactaagtgttttatagctttcgctttttgtttgccctggtgtgcggtaagggtcagtcttcgttgtggctctcctgttgtcccagcactatttgttgacaagactgttgtttccccagtgaagcatcttggcatccttgttgaaaatcagtggaccattaacataagggcttatttctagagtctcagtttgactccactgatgtctgtccttgtgccagaaccacactgtcttggtgagcatagccttgtagtaagttttgaccgcactgtcttggttggcgtagccttgtagtaagttttgatcgtgctgtcttggttggcatagccttgtagtaagttttgaccgcactgtcttggttggcgtagccttgtagtgagttttgactgcactgtcttggcgtagccttgtagtaagttttgactgcactgtcttggtgtagccttgtagtgagttttgaccacactgtcttggttggcgtagacttgtagtaagttttgaccacactgtcttggtgtagccttgtagtaagttttgactgcactctcttggttggcatagccttgtagtaagttttgaccgcactgtcttggtgagcgtagccttgtagtaagttttgaccacactgtcttggcgtagacttgtagtaagttttgaccgcactgtcttggcgtagccttgtagtaagttttgatcgtgctgtcttggttggcgtagccttgtagtaagttttgacctcactctcttggttggcgtagccttgtagtaagttttgacctcactgtcttggttggcgtagccttgtagtaagttttgatcgcgctgtcttggtgagcgtagccttgtagtaagttttgaccacactgtcttggtgagcgtagccttgtagtaagttttgaccgcactgtcttggtgagcgtagccttgtagtaagttttgatcgcgctgtcttggttggcatagccttgtagtaagttttgaccgcactgtcttggttggcgtagccttgtagtgagttttgactgcactgtcttggcgtagccttgtagtaagttttgactgcactgtcttggcgtagccttgtagtaagttttgaccacactgtcttggttggtgtagccttgtagtaagttttgaccacactgtcttggtgtagccttgtagtaagttttgactgcactctcttggttggcatagccttgtagtaagttttgaccgcactgtcttggtgagcgtagccttgtagtaagttttgaccgcactgtcttggcgtagacttgtagtaagttttgaccgcactgtcttggcgtagccttgtagtaagttttgattgtgctgtcttggttggcgtagccttgtagtaagttttgaccgcactgtcttggttggcgtagccttgtagtaagttttgacctcactgtcttggtgagcgtagccttatagtaagttttgaccacactgtcttggtgagcgtagccttgtagtaagttttgaccacactgtcttgttgagcgtagccttgtagtaagttttgaccacactgtcttggtgagcgtagccttgtagtaagttttgaccgcactgtcttggtgagcgtagccttgtagtaagttttgaccgcactgtcttggtgagcgtagtcttgtagtaagttttgactgcactgtcttggttggcgtagccttgtagtaagttttgacctcactgtcttggtgagcgtagccttatagtaagttttgaccacactgtcttggtgagcgtagccttgtagtaagttttgaccgcactgtcttggttggcgtagccttgtagtaagttttgaccgtgctgtcttggtgagcgtagccttgtagtaagttttgaaattcggaagtgtgagtcctaatttgttcttttccaggattgctttggcctctgggtcccttggcttcacaagaatttttggatcagctcatcaatttctccaaaaagggcatctgtgattttgattgtgaacatgggatgtctttttgcttatttaattctttaatttctctcaataatgttttatagtttccagtaataagtcttaatgcttcttctgttaaatttattcctaaatattttattattgtccaagctattataaatagaattgtcctattgatttcatttcaaattgttaatgactggtatgtagacatacattgtcttttgtagattgatcttgaactctgaaaccttgctaaacttctttattacttttaatagttttttagtggatttgtcatatacgagaccatgtcatctgcaaaaagagagttttacttgttcctttccaaactggttgccttttatttcttcttcttgcctaagtgccctggctagaacctccagtacaatgttgaacagaagggacaatgggggacatccttgctttgctcctgatcttaagacgagtccactgatcttagggaacaagcctttcaccattaagtgtgatgttagctgtggggcttttataaatgtcctttatcaggttgaagaagttcccttctattcctagtttcttgagtgtttttattgtgaaggagtggtagactttgtcagctgcttctcctgcacttattcaaatgttcagatggtctttgatccttttactattaatatggtgcattccatcaattgaccttcgaatgttaaaccaactttatgttcctgggacacgtcccacttggtcttggtgaataatctcttttacatggtgctggattcactttgctagctgttttttgatgatttttgcacctatattcatgaaggttattggtctgtggttttcttttcttgtaatatgtttgcctagttttggcaccaggataatactggcctcataaaatggcttaggaagtagttcctcctcttatattttggaagagtttgtaaaagagtggttttaattcttccgtgaacatttggtagaattcaccagtgaactcctctgagtgtggacttttctttgtgtgatgtttttaacttactaattcaatctctttatgtgttataggtctatttatattttctatttcttctccagtcacctttggtagtttgtgtctttctaggaatttgtccattcatctagatcatctaatttttttagcatacaattttctctaggatttcctttgagttctttttctttttgtaagattagtagtaatatcctctctttcatttctgattttagcaatttgagccttctctctttttttccttgatcagtcttagctacaaggtggtaattatttttgttgctctttttcaagaactgagtttggtttgttgacattcattgtttttgatttctcgatctcatttatattctaatcttcattctttccttccttctgcttgcttttggcttgtctcagggaaagcatccagtctttcccactgggtatgatgttagctgcagggtttttgtaaatgtcctttcaatcaaagaggttctctttgattcctaacttcttgagtgtttttattgtgaaagggtggtttgctcttctttttctagtttactacagtgggaagttacgttaataatttcagctcttctttattaatataggaatttatagccatcagagtgcgtttctatcttagaaaattagtaacacattcaaaataggtttgattacccaataatgcattgctcattgttgaacaattttaaaattcaagataagtataaggaaagaatgttattcataatttcacctcccggagttaactactgttaacaacttactatgtttccttagagatttgtttaaggtagaagctgtttccatattcaatagcccttactttctatgcacgcaggacgctatttttcttcacaatcacccgtttcacttgtcgatacattgcctctgcaacatcttcccttttccacatctccacgtctcccttctctttgggatagttgttatttttttccttttcaattctttttttttttttttttttttaatttttgagacagacatttgctcttgttgcccaggctggagtgcaatgaggcaacctcggctcactgcaacctccacctccctcccggattcaagtgattttcctgcctcagcctcccgagtagctgggattataggcgcccgccaccatgcctggctaatttttgtatttttagtagagacaaggtttcaccatgttgaccaggctggtctcaaactcctgacctcaggtgatccgcccgccttggcctcccaaagtgctgggattacaggcatgagccactgctcctggcctttccttttaaattatttccaccaaattgaactccccaggcttgggacctggtgctggccctggctgggaccctggcagtgccctggtgggtggcacaccctgggcggaggcacgggccagcctgggtgcagctctgcccccggggcctcctacctgcatctggctggagacagatgcctctttctggacttctggcccagaggtgacagctgaggtcacccaaatgagcagcatcaggcctgcgggggacctggcagtgactggaggcctcgagggccccctcctgccaagctcctcttgactctgtgttgttttcttggctcacccacccccattcccaacgccaggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaagtgagcgcctgggtggggctggcgtgcaggtgggtgggtgggcggcgttcctgggccgcagtggccatgctgtctccagggtctcgtggacagtgtggatgatgggctggtgcacagaggcgcgtcactcatatcctggtggagtgtgcacagccactctctgtggtcactgctgcgtctcttgagctggcgtgagtctgtctcttgagctggcgtgggtctgtccttgtggctgctggggacccgcggtgctgtggatccacaagggccctgctcacggtgctgctgcggaggcagcctcctcccgcagggcagggatgttggtgtcagcctcgttccttctgcgcaggcgcagcattattcatgggctcactgctctacccggggagcgtgctggggccgctgctgctcagggctgtccccttgtcaccccaagggctctgcctgtgtctccctgttactgagcaaaagggctcgctgcccgatgtgcaggaggccaatactatgacaccaggtttttgagaaaagaaaagcttttattctaggccaacccacaaggagacaggggcgcagttcacgtctgtctccccgcgctggctttaatgcagtgtttctattagggaaggttcgggggtgggttcttggatgagtaagtggctggtggaagaaaagggggttctggaaagttatgtctcctcataggtctcgtgtgcacatttgggcggagttactgggaccctggggtggaaactcgggctgtgcagactccagctggccacagtggttccagctgtgacctcagccagttccaaaagctcctgcaagcgagtctcagcatcccagcaggtggcttcttttcccgtctgccatctgtaagtgtgagcatttcggttagttgctgggttctttagctctttggggccggttccccagccctagacgtgttcctgctgcccccaccgtgtgcctcagacggcgctggctctgcggtgccttccccagagctccgatccatctgtggacggctctgtgtctgccctcccgtgccattggggtcttcctcatctgcacgtcttcacgtgctttgctggttttgtggatttgcacacacgtgtccacctcctctgggcctggtgtttgtggcatctgtggcagtttgaataacagccccagggaggtccacactcgaaccctgtggctatggggccctatgtggcaaaagggactgggagggtggggttaagtggaggatcctgaggtgggaaattatctggggttatctgcatgggcccgacatcatcatgaggggccgtggaagagggaggcggagaaggaatgtgacggtggcagtgagcgtcggcgggaggggagagcctcagcccaggaatgcaggcagcctctggaaggcaggaaaggcaaggcatggaggctcccgacctacgggaggagcacagccctgccgaaccttggttttagcccagtgagactcctgacctccaggactgagagaagagtctgattgctttaagctgccaaggccgtggcggttcactacagcagcatcaggagacccatgcagtagctgtttcttctctttgaaaatgtctaggattttctttaaatcctagtgtcttgaagtcttatcatagaacttttggaatgttatttgctattgttgcttttgaaacaaggagtacaaaataggtggctgtccatccggcccctggtggacgtggtcctctggggtcgtatctctgatcagccgcagcagctgtgggccccaggctttgggggttctgttttgctcttgcagcttttaaacttagaacaaattaaatgctgaggacctcacaccagaggcagcataaaaaagaactccagggaaccaggaggccacgcagaatgaaaacacaggtgtttggggtcctagtgggccccagggttggctctgggggttctgtggccaattcctagccctgacagtggagctgaggagcccagcacggctgcggagctgtcatggtccacagaaagcccagtctccccacgttgcccccataattcagaaagcctcccaggccctcagagcccttcccagcatctgcagacagaccctgtgctacccaggactctgaaaatccttgtgttcctggttttgttaggaaccaaccgtttctcttcttgtttcattggctaagttgctgaggttgccacctttcagaacgtgggttctgaacattgagagaacccgagcatgggccaggactgtcatctcgaggccaaggggctggtggcaggacactgtccctgcagcaagtatggcacccacacttccggctcccactgcggagggctctgtgcctgtcaccctgagacacaccaaggaggcccctgcagccctgccccttccacatgcacccctggagggtctggctcttgtgctcgtcagaatccacagatcaggtcctagagttcagtgccagacagtgtctgtctcctgataaacacccacttcgtgttattagccagtgaggcttataatatcgaaagtctgtgtgcttctccttttttcttgctttggttcccaggaagcctggaattgtgaggtctgtgggctgagttctgtgcctggagctggcctcccgtgtggcgtggctctgctctctgtggcatcacagtgggcacgtgggcatggctctgctctctgtggcatcacagtgggcacgtgggcatggctctgctctctggcatcacagtgggcacgtgggcatggctctgctctctgtggcatcacagtgggcacgtgggtgtggctctgctctctgtggcatcacagtgtgcacgtgggcgtggctctgctctctggcatcacagtgggcacgtgggcgtggctctgctctctgtggcatcacagtgtgcacgtgggcatggctctgctctctggcatcacagtgggcacgtgggcatggctctgctctctgtggcatcacagtgggcacgtgggcatggctctgctctctgtggcatcacagtgggcatgtgggcatggctctgctctctggcatcacagtgggcacgtgggcgtggctctgctatctgtggcatcacagtgggcacgtgggcgtggctctgctctctggcatcacagtgggcacaagggcgtggctctgctctctgtggcatcacagtgtgcatgtgggcgtggctctgctctctggcatcacagtgggcacaagggcgtggctctgctctctggcatcacagtgggcacgtgggcgtggctctgctctctggcatcacagtgggcacgtgggcgtggctctgctctctgtggcatcacagtgggcacgtgggcgtggctctgctctctggcatcacagtgtgcacgtgggcgtggctctgctctctggcatcacagtgggcacgtgggcgtggctctgctctctgtggcatcatagtgggcacgtgggcatggctctgctctctggcatcacagtgggcacgtgggcgtggctctgctctctgtggcatcacagtgggcacgtgggcgtggctctgctctctggcatcacagtgggcacgtgggcgtggctctgctctctgtggcatcacagtgggcacgtgggcgtggctctgctctctgtggcatcacagtgggcacgtgggcgtggctctgctctctgtgacatcacagtgggcatgtgggtgtggctctgctctctgtggcatcacagtgggcatgtgggcgtggctctgctctctgtggcatcacagtgggcacgcaggcggtgagaggggtctgttctgggtaaacaccctgacctcgaggtgttgctttctcctccctgacagctacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcagtatgccagccccagtgcctctcctgaatgtcctggccacccgggtgcagagggggtggagatggcatggcagctctgcccagaaccctggacgctcagcaggcgtgcaggtcactcaggctgctggccttctgctggccttgagcaagtggtgggggctgagcccagaggcccccttgggggcaggtgtgcgatgggctcttcctgccactcaggactggccccctcccacggggcccccccggtgggtcagggcttcagggcccacctcctgaggattccaggtcccctggtctgtccgcccaccctgacagagaacaagctggagaagaacgaggaggcggccctgctatcctgggagatctacctgaaggagaactacctccagaaccgacagttccagcaaaagcagcggcccgagcagaagatcgaggacatcagcaataagtatgggggctccggtgggcctgggggcgggaagcctctgggggacctcctgcaggtccacaggcaccatgagtacatgtcccacctggggaggcccagcaatgcctcaccggtgagggagcgctgtatcccgtggcccctgcaatgctgcaggcatccgggcctgtgcccacagctgacccaggaccctctgcggtccttaggaaggctgggccccacagggcgcagggtcagaggctgggagggaagccttggcggctgggggaggggcaggttggcccgcaggatccggcttggaggcctgggggcatgtgcacacggggtccaggctggtttgggggtggtttgctctgtgagcttgttggtgcacagccttattatagcttctgcaggacctcggcagcccagccctcggggtcagccatgctcagcaccgtcctccctctcagctcctcccatcttgcttctttccaaggtgcgaggtcagtgttgggggaacatctgctcccttctctccactgccaggccttccgccctgctaggtgtcagcagggcctaatggcccagcagcgggcagcaggaagggctgcccccagtgtcctgctctcagtgtgcgtctcaccatggcatgagaggaggagggggaaatggacacggtgccacctagttatggccgtgtggaggctcctgcagccacaaacaggagcatcctggagctggcaagggatggccaagaccaggccaagtgccctcccccttagagacatgtatgtactcctgcctttccatacctccctcaccttgtctgtaagatggagacacgatagtccctgtctcttggagttgtttccagaatacagtggggtcctgactgtaaagaattgagcacatatgctggaactataaccagggatctgctaacgtggctggtgcttttatcatcacccttacttatgagtagtgggggcggtggtggtgatggtgatgatggtggctgcgatggtgatggtggtggtggtgatggtagtggtggtagtggtgatgttggtgatgatggtgatgtggtggtgattgtgatggtggtggtgttggtgatggtggtagtgatggtgatgatgatggtgattctgatggctgtaatggaagtggtggtgatggtggtggtgatggtagtggtggtgatgttgatggtgatgatggcagtggtggtggtggtggtggtgatggtagtggtggtgatgttgatggtgatgttggcagtggtggtggtggtgatggtggtgatggtgcttctgatggtggtaatggtggtagcggtgatggtggtggtggtggatggtaatggtgatggtgacagtggtggtagtgatggtagtggtggtgctggtgctggtggtggtgacgatggtggatgtggtggtggtgatgatagtgatgatggtgattatgatggcaatagtaatgacgatggtgacaatgtgaggaccttaatgaactagctgatgtcaaagccccttctagctcccattctgagtgaactagatacacgtgtcctgtttgcttgagtctgggcatgatgacttccagttgagcccttggcatgctctttgcctagaacagtcttctcccagagagagtcaggacttgctgtctctctctattcaagcctcacttcattggagggcctttcctgccctccacccaccctgtccccatcccctgtcgttctggaatctggatgttggttggttggctggtgggtttgtgggttgtgtcatgtctaactgccaggctccatgtgagagtagggacagagtcccacatgttccccatagtatcctgggatgtagagcaggcccagtgcctagaaggcactgaggaaatcctatgcaattctggaactgctgttagttcctggcctggcagggttgcaggaggctggggtcgctggtctccaggcctgctcagccctgacgtttggctctgatggtccacttacagaggaggggggcctggggccatgcagtgccctgacaaccttctcttacttgctgttgccaagtacagctttgatggatggcctcgtctgggactttgagcagtggccatgcccagggcccagatgctgggggaaggtgcttgggagagtttctgaaaggcggcctccgcatgtcaggatgaagctggaaggccacagctctgctgatgaccaacatagtcagggctggaatatgatggctggcatgtgttaagggctcattgaggaccacacccttcacctgcatcatctcgctcaacccttttgcagagggaggtatttttccttccacttttacccatgaggaagtggaggcccaggaaagtgagagaggtggctcagcttccaccactggccagcggtgtggcctggaatgcaggccccagcaactttgcagcctcctgccttaagggagtgggctggaccccaaatgaatcagtcccaggccgggcgcggtggctcacgcctgtaatctcagcactttgggaggccaaggtgggtggatcacaaggttaggagatcaagactatcctggctaacatggtgaaacctcatctctactaaaaatacaaaaattagccgggtgtggtggcgtgcgcttgtaatcccagctacttgggaggctgaggcaggagaatcgcttgaacccaggaggcggaggttgcagtgagctgagatcgcgctgctgcactccagcctgggcgacagagcaagactccacctaaaaaaaaaaaaaatttagtcccaaatgcctctcagctcctgccctatcccagacatcttaaagctcagagctggtctgctgcctatttcccagcctaggtgctcagtggaagttgggcgcctccagttattttctgaggttgaaaaagcttaactaaaatataactttgcaggccaggcacagtggctcatgcttgtaatcccaacattttgggaggctgaggtgggaggattgctcgagcccaggagttcaagaccaacctaggcaacatagtgagacccccatctctacaaaaaataaaaataacaattagccaggcacggtggctcatgcctgtgatcccagctactaaggaggccacagcaggaggatttcttgaggccaaaagtttgagaccagcctgggtaacatagtgagaccccatctctacaaaaaataaaaaaacaacaacaaaaaaggaaagagtagccaggtgtggtggtgcacatggggtcagagtcccagctgctcaggaggctgaggccaggggttcgaggctgcagtgcgccatgatggtgccactgcactgcagcctgggtgacagggtgagaccctgactctaatgcatatttgtatgtgagtagaagttttcccaagatgagcctgcagaacgtgtttccgctgggccgctggctggtgtgctgagctgtcactcccattggtcagcagctcttgctcatccgcagaggggcctgggacagaagctgatgtgcttcagtcgacctgatcttgcagaacacgggctccagggaaagtgaggaaagagctcctcagcccgtaccaagggccctagcctggtcaccgtcccctcctccagtgaagaagctgggcacctgggaggcgcatgagtgtggggtgccataaccttgcagcactgaggtgagctgagttcaccaaagctcctcgcccacagggcagggctggagctttgggggtcaaggacaagctctgtctgcaaatctagacagttcctgcatctcacggtggtggaatcacgcgggtccgagaaggctccagtaaccaccctcgcatgtttgcaaggctgtctgggaaaacatggcaggtgcggttaagcggcttttgtgggattaagcaaaatgaaatgtgggtgaaaggagatgcccaggcctggagcgaaatcactttcttccctctccctagataactgtttaaagtgggtcatatccccagaaagtttctgtgttactaaaatagttgctcagtgtattataagaatatcacttgcagtgggcgctgtggatgaaaggaagtgagggagcccaggggacagcggatgagagctggagactcgggtttgcccacagagttattttaaccataaacacagcaggccgaggctgggcgaagcaaaataagacagaaaccaaacatttccagaataatagcgccgctctacaaccccacaaaataagacagaagccaaatactcccagaaaaacagcgctgctccacaacccccacaaaatacgacagacaccaaacatccttagaacagcagcactgctccacgacccccacaaaataagacagaaaccaaacatttccagaataatagcgccgctctacaaccccacaaaataagacagaagccaaatactcccagaaaaacagcgctgctccacaacccccacaaaatacgacagacaccaaacatccttagaacagcagcactgctccacgacccccacaaaataagacagaaaccaaacatttccagaataatagcgccgctctacaaccccacaaaataagacagaagccaaataactcccagaaaaacagcactgctccacaacccccacaaaatacgacagacaccaaacatccttagaacagcagcactgctccacgacccccacaaaataagacaaaaaccaaatattccccaagcaacagtgccgcgccacatcacccccaaaacaaaaccaacctctgctgtgcccagaggaagtttcattgtttgtgacctgtcacctggccctccctcagttcactcacctccccctctctcctgggaccgacaggctgccagagcttgccatgtgagcctcggctgtccgtctgctgagacatcttcccctctggggccctgggcagtttggttctatgggagaaatgcatgttagaaatagtttcatattaagaggaagcaaaggctgacacagggccttggtggctgcatctggcagggctgtctgcagagcggtgtggcgttcccagggccccaaggtgtggtgtgcgtccagctcagctgcttcctctttcagggttgacgccatggtggacctgctggacctggacccactgaagaggtcgggctccatggagcagaggttggcctccctggaggagcaggtgggtccgaggtcggggcctccgtcaggaggtgccactgctgggcctggtgggcggctctgccatgtggtggcaccaagaaggagggctctgaggagtgatggtgaggaggaggccggaacgttggggcagccattcccagctggaagaggcaccctgtgtgtcctccagaaaaccccgcccaagggtttctgtgactgagttccttctgtgtgcactgaggcctccacggccgggctgtgctcctcgctgctcccaggaaacagagtgcttctcccctcccggcctccagggaggctgtgggactctgtgcctgagccctggagaggccgcaagaccgaggtggggaggacttagagacggcctctcagggtctgctcccaccaccccatcaacgtccaccagctgggccgggctgtgctgtccaacaacagcacctgcggccacggcagcccctgcgggcagtgctgagccctgtggatggctcagccaccctgtgctgctgctcccagccttgctctgtggggcagggctgggacctgtgctgctggggcatccaccatccaccagtcctgcccgttgcacccaggggtctgcccaggccgccctctacccctgtcttggccatgctgggacccctgacagggtgcccagcactgagccacacgagtgagacatgtcccactgtcccctgtgggaggcgcatcagcctctggggaggctcctcctgggaggtgcaggaaccctggaagcctctggctttggcggcctgtgacctctccctgtggtgcagaattgcctgactgtgccttcatgctggctccatcctctggcttgtccagtgcagtgacagtcccactgttgtgtctcttggggaggctgcaccatcagatgtgtgacttggcagcccccggggggagccgggtgggcctggggcagcgttctggctggcttggtggctgcctggggaggacgtggtgtctcactttcaaagggcgcaggggctgagtgacaggggtggggctcctggctgggggagtgaagtctcggtgggcagtggggtgtgtaccatgcgtgtgggtggcaggtgctcactgtgtctcgggccatgccttccaggtggcccagacagcccaagccctgcactggatcgtgaggacgctgcgggccagcggcttcagctcggaggcggacgtccccactctgggtgagtgggtggccaggccagcagctggtctccagccgcctgtttcttttgggtctggggtcagttgggaggagaggcagctgggggtggggggctctgtccaggaggaaggcactggctgcagcctgttccaggcagggccagcgccctcaggaactcagcccacccaccgacgctggcgccgaggccccgcccaatccctgacctgacctggttcctggacgtccacggggaggcctggcctgctgtgccctgagctccccacataccgcactgcagagtgggggtgcgaggcgggcggctgcagactgtgtctgaacctggtcacgtaggctgagtgacgagaagcaaagtctgttttcctaaattcgcagccggctatgaaatgcacatcagtagccttcctcgggctgctgagtttcgccggccctcaaggagcatatttgccctcgtaaccgcactgcgagttcagctcattgccgagggccctgactgccgctgcacaaagaggcaggtgccggcggggacgctgcctgagctcccgtggctgtcctccctgggggccctgcccacttcagagctggtgttcgacctgcatggccatttgggctcggggaggtggaggagcccagatgttttggcggaaggaccacagaggaagtccttgtcctgcgggcgggcacctgagcccgggctccgccttgcgtcacgtcttcctgactgtccccagcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggaggtgagcgcctgcccaagcccaaccaggcggagtggccgggcccctggggaggggagggcggccctgtccccatccatctggtattaatcctggctcccagccactgcagccacagggggatctgtgcgtctggcagcccctgtttgacatttgaggaaaccgaggcacagagaagtcaagtcacaggggcctcacagctggaggtggtggaggggcctgaggggggcacactgatccccacagagctcgaggcttaggctcctcccatgaccatcccagggcccagccccccggccccattcccccaggtcatgccctggtcctagaccccacccaccccggtgaatggctctggcccctttccaggtgccaggcatggaagagagacagagacacagagacagagagatggctaatggcccctgggagacccccgccctcctggtgcagggcttctctctggcctatccagaacattccaggctgctgcttccgctgcctccccttggtctctaccacatagaatcctccttgcctctagggtccagcttagccccctgccccactctgggaagacccccaaggcccccaagtcacggccacctgcccttcagctggccccagggtgggggtccctgatcccagcccccggccctgcccagcccccagctctgcctggcacccggatctgcccagcttggagcttctgccctgcatgttgggatgttggggtcgggttcagacccagctgagcagccctttcaccctggtgcctggcccagctttgcagtgggggtaaaaatctgagggaaaactccctgttttgcgacagacggagttcctgatctatgacccacccttttacacggcagagaggaaggacgcggccgccatggaccccatgggagagtgagtatgagccgctgtccgtgctcccagctggccccaaacccagggcctcctaggggctcccttgagaatcccagtcagagcccagcccggggaggtccaggtgagcaggaggggcccgtgggggcctgaaggggcccagctcctactgttgtgtacacccagcctgcagctactcggctgggcccttggtgggggggtgatccctctgcctgtctgctctgtcccacctgcaacacgggcacacagacacgccttctcctctgctcccagcaccctggagccactgtccacgatccagtacaacgtggtggatggcctgagggaccgccggagcttccacgggccgtacacagtgcaggccgggttgcccctgtgagtgtgccccctgcgggccccgccccgtcagcctttggggtttgcctggggggcaggtttcctctctgggcaaaggaagcatttttctcataaaacaaaatcaaaaaaagcacgtgagccaccgaaaggaagaaaacatcaactcactgcatctccgtagcccccaggactgggcttgggggcgtgggacttgccccctggcctcgggcaggccctgccccatggtccctgccgtaatctggggacgtggatttgtctgtgtacgtggggatggctgtgctgggagaggacgatgcctcagaggatgggcaggggctgtgcggcagggaggggacacggagatgggcactggcaggcttacctggccgggaaggtggcctcgcctggcatcctgttccccacaggatcggcgctgcacccatcacacaggtgaggaaacccaaaataaaggtgtcaagtgtcctgtgagcacctacaagtgccctggaaggaaggagcctgggagtcttggaccctgccatgaggaggaggtggaggaggggccaccagaacctgggactggggggttgccgggatgtggggcatgaaccatggagcagaggaaccaaagggtctgaaggacggggggactgcgtggcaggcctttgcagaatgctctggaacagggtgtgggctcctctgcctggagccggaggttgagtaaggaggtggtaggaggcgatggggcctgagagcagaggtcctggccaggtggctgcagctgcaggcggcccgctctggtgttgggggtatgtgggacgggcaagggcgggtgtttagggaggtgcatccggtggctatgggaagctgacgaggagagcagcaggtgcctggcatgggcaacaaggcgtgagcacctgctctcacgggtggctgccacacaggcaggtgtgtcaggacttggcaggacgtggtgtccatgcgggctttagtagtgcagaagagcactttctgtatgcaccatgcttctgttgtggacttgcgaatcatattttcattatatttccttaggtgtgttctctttctatgaaattataaagacacaccttcctatattcatttgatacattttaaaattagtttttttcactgagactttaatacagctgaaggctgattgtataaggtgtgaggaggggcctgatttattttgtgaattcacagagaaagtgagctgcctgacttcatttcctgctaagatctggcccctcccctgaggtgtggctcctccctgaggtgtggctcctccccttaggtgtggctcctccccttaggtgtggctcctccccttaggtctggcccctcccctgacgtgtggctcctccctgaggtgtggctcctcccctgaggtgtggctcctccctgaggtgtggctcctccctgaggtgtgactcctccccttaggtgtggctcctccctgaggtgtgactcctccccttaggtgtggctcctccccttaggtctggcccctcccctgaggtgtggctcctccctgaggtgtggctcctccccttaggtctggctcctccctgaggtgtggctcctcccctgagatgtggctcctccctgaggtgtggctcctccccttaggtgtggctcttccctgaggtgtggctcctccctgaggtgtggctccttccctgaggtctggctcctccctgaggtgtggctcctccccttacgtctggctcctcccctgaggtgtggctcctctttcaaagctctgtatgcctctgtcccagtcatctcatagcagatcatgccactatttgccacagcgttgcagtaatcctgactctgggatagcatgtctttaaacctgccttttctagtcttgagcctttagcttttttgtgagtttaaaagccagtttttctagctccatgacaaatccattgataagaattgtattaaatttatagaaaaatttgagacaatggacacttttatgataatgagtcttctatgactgtatttgtcaacatttatttatgtcttctctttgtccttccctaaagttttataattttgttcataaagatcttacatttttaaataatatttattcctcaggtatttgataacttttgttatttggggtaattataacatttttttctttttcttttttttttttttttttttttttttgagatggaatttcacttttgttgcccaggctggagtgcaatggggtgatcttggctcactacaacctctgcctcctgggttcaagcaattctcctgcctcagcctcctgagtagttggaattacaggcatccaccaccatgcccagctaattttgtatttttagtagagatggggtttcaccatgttggccaggctggtcttgaattcctgacctcaggtgatccactcgcctcagcctcccagagtgctgggattacagacatgagccaccatgcctggtgtataacatttttttatattttcaatttttaaaaatatatataggggcattattaattttgtttgctgactttgtatctaacaactttattaaaccttctcgttaattatataaatgtgtttgtagattttctatgtaaataatatatattctgcaaataacaatattgtctttctccttacaataatcatgcctcattcctttttcttgccttattgtgctgggtaaattcttcagtgtaatttagaatattggtaatattaacaggcttccttgtttctgacttaatggaaatgctatcaacatttcaccattaagtatggtatttactgaagaaatttataaataccttttattggattaggaatgtttctatctagtcccaatttgtcaggggctgaatgctactaaatggtttttctgccattgattgagatagttataagatgtttcccctttagccaattagtgtgtgaattatttttatagctcctttagtgttgagccatccttgcattcctggaataaactcttctgttatatttaacgtactgctggagttaatttactaacattttacttaagattttaaaaaatctgtgttcaaaagtggaatttgcctataatttatatttcttgtactgtcttactttggttttggtatgaggttataccagtctcaatgaatgagctggtcagctttccttcttttctcttctttacaaagaagagaatgtttgtatgaggtggagataattatttgtttcttaaagtctgataatacttagctatataactgttagctctaacatattttgagcaagtggatttctttttttttttttttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatcttctgacctcatgatccacccgcctcggcctcccaaagtgctgggattacaggcgtgagccaccgcgcccggccgagcaagtggatttctaactactttatcttccataatgatttttcgaatcttatttcctgtttcttcttgggtcctttttagtaattgtaaattttctggaaaattataatttcatctaacttttgaaatgtattgtgtcacagatgtccataatattcttttatgatttaaaaaataatataaatatatagtaatttctcttttgagcattgatatttattatgtatttctcttctttttttttttgattattcttgccagtggcttaattttataatcttttcaaaaaactaacttttggatttgttgattatcttaatttttcgatctcatccatttttgcttttattgttatctttccttcctttctacttcttatggatttgctcttgatttgtgtgttagagctcatttttattcaactttcctggttttctaataagggtacctaagactgtaaattctctctaagacctggtaggctgtaacccttaaattttgatgtgtagggattttattttttactttatgaatttcattataatcttcattttacacttttgttttgctcttttttttttttctttttgtggagaatgaggtcttgctctattgcccaggcagatcttaagctcctgggctcaagctatcctcctgcctctgcctcctcaagtgctgggattacagatgtgagccaccacgcccagcatagtcttcatttgattgtttagtgatgtacttttagctttttttatcttgagatggagtcttgctctgtaccccaggatggagtgcagtggtgcgatcttggctcactgcaacctccgcctactgggtcccagttcaagcaattctcctacctcagcctcccaagtcactggaattacaggcacgcaccaccatgccagctaattccttttgtatttttagtagagatggggtttcaccatgatggtcagcctggtcttgaactcctgacctcgtgatccgcccgccttggcctcccaatgtgctaggattacgggcgtgagccactatgcctggtcatgtgcttatagtttttaagccattctttgttatcaccttctagttttattgcatttttgttggagcgggattggcaacacgctgattcttgaaattgaaatgtcctccgtggcccgtctctaccctgggttgttgcagctgtttggctgtaaccctaaactaacacctaacccctaaccttaaccctaaccctaatcctaacccctaaccttaaccctaaccctcttggcccattcacaacagcagcctgtgtgagcttgtctgactcaagtcattcacacactcagatgccctttctggtataggagtgactgtccccacgtctgtctggggccagccccctcactgtattagttttctatggctgttgtaactaagtaccacaaactggggggcttaacagaaatggattatctcacagttctgagggccaggagtctgaaatcaaggaccacactccctctgagggcttgaggggagacctcttcctgcctctccagctcctggtgttcctggcagcccttcgtgttccttggcttgtgatctctgcctccctagccacatggcctctccctgcacgtgtctgtgtctcttctgttcttaggattataaatcgtactgggtttagggccaaccctattccagtgtagcttcatcttaactaattacacctgcagacactatttctgaacaaggccagattctgaggttctgggaaggacatacatttgtgggcattgttcaccccagtgcatctttgtgctagacccatctcccattgcctttcaaggacctcatcccgggaatgtcctgctcctcctgcacccgggtcctcctgccctcttgcattgctcctgccaacataaactaaacaagcccctgcccgcaagtcccttcctctttcgaatccactccacttgggctttgcttgccccctctttctgagatggattgaggtcaggtcagcaaagattctgccttgttcaacccataggccagctctccacccctcaacccacctgcatttctggagctgagtggatgagtgaatgaacgtgtgattgctgtagccagactgtcgctgtttttgcgctttggggttgtgtgcgtaggtttatggacgggcctatgccttgatgtcgtgatggaactaccgggcacgtggcagggagatgaggggttgagaaccatatggacgagatcatgaccgggggatcagagatcagggcacagtgagagcagctgaagactcaggtgtggggtgggggctgcggtgggaggagggcagcatggtggtccgaagcccctgctgcccggcccgctcaggctgactgagaagcaagggtgcagagtgtttgtttccctcctggcagaagcgagcgtgcatgtggtaggagctggcaggcccctaacctccctcctggctctgccactggccgactagggatggggacagtgagatgacagcagggccctggggcccagagcttcctgtgggggtggactcatgccaggcagagcgtgtggcctcctctgtgagcttcttgaccaatgcactgcactcagcacgaacagcagttacagggagacgaggcagccttgctcccagcagcacgacctctgccttcctctccttctggagctcagtgcagctctgcccagtgccgaatttgtccgtggccttggttctgggttctgcccgctcagtggcgtgagtgcaggaaggagaatggtggctggcaagggcggggtggacgggagtgagagacgggcttggggttgaggggaggcagcagtgaccctcgcaggaaccctgactgagccccggccttcgagctgaggtccccaagccttgctgcatgtgttgccagctctgtagctgggtggggccggggctctggtttctgagcagcttctggggaggctgcctgggccccaccgtgcaaggccccccggccacagaggagaccgcagagtgagctgggagggctgtctgagaggcctggccaggtgggccctacacactgggcatgttctggtgcggactctgatcgctgtgggctcgggcaggtctgcgcagaggtgtgacgagagctgggacccctgacagctgggcgggaacagggtggctgctgaggggtaacagagaggaggggctgggtggaggcagggaggccagctggaggctgccccgccaggcagggtcagggacggtagcgcaggcctggctggtggccgccggtgctagaggtggtcagctgtcctggggcagccacggtcagctgtcctggagcagccacgcactgccgcgcagactcaggaggatggagtctaggctgtggggagaggaggccatgaggggtgggtcagaggctgcagctctgatggggtctggaggtcagagtggaatggtggaggaacgataccactgtccccactgtggcatggatggtggtggggactgtggtggggacggtggcggggacgctggcggggactgtggcagagacgctggcagggatggtgacggagactgtggcgaggactgtggcagggacgctggcagggatggtgacggggactgtggcggggacactggtgttgggaacgctggtggcggggatggtggcggggacggtggcagggatgctgtcggggactatggcggggatgctgctggggaccttctgtagacgtggatgccgcccccaccgcacgatagcggcagtgcatttcttccttctgttttagtggtacattcacaggaaatcgcccgtttctagaacttgctgtttcatataggacctggtggtgtcagggagaccagcctggccccatgggaagcgtctgtggctcctgctgcccgtggttagcacactctgctgggggtctgtgtggcctatcatctgtggccacacggacgcagggcctctgggtgtctggcctggttcccacactgcccctcggaaggctgccaggatggaggccatgctctcgcgtgctggggcctttggatgcaaagtgctggcccgagcagtcggccagttccatgctccgtggggagaaggtggccactttagcccctcgctggcctgcagtggccggacttctgctcccagggagacccttcccccaccaggtgaccccgagttaacccagagccttggtctcactccttgggggtcccaaagggatcctactccctaggccagagcaggtctctaaagaagcctgcatgctgtcccgctgtgcgccggctcctgacgcccgctgtcccctctcagtccccctccctgccctgtcctgctcccccattggtggacggtggactgactcaacccctctgcatcccaggaaccccatgggccgcacaggactgcgtgggcgcgggagcctcagctgcttcggacccaaccacacgctgtaccccatggtcacgcggtgagttcatgtgtgccgggcaccagcacctcagcaaggcggtcaccccaccttcacaaggggcggctgccattgcccagtgctcaggggccgggagggcggctttgatgcttggcacttggtgcctactggggggatgcgggaggcgtctgtggataaacgtgaatatgcccgaaatggggcaggaatgtccatgctgcccatcctggaggaagatcccaggacccatcccctctcccggggctgccttcactttcctgccggtccctgcccattagagggcaccctccacggggacacagccccacactcacccctaagtctcactcctccattcccatccacggggacacagccccacactgacccctcagactcactctccacacccatccacggggacacagtcccacactcacccctcagacccactctccacacccatccacggggacagagccccacactcacccctcagactcactttccacacccatccacggggacacagccccacactcacccctcagactcactctccacacccatccatggggacacagccccacactcacccctcagactcactctccacacccatccacggggacacagccccacactcacccctcagactcactctccactcctatccacggggacacagccccacactctctcctcagactcactcctccccacccatccacagggacacagccccacactcacccctcagactcactctctactcccatccacagggacacagccccacactcaccccctcagaccctctccatactcatccagagggacacagccccacactcaacccccaccacaggctcattcctccacacccattcacacacagggacacagctccacactcaccccctcaggctcactcctctgcactccagcagctggcccactgctctcacccaaggcacgggccgccttctgtgcaggtgcagacgcctgcgtccctgaggaagctgccgggggctcttgctgcccccattgggcaggaatgggattctggggcccaggcccagctgctgtgccctgtgctctctggggcctctgcctccacagctgggacctccccccagcggaggggcctttggcctcagggtcctcttgctgcccagccactctcacccagtggcttctctggccgtgcagacatggccctggggtgcgagtcactctctgctccccagtcctttggcctctccttggcctgcccaggtggcactcggcaccccacgtcacccccacgtcacccccgggctgcactctgcaccccatgtgacccccaggtggcacttggcaccccacgtcacccccatgtcacccccatgtcaaccctgggctgcactcagcaccccatgtcacccccacatcacccccaggtggccctcggcaccccacatcacccccaggctgcactcagcatcccacgtcacccccgggaggcactcagcaccccacatcacctcactggattcccactggcattttctaagagtggtcaaactgcaaagctgggtcaaagggcaggtacctctctaaggattttaatgtttaaaaaattctccatgaaggctgggtctctttctagttctaccagctatgatggaagtgaagaaggacgtcccctaagtggttactatctcagtcttttccctggggatgaagaacttgaaaaagaacacggtttgagcctgcagtgggcctgacactgccccgccccaggcagggccagccccgccgcggcgcaggggagggtggaggccgcagcgggtcctgggcagccatggccgctctctccgcaggtggaggcggaacgaggatggagccatctgcaggaagagcataaagaagatgctggaagtgctggtggtgaagctccctctctccgagcactgggccctgcctggggtaaggctgccgcgtgtgggacctctgtccactgggctgtctgtgggtcactcgtccattcatccattctgcccacggactggacaccagccccctgcagccccctgcagcccctgggcagggagggttcgagaccccgcctgttttgtctgtagaagacactcctcctcccttttcctcatgttgcagttaggaaaacccaggatcagaggatcttttggtgcataaacactaacggggcacctactgtgtcccaggcatgggctgggctgcggctggaggccacctgggctccccttgtggagttcagggtgttgggggcagaggtagctcttctcccgtgtctcagacaccaaccagctcctgaccttcagggccaggtgctgagccataaatataggacggtgtcatccaggggtaggggcaggtacaggagtaggggcaggggcagcgacaggggtaggtagggcccagggttgtgcacaggcccctcagctcaggggctggttgtggggctgaggctggagcgcaccccagcatcttgtggggaggggtgcacacaatcaggacagatggcctgggcctttcctgttcaagtgcctccaacagctcctgtttcctcccaggccagcctggcctccgcagccctccagcccgctcactgcaggggatggaagaggctggtcctgccaggaggtctgagtcctgccaggcctggccgtggcgcatggcctctggggtacagcctgccccgcagggcctctcctctgcacctgatccggggagtctgtgacttacaacaactcagcaagaagctgttgcatttctctgaccccgagctcacggcctggtggctgcctctgctgctgtgggagtgtgtgtgccaccacggtgtgcagggcagcagtgccacaagggcctctgggcaggaacggggactccggagcccaggcccagctgctgggtcccagtgctttgggggcctgtctccacagctggaaccacccccgcagcagagggggcctttggccttggggtccccttgctgccctgctgcgctcacccagtagcttctctgcctgtgcacacctggccctggaacacgagtcaccctccgctctctggcactttggcctctccatgcggggtgcgtggagttgggtttgggggtcccactcactggcatccctgtcagctcaggctggtcactgagaggggcactctgaggggcctcctgggttcctggctctgtagggcacgcacgcttgagggtgggagtgtcatggggctgaggtgggaccgtcttgacgtggcctgcaaagtcttcatgagaaacccacgggtgtttcagtgggactttgaatgacaaatagggtgggaaagatgggtgtggggaggaggaggtgcaggccggagctgggtccctgagtcaggtggcgctcgggagcgtctgggagcccagccagccgcagcacaggccggggtgggactgggagagacgggaatgcaaacagggaacccgccgtggcagcctgctgcactgggcgggagctgggaggggcgacgcgggggcaggcgccaggggagcgggaagggggtgccctgtcacccttggggagtctgagctcagggtgggtaccctgggggctgtccctgctcctcagaggttgtgtctgcagcccagtgccccctgctcgggccacggcaggcctcacagatgctgacgtggacggcgggttctgggcaatgtcactgcagcctgagatgccgcctgcctgtggctcccagggctgggccgctgcccacgccgggcaggaggccagtggagacgggtgccagggcagcctgaggtcccgcttcggtgccctgttgacctgcctccgtcctctgtctgtccagggctcccgggagccaggggagatgctacctcggaagctgaagcggatcctccggcaggagcactggccgtcttttgaaaacttgctgaagtgcggcatggaggtattcctggcctgtttgctctgttccacctgtgtgtccccagggctgcaggacaaacacagtgtgatactggggacctgccccagcaccactgggtggcagcggtcccacccagcttcaccaggtgacggtggtcccagcccctgcccccacgttgcacagctcccagaggacccggaagcatagctgtgtgcagggcccctcagacatctcgccctccctctctgttccattttctcctctctaaatcaagggggatgggctgaggacccttgctgccttcgagtgtgacagctgcttggaggcctggtgccgccctcctccccacatccacccttgcctcgagcacagctgcgcccaagggtgctgggaagccagcccctccctcagacctcgccccgactcccaagctctggaggggcccttcccacatgcatgcccagcctggggaccgactgtaccaggactttttatttacttctttagaaacctcgatctttccttagaaagcctccatctccagctctctcacacaaatgcatgcacactttttttttaatttttatttttggaaacaaggtcttattctgtcacccaggctagagtgcagtggtgcgatcttggcttgctgcagcctccacctcccgggctcaagcaatgctcttgccttggcctcccaggcagcaggggctgcagcggtgagacaccacacccgtctaatattttgtatttttagtagagacagggtttggccatgttgcccaggctggtcatgaactgggctcaagcgatctgcccacctcagcctcccaaagtgctgggattacaggtgtgagccactgcgcccagccctttatggacgctctttataaaagcaggctacacgggccgggtgcgctggctcacacctgtaatcccaacactttgggaggctgaggtgggtagatcacttgaggtcaggagttcgagaccagcctggccaacatggtgaaaccccgtctctactaaaaatacaaaaattagccaggcctgatggcgcacacctgtaatctcagctacttgggaggctgaagcagaagaattgcttgaaccaggcggcggaggttgcagtgagccgaggttgcaccactgcgctcaaaaaaaaaaaaaaaaaaaaaaaaagtgatcaatgccatggtgtggagcacttcacaacattgtgcagccaccacctctatccggttccagaacgttccatcaccccagtcacccccagctcctccccagcactcccgcatctgcttcccatctccttggatttgccggttctgggtgtctgttatgagtggactcctacaacaggtggcctttgaaactgtcttccttcactgagcagacgtttccaaggcgtttccaagatctctgcagggcaaggacgtgtctgtccaggatgaagcccgcattgggctgctccgccttgcaggcccaggcaggctggcgggggctggggagagctgggccggggtcctgtgtgtgctggaagctgtgctcagagctgggtcagggtggagggcacgaggtgggccggggcaccgctcaggtgtccctcgctgtcgggcttaccctgccctgcccatccaggtgtacaaaggctacatggatgacccgaggaacacggacaatgcctggatcgagacggtggccgtcagcgtccacttccaggaccagaatgacgtggagctgaacaggctgaactctgtatgtgcctggcctccctggaggcgggagtggggaggcagggacgggtatgggcgtggcctccggggagggggttggcagggatgggggtctggattctggcaggctgaactctgtatgggcgtggcctccggggagagggaaggcggggaccggggtctggattctggacgtgcctcgagggcttccaagggagggacctggccgtgctcctggggcccagggccagaaactggaggctacagggtcagagtcttgcccagaaagtgacaaagggggcaccagggagaggccggggagccacctcaggtggccagagctcacagggctggccaggcgaccatagggccctgtgtagttctgggacctgggtcctccagggaggcctcgaagatggcatccaggggtgaggctggcaaggccccctcagcccccggctgccggcttttagctctttatggggatgtggattcccagtacttggattaatcctgcatgctcctaattcagaactgggatgggaaattccataaataaccccgggctttaaatgcgggctaaatagctcccggcaaagctgcacctgcatcttcttcccctgaaggatcctcagggccttgtgggtgcatctctggtgcacctgacgcaggggtcctgcctcccatttcacagaggagtaaagggagggtgtgcaggccccaagccctcgaaggctgcagtccgtagggctcagctgggcagaggcagggctggcggggagggtcagctgtgcccttgttcttccagaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtat

SEQ ID NO: 426 - DNA, 89481 bp, Homo sapiens; identical to SEQ ID NO: 425
  source 1..89481: mol_type = genomic DNA

SEQ ID NO: 427 - DNA, 151986 bp, Homo sapiens
  source 1..151986: mol_type = genomic DNA
ctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgaggtgagggcggcgcggggccgcggcggctcgggcgggcgcgggctccggaccccgcggtggcggcgtttatgtaagcgccgggcagggactggtggtggggccggagctgcgggccgtcccgggagcggagggcgcccgcggagaagcgagggtgccgcggcaccgcctcgcacccaccctcctgggtcgcccgtctgctccggcgctcggctcccggaggaagctgcgcccgggcggccccgcgtcccctcccgagggcgccgagtccgcgtgggatgcgccgcgctgcgccgcggggagggcaggtgcgccgggacgaggctgcgccctggggaccgagactgcgttttggggaggggacggtgtgccctggagatcggaggctgcgctggggacgaggctgcgcccggggaccagaggctgccccgggtacaaggttgcgccggggaacgggaggctgcgttggcaacaaggctgcgcctggggacggtaggctatgtccctggggagacgctccgcccggcatgggacgctgcgccgggggacggcaggctgcgcccgggatgaggctgggcccgggcaggggaggctgccttgggaggggacgctgtgccacgggagtggagactgcgttggggacgagtctgcgccctggacggtcctgcgtgtccttccgagggcgcagtgtccgcgcgggatgctctgcgccgcgggcggcccgggccagggaagttcctgcgggtgccgggcgtctgcagcgatcgggagcaatctggggcagttgggggcccgaggtgacttttgacgtgttcacatcagaaggaaaattattgcgtggtggatgggtgcgagggaaggtgtcagattgggctgtggacgctgaaacgtgttggagtcccgatttacacgctggaaaacctaacctaaaacgtgttcctgtccaggtttctatgtcggagatctgcaccgtggtgtttagttcccagttaatatttttggtcagcaggtttgggctgttacttctgatacaggcattttacttccttcttactaaccattattgcattccgttctcgaagtataacgaaaagtggcatgatatcaaacttgtttctttaacgtttaactccataattaagatgatagaaccgtagtttttttaattgagaatacaaatatgtatttaatcctctttgtttcctcttaaattttgccgtatgttttattgcttcgaaaggtgccacccagagctgcattttccaaaacgctaggttgtcttaagagcagttgtttctaggagatagaaaagctaattgtcttttgatgaccatcttttccttggggttgagactgctgtatcctttttgcctgctgagggtttcccagaggggaaagggagaaggaagaaaggataaaagcttggctgatacagttccttcttggataagagaattaactgtctctcattgcgcggttcctccggaggacagggtccagtatgcatggacagccacaacgggggctcggtaagtatttgatgagacaggctgagctgggtgcctatatcttgcctgtggtggagaggatgaactcacacagactctgaaaggaatgcattgtctgtgagtgatgccctgttagatgtctgagggttcctaagactgggtatatcccactacatctacatcacatttgaagctgtagttggaaaggaaaaaaggaggccctcctgcagggacaggggcttaaaaataatcgatccagctctgagaaattgatgacacatgtgtctctggtgtgacgtgctcatgcagttgttactgggaggccaagggggaaggattagctatgaagtgataacatcatccacaaaaaacatcttggctcagaggctaatttcacttcctcgtgaatttatgtattgtaaaacatttgaattcttttagatttttggaataagaatttttttaacttctatttgtccagtgaatgcataaaacaaacttaatccatttgacaaatacttgtctgtggcctgttatgtgctaggccttccctgttttaggccctaggagatacagtacttaacaagataggtagagatcaaaaatgcttctggcataaagcagtacatttgtattgatagatttaaaaagataagcaagcacacagtacctacagaaaggtaaagcctcattccactccatccctgggcacttggttcaaaggctgcacccaattgtgtattgtcctagcaggagtcaaagtgtgtattgtatatgttttaatatatgacaaaccttgctatagtgcatattcttacacgtgggtacaagcaaagcctactaattagttattatcaaaatttcttagctgtaagttttacttaagaactgggttttattcccttgaatgctgtgattagctctgtgatcaaacaatataattcaaataggaggtagttaactttggaaagaaatagatgaagttacacatttaccagcctataaaaaagtttagcaaagttatcaagcttagtttgaaaccaaaaagctcagagaggtccaattttattagaaaactcaatggtggccgggcgcggtggctcacgcctgtaatcccagcactttgggaggccgaggcgggtagatcacgaggtcaggagatcgagaccatccttgctaacacggtgaaaacccgtctctactaaaaaaatataaaaaatcagccgggcatggtggtgggcgcctgtagtcccagctacttgggaggctgaggcaggaaaatggcgtgaacccaggaggcggagcttgcaatgagctgagaccgtgccattgcactccagcctgggcaacagagcgagacgccgtctaaaaaaaaaaaaagaaaagaaaaagaaaactcagtggttttctgtgtcaactttctaaaataggaatttctaaatctgtaatttggtgtgatggaaatggtgttaaaaaaaaacccatattattttgtatgttcataatatgtgaggtaggaaaagcaaatgggaaaattaaaaattgtccagtgaaatcattaagattccttccttattccttgagtgacttttctttccaagttgacagctttttatctggggtgtggacagggacagcgcagtagcccacagaggtcttcgtggcagggcttaccgcaccttccatttgcagagttttgcttcatccatagcttgacagctgttgggctagggccattaatatcaaattatcacaattttttttttttggtagtttgattagtactgcttgctgcacttttccacctgtatgcctataagatgtcctaggcgtacacaaagaaaagtgactttggttttaggtttaacgtctttgtgatggaacaggaagggggatgaaagtaactctgagataccttgtatttttattggaagtacagtgaaatggaagctctacttgcttctagtttggtgattttggaacctggttccatttcatttgcttgttcatccaacaggcattcacccatgcatcctggcccaggtactgttctaggtattggagattcaggatgagcctgatgaggagagttcctgccctcaagcggttcattttcttgggaaggaggagagcagtaaacaagcatttggtgtcctaactgcttcaaagggcaaatgaggcagggtaggtgagagaaggtcaaataggtggtgaggatggagtgagctgggctgaggtcacggcagcagcagcctctcaggcacagggaactctcgggtgaaagtccctgagcctccttgtagtatggtggtcacctcagggaggccattgctgccagagaggctgggcgagtggtaggaagtgagatgggagtggaggagagctgcatcttggagcacacaggctgtggtaaggaatttagattttaagtttgatgggaagccttaagggagcctttcttccttccttgcgaatgacatgatctgatttatctttaaaaagtaccactctggctgttgggcttacaatatgccaggctgttttaagagctttacatatattaattcatttattcttatgacagtccaaaaagtaggcattattatcattattcccatgttacaggggggaatacctaggcacagagtggttaagtgatttacccaaggtcacacaggaagtggcaatggcaggatgtacccttacctccttactgcagcttgctttttgcacctccactactgcagactggaggaggaatatcagcaaggagatcagttagacttttgtgaaagctgggtgactgtaccggcacctcagaccagggcggaagtggtgagatcagattcagcctactgaatttcagcatttgtaagatgccatcatttttaagttgcatcatcatttcttatgctgctaacaaagggaaaatgtagccaactagattgtgacacaatgctttcttgttacccagcattcatttatactcattgaaagagcttagactaagcattgacttttaaaatcatataattcatgcactttcataaaaaaggaaaatacaagtaaaataaagtaattctgaaatttcttcacatctagaatctgattcttccaactcagcttttgacttggcgttggtgccaggtatgagatagggaagtctgggaagagccagtgttgggatttgaacatgtggagcttgtgactggaaggcagcccagctcagcagctccactcaagggccagatctggaggacgagggttgggtcattgtgcagctacttcctagatgatcttgagcaagcagtctaatctctgtgcttcagttttctcatctataaattaggaagaataaaagcaacttgtcagggttgttgagttgctaatgtaaagtacctaaaatagtacctgactaacagtatttaatggggcttactttgcttattatttttatgattagttatctgagtagagaaaggtgaatatggatggaaattcaaggtcaggttcaagaagaggttggggccaaatatgtaaatttgggagtcatttgcatattgctgatctatgaggcatacagtatggatacagaggagcaggagatgaggaatggcctgggagcttttggcaagcggtccacattgggagggagggtctagcaacgccattgaaaaggactctgtttgaagaaggaagaaactagtgagagtctagtggcctggaaaccaagacaccgaggggttcttttcttcttattcttcgtgggctggagagtttcctattggctttgataagaggtggttgtgagtgaccttgataggtttggagtggtggggagaggaaacaaatagagtagaggtgggaacatcagtgtagacgactctctagaggagttctgttaaaagggaagagtcatgggatggtggctggaggggacatgggtacaggaagtttttagttgtatttttaaatgagagcgatgatagcatgttatgagctaataggaatgatccagtagagggaaacatttataatatgccaggaaagaggataatgttggagccaagtccttgagaaggtgagagggaggcaggaagagcagggatgctcagctctagaagggaggcgggacttcaggagggaggcaggacttctgcacgtgggagcctggactcagaaatattcctcaagacatgctgcccttttgaaaggaggataggaaataaatcatggttttgtcctcagtcctaaaaagttcggaatctcaccctaggactcaggatccagcttcttaccagcttgtgctgaacatgccatggggcgtacttacggaaagatacatgtggaaatggaattttttatttatttaaaaaattcacttttctctaaaagtattgttacctggaggttggcacctttattcaccaaattcagtactcagaggactagaagactcggtgcctgatttgtgcttgatttgcctagctgggaatttcagttttgcatttaagacgactccctcaccaaccctacccccagaggaaagcaggtattgttgctttgggcctgttgcatgtatatgtttatgttccactgggtcagcagcattcagtgaaacacagttgcctgttaacttggtaaaatatcttaattgcatgagttttgatttgtttttgtgattatttgattttttcaggtttggagtttcagaacacccatcttctcagtagttcagccaatgcgatgaaatgtgaagaagccttccccagcttccttgcattctctccatcatctgtgcagtggagagtagttcccactgctgtggaaacattttccctttgctcttttctctcagggcaggctttcctgagtgcctgctctgtgtgagtcatcgtgggaggatgcggtggagaaggacagggaggaggtctgtgcttctttgaactgacattctggtggagaaactaaacagatcacagaggcagacaccgtgcctcacaactacacacggacccggcttatgatggttccagtaacaatttttgacttgactgtggtacccatacagtcattctgtttttcacttttggcatagcattcaataaattgcatgcgatattaagtactttgttataaaataggctttgtattagatgattttgttcaattgtaggctaatgtgagtgttctgagcaccttttaggtaggctaggctaagctttgatgtttggtagggtaggtgtattgaatgctttttcaggttaggatgtcttcaacttgcgatgggttcataggatcggaactccaccgtcagtcaaggagcacctgtgctgtctttattggcatgaccgaggagacagggctgaggtagatggcatcaagagggtggctcctggtggaggtatgatgttctgggaaggcctctctgagtgcgatgtggtacgctgaggcccagagggaaagcatgagctcatgtcaggaggggggacaacagccttctggctagaaggatagcctgccagagagcctgcttattagagtggccaggataggaccagaaccattgtccagtcaggggctaggaggtgaggctgcagagacacaggggccaggtcctgcagactctcaagagtgcaacaggaagaatggaggcctgggttggcactgttgccatgatttagcggggcagaggtggcagaactggagaaaagagagcaggtgtgaattcttggttgtgggcaatagatcaggtcttggagacaagggaagtggagggaccaagaagggctcttggagctctttggatggtgatgatgtgatgatgccacgttccagaggatctcaggttaggagtcttcaactagagacctcattttgtattgggttctgtttgagtctgcaaagcagttgtcatctaatatgtgactagcagaatatttgtttgtatagatacctctcaacttacgatgaggttcataacttaaatatattgtcagttgaaaatgcatttaatacacctaaccttcaaaattcaaagtacactttctattaaatatgtatcactttcacaccatcataaagtaaaaaaatcataagtcagactgttgtaagccagcgtctgtctgtaccttcccacggcctacaaaatttgtaatgcattgtttgtaaaacacagacacgtgcatttaaacttttattaggtagaactggctcttcttcagggtccttgtaattaagtcagttattcctctcatgacattcttgtaggaggtctcattacccctatttatcagatcagaaaactgatgctaaggggctcagtgacttcctaggaaagctggataatgtttaacatttattaagctcttaccatgtgtcagacatggtaaagtgagtttaatctagtttaatcctcatgatgatcttaggatgttgctattaagggtcactgtcatcatccctttttactgataacactggcctggcttacctgagtagcctcctaacagatctcttcttccacttctggtctccttcagtctgttcttgaccagcagtcggatctgagcctgtacatggaagacatcacgtcattctcctgctcagagtccccctgcggccttctttcctgctgtcccttcctgccactcagagccctggctccagctgtcttggggcctatagctagccctcacttcagtgttcatgcaccattgtgtgctgcgtgccctgctcactgttctgtttatttctgccatctgtacccaccactaccttcctccccacacagcctgcctggccagaatgaaagcctcaggaaggcagggctattgctctgaatctgtcctgagggctcggagcaatgcctggtagatagacacttgtaagcctttgctgaaggagagaataactttaacttactttttctgttggtagtaagtagtagaacctgcattaagtttatctgcttctgaaaacgtatgcttttgctgcctccctacactgcccccccatcctattgtacttggtgaatcagtcatatatttatgccccatatgtctgtgttatctccagatttccacacttttctatgtagaatagaaacatttataaaacattcaaaattgttataaaaccataaagtttgacatagtaaattatctgttgaaaacagggaggccacatcctggaaaagtagctctgtcctgccagcatcattttaaccccttttggacaagatacagttgaaatgcattctctgaaataatacttataactacatcttgacagaaacaagaatatttcgaataattctgggaggattcaggaaaaggcagccaaataaaatgaaaaaatacatttgattcaactgtggaggcttaaaggaattacacatcttttttgtttttttgcgacagcgtcttgctttgttgctcaggctagagtacagtggtacaatcatagctcactgtagccacaacctcctgggttcaagcgatcctcccgcctcagtctcagcctcccaggtagctggggctacaggtggatgccaccacacccggctaatttttgtattttttgtagagacggggttttaccgtgttgcccaggctggtctcgagctcctggactcaagggatccaattgcctcggcctcccaaaatgctgggattacaggcggagccattgcacctggccaaaaaagcatctcttataagctgtttttggtgaaggagcaaacaggaaagtgtcccagaatttgggagatcaggattgtaatcccagccctgcttctgaacaggatggtgcattctcttcatgcctctgctgcaggctccttggatgtagaatgagggcagttgaattgcttgttgccgaggttctctccatttctggaagactattgtaagtcagagtcaaataatcattcattcagttgtccaataaatactcatcatagaacctatgtgtagtcctgtctaatggtaggtggtgctacgtcacttcctgccatggctgccgaggctcacgcgaggctggcacttggcagagagtcctgtcccttcttttgactcagtaactgtggaaagaggtgaggtataggaagggagggcctaggccttaggggttaagcgggcttaggaggcaggattgagagaggtggaatgatggattcagagtccaagagaaaacgtgaaactccaggggattagaattgatccctttctctgtttcctcagtcttagggggactagactgtgttagttgtcttgaattaaattgagcaggggttgtttttcacttctgtaagtccagagtttatcataagccaccagaggtaattcagtagtagttaatatttcattaaccctcacttctaaaattacaaagttagaagtggaggtctttaacatatatatcagtcaggctggagagtaagttggaaagttgcattttattcctgtgtgtttacttatggcagtgcacataagcccagttttgtttctttttctttgattagtaacagttgggcacaaggtgtccaacccacccagtgttaagtcacttagagtgagttgatttccttgaaaaaaggaatcttttcaagaatgtaaagtggcttctcgtagtcttcgtgaggctctggagtcagacacaatactgggttaccctgggaccatgtgcagtgagcccgggcttctggagtcagacacagtacctggttaccctgggatcatgtgcagtgagcctgggctgccggatgccgctggtgggccctctgccagctgctgcatccccaagccctctcttgtgtcattgttttcccttttcaggaatagtttccactagggacctgctccctcaaatttctatcatttgaggtgaggtttcgtgttggttcatctgactggccgagtgcaccctggctgtgagaacaggaaatagaattctggcttttgtcttagggatatccccaggtagagagaggagattcaaaagatgctggggagctacagacgtgacctctgacctctacatgaagaatggtggaaaacacttactacttagtgttaatctacacatttcacttggtttagacctaagcataaatagtgtgaagtcgatttaaacagaggttacagtttccagaaacttcagcgccgtggctgcagttaaacagcaatgattggactctttacgtctactccattctcgatatgaatgaaagtagtcacatcaaatgcatatttattagtcttggtcattttgaatttgagtcctttacatactatgtatgtatgtacccaggagcagagcagggttaaaagtgacatcttctaacttctactctggaattttttccctctgcactttttgttgtcacgtagtagatgttttcacccacatgcaggtgaatgagtgacatatttatcttgttacatagtgaagctttcaattctttaattttatccctctaatgaaactgtgaggaattgattctgttgacacagaaaaggctggtgtcacatgaacctaaaggacgtcattgagcatgtgcctctcacgcagaactgacatagagcctcccgtgcagctcaccttgaattctccatgcacgaatcagccataggcacgtgttatgtgtggcacaggcaagaagtgcctgatagattttagttctgtttattgctggaagcccttgctgtaggaaaaggaaggttttttcctttcctggacaatgattttgagctacggtgtagaatggaaaaggcaggctttgatttgccagacactgcttgctatgtgtgaagccgggatagggcggtgctgttggacagaagacctgccctgtgtgccttttcacactgcattgagaatttgtctagatgatttcctgggcttattgattgttgaaggaaacaatgcaaattgcaagttatgatcaaataatgctttgagtcttcacctttttagaatgctctgggaaaatacggggagaaaataaaccataggaaaggcattttgaggcggttttgttttgttttaaacagctgccatgaaatgcaccctctctaagaggacaattcagtgattttctgaatgtctgagttgtgcagacatcaccactgtctagttcttgaacactcctgtcacctcaaatgttccctgtgcttgtctgcagttgattcgcgcacccagcccagcctcaggcaaccgctcaggcagcctgcctgctgtttccacatgtgccttgcagatatttcatgggaagcagctcatgtcctgtgtcatcgtttgcatcaggctttcacttaacatgtttttcgggttcatccgtgtgttgtagaacatatcagtaatttgttccttttagtcgtattggcgtagcgtgttcgtttattccactccagcgatggactttgggttgtttctgcattctggctattatgaatcacgtgactttgaacattagcaagcatgtctgcgtgtggatgtgtattttcatttgtcataggtagattcctaggagttcgtaggagcttcgaaatggagtttaagacagaagcctttgtttgatactgataatgctagcaagggccatttatttggcttgctcttgaagtctgtctctgtgatgtgcattgtgcttcttgaattgtatgagcctactataggatgaaatatggttataatgtcgagcagaagctattagcatttcttaagctgaccacctgtgttgtgcacactattaggtcctcagcagatgagttcttaccgggtgtttgatgttttccccccacttatcagaagaggaagtcggtgaagtacggttgggcatattaaaaccacattcagcctacaacaccacagaaacacttaccctttgacccagcaattctgcttctaggaatccttccagaagatagacctccaacaatgtgaaaatacattcggaataacctaaatatccatatgcaggagagggttgagtaaactctagtacagccacacaaccacatccactgttgaggatgacctctgtgaattggtttgaggtggtttccagggcacgtggatgtgaatgaggcaagtaccaaagaacatctaaatgctgcccttgatgtgagaagaaggggatgcaggaagacacacgctccctgcacacttgtgcagaggagatacaggagggcagagccagaaacaaaagagatggtgactgcagagggccaggggacggaggaggagtgggtgccaggtcataggtggggtgcagagggcgagggggcagggaagtggagtgggtgccaggtcataggtggggtgcagtgctgctctcagtacaccttttagtgtggcccagctcttgaaaccacagcaatacttcatatactccaaagtaaaatagatggttaatatcagccaggatgtgggggacccaaaatgaaatataagcggaaaacacacatctcactgtagtacaaagcggcagggccacagcaaagggggtggaaaggaaagtgttaaccttatttgggaaaatgataatgttgactggattctgtgaggctgaagagaactgtacaaaatagtagtaaatttttttctcagtgttaatggtgagcaatgtgaaacgactttatgtgtatgtggggattgaacaaataagcagaatcgtagtggataatgagagccaggtttctcactgtcccaggaagaagttacaaatagcaaaaggaagatggcagagggaggccgtgctgttggattgggataggtgtcagtgtgactctgtggtctttaatagatgcatgtacagcacaggagtaaacataggtgtacgcgttacatgcatgggttagtgatacacctacatatgcatctcctagccttgtccgttgggaagacctagaagcaatgacctccagcaacagggagcacacctaaatatcagttgctgataaaaataagcagggctccttgcagaagatgagtctggaacctctgatgatgctggaaataaggaagtggccaaaatggatggggtgtgtcagagggcacataagcaacctggaggagccccatggccaaagcgggtcaatttgagcaaggaaatgagtaatgatagtataggtgtataatctataaaacaaagtcagtatcactactgatacttcttatattgatataagaagaaattgaaaaaataaggagaagggacatctcttcctgacagaaacattccaattaattggtgtaggagcagtgagaaaatagaaaatcgccttcaggcggcactatggaaatagttacttcaggtgagttccgcgggaggatgctgattagtgggccagagtttggagagaaacaggatatttgcctagtctcgaagtatctcttcctcaagttatttatttattaaaaagggaaaaatagtaactttagaatggaggaagccagcagacaccacgtcacctgggcgatcaagatcagcatcatctgatgagacaagttgcatcatatgccgccccacaccacatggcatgtgctctgtcagggactcctgccacaaatgcacaatcacagtctagtcatggagaaatgtcagacgctccagtagagggacgtcctgcaaaatacctcacctcatcagtgttcctcagaagtgtccaggtcatgaacactggaaacaccgaggattggtctaagcttagagacctgatgactaactgtggcctgtgattctgggcagaatcctggaacagaagccggtattggtggagaaaccaccgaaattcagatgaggtctgtggtgtagccaattgtattgtgccagtgtttattttctgatttcgatatatccttctcccagctcacaacatacaggtctgtgattgatacatacttctcctcatgctcacaacttacaaatctatgattttagaggaagctgggagaaggacataggggaattatctgtactatttttcagccttcccataagcctaaaatttcaacataaaaagttgaaaaagaaacccatggcagaatatgatgggagaatggcagaaatggcaggaccagcccctgtctctgtttcttcccatgtgaagctgtttacctggtttatcttggtctttggatttggtcgattttttttttctaaaaagaaattttaaatatagtcaaatttatcagtttttttcctttatggcttttgggttttgaatcctaagaatactttccctactacaatactcatatttttctttaatttcttctaatagttttatattttgtttttcacatttagcatattgatctatatgaaatttgtttttgtacagtttgaagttgggatattttttcaattggctaatcatttgcctttgtcattgagtagtctgccctttgcccagttatcagaaatatcacctttatcactactaaatgttttctttcaatgatatttcaaattgcttattattcttgtgtgataaagtgattggtttttgtatgttgtgtccacagcttgtcatttgtgtctcatgttttctagatggaggatccttttgggaacatgcgtcttcctttctaagctttgtacttcccctgtattaattggctaggacttctggtactgtgctgagtgtagtgtttggatcatagtgatggctagcaggctgcatctcgttgttgtctttgacgtgaatgcttccagtatttcatccttaagtgtgacattactctagttgttttgtacataccctttatcttgtctagcatgttaccttctcttcctggtttgtccaaaataatctttatcatgagtggcagtagaattttaccatatgtgcgtctgttgaaatgatcacgtggttttccctccagtctgttaatatagcaaatttcattaatagatttcctgatattaaacattcctgcattctggggaaaatcctgtttttaacacagtgcaaaattaaaattgctatttattttaataccttctattttttcaaaatgagtctctccccagccctacccctagtcttttcatttttttcatgtagtttacatgctgtagtagctacatagtggtataagtgcttaacacctggcttttggtgggaaggaggagtgggagtgtatggaaacccctgatttgtagcatttgccaatttccaagttataaatgtccctaccgtgccctatttcaagctaccgatgagctgtcaactggtttacaaaattcctgaaaatgtgacagtcttctctcatgaacaggtataagtataccagtggggcctgagtgtgcagcctggtgactctcatatctgtgtgcactcacacaaccatcactgggatcaacccggaggcttcctggtacctgtgcagctcagcactcctaccctccccaggaggaccccggttctgacctctctccacctttgttctcacttggggattgaataccttgtttattttcacgtcatccttgttttctcttctgtgcacatgcagctctacgttttccccccaagaactgccttggccacctcatttgtagatagcgaaatgcagggtttgtaatgatttttattgaaaaattgagcatctgattattattgtggcactggctttattaaacaatgtaggttctgtgataacctttcttaaatgttgggcattgctgccatgttatattcatgaagttcatcaacttcatataaactgacatttttcattcatgtgtttatgcagtcattgaataaatattttttgagcactttggataccaaaggtttagcagtgaatgaaataactcagtccctttcttcacagagcatatgttctgctatgtctttaagtcacgtgttttttctatttgaccgtccttgccaattttcccctaactcagacatccacttgtctttgcccctggtattatcttaaatcaactctaaatcaatccgatttcttccactgcttcaatgctagttgacgtttggcttaactgcttatataattatttctgcttttattgaattcttatgatgaaaaaacagaagacttgaatctgatgatttttactttagaaaggttaatgatgaaagtgttgtaatactacagtttggtgaaatggcactttttgtgttgtgtgaactgtcatcacttaatgaggagcaggagatcagcttacagttttctgctatagttctggacatcatgagaccttattccccaccagcatgatctctgtctatggctcagagggagagcaatagggatatggggtgctattcacagccttgcctgggtgactgtgtcttctggcagcttagtggctcccaggggcaggatcctggtcaccagcatcctacagcattgccacatgtttgctcatgctctggtgtcctgtggagtagagctccttgttctcctgtggaccacagtccagggagagtgggggtttccctgtaggaggaggagctggaagactccagatcgagtttaaccgtgggctaggctgcgaaatttggatgcaggccagtggacctcagaaatccatctgttcatctttctgctaaactgatttggatttctgcttttttaatcctttgcaaaattaatttgtctttaatatgaaaatcagtgttttatttttagtaagagaaaataattctattttatttatttggaacaatttaaaagaccctagagatcaacatccttcctctttcatttcctagaggagggtgtagaggagcagagtgtgtgacaggcacagtgggactgacctttgcttctgggcctggattaccatgtctggagagtgatgctttggaggaagtatgggtcacttcgctcctgggccgtcggttcagaaggtgcagccttgcccggagctgaggtccagtgctagcagcacattccctttccttgccctgagcctgcatggcagccttcttcatcaactggaatctctgttgaggatggagaaaaatctgtggtccttttgtttactgggtgactttctgacctctctctcttctcattctctctactgcattacaactgtttgatgagagagattttaaaaatgaacataaacaatttttatggaaatatctgttatctattttttttatatagttataccattggaatttactcttaccttcaggtaacagttgtgaggaccaaatcttaatcctggtaggtgacctttaaatcttagaatcaggaattcggctttagtcaaaagttaactttttccttattattgttctcctgttggatttttaaaaatggatacattctatttattggtatttacaagtcacttgactagactgatactaatagtatgacacaggaaaaacaaaaacatctttctgtaaattttgaagtaatgaacaatattagggattattccaaaacagagcagacaaggcagaggaaaaccagtcaagctctttatagcttaaatctaaccctttacctgaataataatttaaaaaactattttataaatcaagcctcccattcctgtaaaataggagtaattcattatcacacatttttgtacctttaatttttttttttcttgatggagcccaagtcttaaagatgtcaaaactagtatcatgttccattttctaaagtcgaggctatctcagtcccatttctatagccaacagggtaatctgttactaggccctgaaacccttctgatgagtctcagcttataccccaccccacccccaaatattcacacaataggcacagtgaaaaccaggaaattagtctctgaaataagcagcctccccaggaaggaagcagcatggccactgcccattctgtgcctggacctcgccccaccggcacttggcttcaggaactggactgatccaggcactttgctggggtgcactttggcttttctcaccagttcccagggcagcctcgggtaggagtctcgggtaggagagtgttggaggccctagatctggggctacagggacttttctcacaactccaggcgagggcacaccgggcttggctcttctaggtctggcgactgctcccattggcaggtttccacaggcctctgcctgacgtccttgacaagaggaagagaggacccggctttctgtgggtgccgagccctctgggccacacagctgctgttctctgacttgtgggtttttctgccgcctcttgcgtttcatgctgtgactctggaactaggtcttaccctgtttggagtgaaggttcggggtgttgggaagttctgtcctcttctctcaggaagaggccctttgactgtgtgcccggaggaggcatgggtgcatcttttctccagggggctcctcaccaggggtatggggagactgtgctgcagcctcaggaatgtcagggtgaagaggccctggaggctgatgcttccggccaagggcttcttctggattttcagataaagtcccagaacagaattactttatgttttaatttcaggcaaatgtctctcatctgcccttttaagtacattaggattgggtttttcgaccctgcacagcacatgggggctcctcagagaagtgtctgaaaaaataaaattaaataactcgctttttagcacttcgtttttactggtgatttgttagtcattgattgaggtgattgtgattgatccaattatttgtctgcccatcctgattataactttttttatttacaggattttaaaagatagtttcttgatcttaatgttatatttaatgttctctttcataagatggttttttgatgactttgtgtttaaaaagtgagggtcttttgagaaatagaatatatcaaattatttgttcagaaacattcaaaagcattttttccaactctgcaagcagttgtctgttaaagcaattagcgtgtacccaattagagctctgttcaagatccctcactgataacctctgtgaggctgttggtccgtgtctttatcaagcagtagtgtggcttcccaggtactgtcagctcattttggacccaatactagtttattgcctgaaattacctttaaactggaaaatcttcaagtaaaatttttgagagtttttgattaatcccctaggatacttttgaatgataggttttggggagatacatttggttgttttggcaccactaccatcagcctcactcacgtgctgccaggcgccccgccagatcagggaacatcctctgtacatggaagcagccccgagcactatgtctgcttgtgtttctgctctcaaggtttctacggccctgcacgtgggccctgctgaggccccagactgcttcctcacacagctgacctggtgggcttcctgtccacacagctgcccttcctgtcctcccatccaacctctcgcatcatgttgaggggagagaggggggcaaatgagacatggtccttgctttcatggaaatttctagtgatgcagatgtctgtatatcaagtactcacacaagcagatgtaaagtcataactgtgatgaaggaagaccaattgaggacctccatcagccgaggggcctggacgctcactgagaggcgaggtttgcactcagtctccttgcccaaagctggcagcctcattctgctgcccatgtgctgggcaccttctccactatcacgacttccttgacatttcagtctgttctgttcaagttttggccttccatccctctgaaatgggtcttgctagtcactaatgatctgtctcttgttaaggtcagtggcctgtatttcgtcctggtctcaatcagtgtctcaacaggactgtacagaactagccaacctcttggattccgtgggcagtgccaccctggcatccttctggctcagtcttctgtgcaggtcccccagtcaccaggagccctgcaggtgcagcctacctgcccccagcccaggctgcgctccctgcttgctctgcgtgtgatgctccggcctttgccgtgagctctgacacagtgcagcacagacctgcttgagctctggatcccctccccaggctcctgtccatcctgccccctttcagcttcctgcagtgaccattgcctggaactcaacccagtgttttttctctgccccctttttctgttagctcttcccccagtggtgtggggctgggacaggggcctcacattgtcgtccacgtttcccgaggcttctgtctctccatcccgctgtttcagggttctgcatcctgctgtttcagggttctgcatcccgctgtttcagggttctgcatcccgctgtttcagggtgcacgtttccttctcgggcttggctccttgggtcatgtctccagcctgacgttccagctgagaggtggtgaggcaggaaggggtgtctctgcatcaggaaagcgataaggagttcaggaaacccagtgtctctcattggctggaagagtattacacggctacctctggttgcccagatgcctggggcagggtctgtgctcgagaaaataaggctctgtgagtaagggtctcccacagccagatcaacaaggagctgtaggctgtaagtcctggttcctgactgagggaggcctaaaaagtggggctgttggggctttatatttagcacccactttttaccctctcaaattccagaccagttgagagagccgcacacactgtagataggcaagtggagatcagatacaggctctgttttagataaaagcaactggagaaagtggctgactggccaagcgggtttgctaatcctttatcccaaattagacaaacttcccacctagtaacgagcatggctgggggcaagccccttccacgtggcaggagaagaaaccctagcactttggtgtgggtgcgcctagcccaagaggagaggaggaccggctgggctaagcagcccatttcctccttctagatgcctccttctgcaggaaagagtgcgtgagttggattctgtccacagggaacagaagcgcaagggacaagtgccccctctgctctgaggaagggttttgcatatctcctgttggaagtctggaagctgggcagtctcgctccctgcaccagctgtgccggccctgcctgtcttcctgcaggtctgggctggctgctgtgggcctgtgtcctcaacactgccctgccctgaggctgttggagggacagccccagtgctcccccttcatcatccactctcctttccctttagtgtttctatctctggatttgtttctggtgagccttccctccagaaggaactgctcttgtccccatgtacttcctcgaggcctccctggtcgttcctaggggcgatcatactatagaaagaacccatcattgtcacccagaagtgctcctgagagatgagggaacctctggggaagccagcttgggcttcgggaggaattttctcctctctttatttttattttatttttttgagacagagtctgtctctgtcgcccaggcggtgcagtggcactgccagctctgcctcccgggttcacaccattctcctgcctcagcctcctgagtagctggaaccacaggcgcctgccaccacgcccggctaattttttgtatttttagtagagacggggtttcaccgtgttagtcaggatggtctcgatctcctgaccttgtgatccacccaccttggcctcccaaagtgctaggattacaggtgtgagccactgcgcccagcctttctcctctttttaaatgttctcaagtagcttcctcttcaagtccggtttctttttcttgttttctgctgggaactagatgtagttcccctccttcctcagcagcaccctttaggtacgagatgggtggggttggccctttccattctttaaggagagtattttccactgtgagatggtcacataccttctctttggtaacaggacaaaagagcaaatgctggaaaaactaagcttatgagctttggggaagcctggtgtgcaaatgagggaggctaacatgattttcgggctactggattggtgctcactcccaatttgaaaactagtcaggagataccgaggccctgtgtgatgtggtacaaagtataaggcgttggccatggtagagaatcatgatttttttttttttttctggaggtgggaagccattgtggttgggggcatgaactcagagttgtgccgtggaagggtccctgtggcaggagaacaggtggagagcagacgccgaggggccgctgtccaggcaggagtgatggagcatggctggtggggacttcagacacatgtgcaaggttctgaggatgcctgggtgctggccatgtggcaaggtggaaggcagtgcctatgactggacagctgggagggagcccactgtggtgatggggagggtagactagcaggtctgtttgggtatgctgacttgggggcactcaaggggagctgtcagggaggccattgggtggaagcaattccagagacaaaccgctgctccctaaaggaaaaggagagtgcctttgcctttcaacctgagctccatgtggtcctctggcccagcctgctaggcagcctcgccctgctccccactgatgtcacacaggtgtcacaaaatgaacatctgaaaccagagcttcattttcctaaatttcctagcctttctccttacagtgaacgtcaccaacacccacccagctgctggaaacctggcagtcatcctagccacctcgctttccctcaccgtcacacccagtcccctcaaacatttgtgcctgctgtccctgcgttcgcttcccacccgggtgcttgcctttccacgtctccctgctgtccagcagctggcaagtcattcctgccctgtgcttgcaggctccacggacccaccagggcatctggaatacaactgtgacttcctcctcaccccacggctgtgcttgacccggctcccatctgtctccagatcccttggagcactctcccaggtctgctgcaggcccatggcctcctcccttggaccactctccccgtctctgtctaggggctgctcacagcttcctagaagtttcttgcctgggctttgcttattcccagctggtggctttccatctgtgctcttcctctgctgacggccccttctgccccagctcattatatgaccgttgtctcccatcccgtcctgacctgcctgtttatggaggcatcctctaggttctcagtggagggtgcctggcccctggaacaaaactgttgagtttgaatcatccccaccctgcctcttcctagctgcagtgctgggcctcagtttccctatgtgcaaaatggggacactcaaacctgcctcattcccgtgaggattacatgattaggtaaagtgttcgtggcagtgtgggggatggcgagtgctaggcaggagctggaggctgttctctttgggctatttgcacacatatgctcttagcctcctttcgagcactttcctcagccttcaatcttgtgtatatttgtgtgtgtttctcttttaggagagagacttctctggcattgactggacaactgtcagagcttatccttgacctgagctcactgcctctgcctcagaattgggggtcaggttattcttagtattctaggtttataaggccagacagagtccttcttccctgtagagcagaaatgacccctaatataggagcatattgttttccctcagcagagcaaatgcttcagtagtagtgttaccagcagacagatggcgctttagaggtgacatgtgatagatgcttgggactgaaatttagccgtggatcatagcctgaatgggattttcacgcatgtcttccctctcaggatttctcttaagggttgttgattccacatttctccttgaggagggggtggtggtagggctggtgaccggggaactgtaatttcctgtgggagagcagcaatttcattattcctttaatgaagctatagttgatcatccttcagtgcctagtatacagcctgttaaattagggtcttcggattgctctgcaagcctttttaaaaaaataatttacaggctgggcgcggtgggtggctcacgcctgtaatcccagcgctttgggaggccgaggcgggtggatcacttgaggtcaggagtttgagaccagcctggccaacatggtgaaaccctatctctactaaaagtacaaaaaaaattagctgggtgtggtggcgcacacctgtgatcccagcgagcaggaggctgatacatgagaatcacttgaaccttgggaggggaccactccagcctgggtgacagagcgagactctgtctcaaaaaaataaaaaataaaaatttacaatttatgttaaaatatgtcattttaagttatgtaaatccaagcataattactgaacacaaggctcaatccaaaacatgcacagtaagcccgtgtgaagtgttcacatgctgttctgaggctggctggatctggagtttctgggagtgctctcttgggctggcacgtcttgggctgtgggggccctgaagccctcctagatgctggacattggtgtgtgtgcaacttggtggtggtgttggggttactttccagaagctactcaaggcttagtctcagtttctatctaaagatatttatatgggaagtattccaaatgtggatttataaagataacacatggatagaaatagtgtaaaacttgtgtgaactgaaccagccaagcttctagtcttccctttccaaaactttcctttttctccccccgtgttaaagatttaaaaatatatgtttaaaaaggtcacttttaacttgtaaaaattattcaacatatacagaaatttaaaaagcagcattgcaggttatgtgagattatgtatgtctgctctttggaactaggttgaaatgatagctacaaggttctttggaagaatggggatgtgtgggtgagagtggagtagacaggctgggcttactaactaggcttgcactggcccccgtcagtcactgttcccaagtcaaatactgcattgcactgaacaccagagcagcagtgcatttcctagagaactctgcaaggctacaggtggcagacttagggagcgcttgccatccctgcccttcccagctctacccagaacaaggaggcctcgcacactacctggtcatattttgacttcatgcatttaatgaaccaaactaaaggtaaatattttcttttgattcccaaggcagacttgtgggtacccaagttcctcagcccatctttaactcagtaggatgtggcatctccattgaggctcttcatggaatccctggaggtgaaacctcggtgtccggttgctccaaaccagtgctggtgggattcagttttctggacccatttctgggtgaagtcaaggaatggaggcgggcggctgtcaagcgtctctgttgctcaatggggcaggccagtcccagcggcgacttagaggtggctggctgggcgtccctacaggagaatgggccacagggccagcggggccagcaggatgagcaggcctggtttggggtatgggccgcaggcgtggagctcgatgctgggcaggggcctgctcactgacgagttgccacccgggattggggtaggggtgggcgcggtggtctcgggctctgagcggctctgcaccggcaggagcaggactggcagcagcagcagcagcgccagtgcggatcgggccgccatggccaagcgctccggctcgtcccgtagcagtgccgcggcggcggccgctgccgggagtgtctgttccgcggttacgcggggtcctctccggtcctgtccagtgaggtcctgacagctgtaccctggcccaacccctgcccacggctgttaacgatcagcctcggggagcaggtgtgccgccacgcgcgccgtagcgctccggagctggctctgcgctcacgtgctcgctgtgccctgcgcgcgggcgggccgtgtccccgcagccccgcgcctggcgctgccaagctgcccagcgggctttagcaggtgctgaaatgcccgctgccagtcgccgagtgctgggtgcagaggatctctccagacacctaggctcccttctttcgcggcacgtgggaaaaactcctgaagtgcgtgcacagagtttttgttttagaggctttgacgttatgattaagtatacctgtgatgtaacgaaaaccttttttaatgcttctcaaaagatttgctagcgtttaacatttacctcctgtactggagtttaaaggaagcgttgcttcttaagtaatcagtgatccttttgcttttggaaattgtaatgaacttcaccatcgtagagctttaatatttctttcctgaagcagaaagcatgtgaaattttctggatagtgtatacttaatacacaagcttttggagtttttgaatgctgggtatgttagcacaccagtcttgctgactattacgtgggagatgagtgctgcttaaaattgtgtaaggggtcagtagttacagtggtggacatacttttgccagacatggtttattttaaagtgaacatattttgtgcttatttatttatttgggacagggtctcactctgttactcaggctggagtgcagtggtaatcatggttcactgcagcctcaacttccaggctcaagtgatcctcccacctcagcctcctgagtagctgggactgtggggctacaggcgcactaccacacccagctaactttttttattttttgtagagacggagtcttgctgtgttgcccaggctagacttgaactcctggcgtcaagcgatcctccctcttcggcctcccaagttgctgggattacagatgtgagccaccatgcctggccaatgtgcttattttaattctaaatcagaatttctataattatcttccttaccttggtgtctgtctgttatcagcacaagggtttaaaataatttttgatttcttggaagtaattacgcaggcagttcaatgggagaaggcactttcctcagcacatttggggtgctgttgtcagaaagaaggggatggattcaagtcagcaaaaccagctgtaaccacaactatattttttaaacatgtagctgcatgttccataaaacagcatataaaaaatagagtgagcattctttattggagaaatagctgattctaggactgggcaggaaataacacaagtgccaggaatgccaaggaaatggcaaggaaatgccgagaaacaaacataaccacacccacatcaatgggtggtgtcaaagggacccaggagccaactgaaagagctcccagtggccaaagctggaacagtttctacaacaaaacaaagtagtattggattatagcccagagataaataaatatccatgagtccagactgacataaataaatgactgataaatgaggagaaaagacaaagctccttttccagcacaattccagatcatctctgcatctgctgtatctgctgtgtcttccaggaggtggagcacaacccttaccccaaggcaagggctgtgcagagcaacttccttccagagaggacagcatggaagtggggcggggggctcaacccagcaggggccaggtcagcctcacagtggtcagtcacggtgacagggtgtgcctgatacagtggagtgacagtgggccttcacctctgggggcttcatccccaaactcagtcccttcctgtaccatgagaaaaacatcagacagatcccagctgagggacagcttcctcaacagtcaaaaaccaagaagagtctgagaaactcacagccaagaggggcctagggagccatgacatctcaatgtcacgtgggatcctggacgactgaatctgacgaaagtgtggatttcagttaataacaatgtgttaattaatactggtccgttaaaccagcagtcctcaacctttttggcaccagggactggtgacaatttttccatgggccgaggtgggggctgggagaatggtttggggatgattccagcgcgttacatttattgtgcattttctttccatgattacattgtaatatataatgaaataatcatacaactcagcatcatgtagaatcagtgggagccctgagcttgttttcctgcaactagatggtcccatcgggggtaaggggagacagtggcagatcatcagacattggattcttataaggaatgtgcaacctagacccctcacatgcgcagttcacaatagggttccagtcctgtgagaatctaatgctgccactgatctgacagaatcagtgcaagaactgattctctgaagcccagttcctaacaggtcatggactgttacttgtccatggcccaggggttgggactcctgtattaaaccatgctcatgtaagatcttaataatagaaaatgggtgtggggtctgtggggcctttctgtcacatctgctcaatttttcttcaaatctaaaattgttctaaaaataacgtttactttaaaaataagtgttttttcaaaaacacttttttgtgtccttatcttctgctccaaataaataattatcctgacttttgtgtaagtggttccactagttttctttgatttcttaactctgtctgttacccttacacagtatatcctttggttttgaaaaccgagtagtcagggcacacttatcgaaccaggccccaggggtcagtgacggttgatctccaaggggttcacttttggggaggggggtccctcctggagcagtgcgttcagctagctcgtatactttttcacaagtgtgttctgttcccttcagcggggtaggcctgctaccctctccttccacttgggcttcccctttcttgtctgtctccttgtgcctggcagccttgggtatctgtgatatggctgtggttagttttggtgcagtgggatatatttatgtgctgcagtcacttctgtgaagagttaggtgctgtccgggtgctgtcagcttggattccggagttgtcctgtgcagtggaggctgtaaaggagcattgtcagggaagagaggctgttgctactgtacccatttgactggggactcctgggatagagtgagttccaagaaagagcagggaagaattgggtcagtggagacacagtgggggtcagggcatggacaggccgtgctgcagcttggagatacaaagaatgagggacgaacccagaactggaggtgtttctcaagaacagaatcttcaaaggttgagatgaaactcccatcatacttactagcaataacctctagcaaagttgaggtggtctgttttggctaaataaaatggacatagcattgctgggcccctgtgaagggctggaagcagggaaatgtcagcagtggcaagcgtgccctctggggagtagggaatttccctggcgctggcaggcagcccatgctgccgtagatgtttcctgctgtcctgggtggcctcacacagagcagctccacacctgctctttgaagttttcttggggtgcctgctggctacaaggggtctagatgtttatgacactgatataaagtctctgtgcttcccttggggaaatgctcccaagtatgaagcacccaggttctgagaacagagttggataaaaaggttgagttggagaaacttacctaacagggttaaagtggagacaaggatggcatgtgaagctttggctttacttcccaggtgatttttctgttacgcttagcatgcatcgttgctgcttcgttgttttgttttgttttgttttgttttgttttgtttttttagatggagtctggcactgtcacccaggctggagagcagtggcatgatcttggctcaccaaaacctctacctcctggggtcaagcaattctcctgcctcagcctcccaagtagctgggattacaggtgcccgccaccacacctggctaatttttgtatttttagtagagatgaggtttcaccatgttggctaggctggtcttgaactccagaccctcagatgatctgcctgccttggcctcttaaagtgctgggattataggcatgagccactgcacccggcctgcttctttgtattttaatatttgtgtattttatgattttctagagaagcattggtttcattttggcctaagtatgatacaagaggtggaaggctggtttctctgtttccttcagctgctcctgactggtcctcatctgttccttctcagatcacagttaactgaatatattttaaaagagaaaactcgtaagtgccctaaggaaataaggaattattttgaacactaaagctaaaagcattctaacattgtgttgcttttatgttctttactaaatttgcttcatgcacacacacacatatatgagtgtatttctcagtatgcagatgatttcaaggactggcttccttcgtgaaaacgtattgttggttgcaagaagataggggactggaaacatgattcgtctgtctgtagaggtgaagttccaagaagctcaccactgtccagtctttatgcttatgaacttgttgagtgagttctttttttatagtgtacccatgtctaggaattttggctgaaatcagcttctttgcttttttaggctttttgctagtgatagtgttgtctttgttctgtaaaacaactgtaaaggaataccaacaatctagtgcagaaattcttttgtaagaacaagctaccctgatgtcatgtcgtgttttaggactgtttgcttctcaacctgatgaagttgttcttagctgtttgctttgttttctcatccacagcagtattcctttctttgcctttaatgcaattgtatcttgagcaggcttgttaaatcccgtgggaggctttttttttttataggtcctttctctacttggctatgttgcctgctgagtttaaagcctttttatgatatttaacaaagccctctgtgttcagcgtgggttgtggttgtgtttaatgtttcaacctagactcgtgtattaagtacagatatcatctgtcacttaacttagccttgctctcagtgtgtttatcatcatgtctctaaggccatcctaaatacgtgacctggagagagagggggtggctaggccaaatgctgggatgcctgcactccgtttcttagccgtgagtctgtgcttggaaacccacgagaactctggggagccacaggccttggggcttttagctgtcccccttttctcttactctccggatgagtgacttgggaacttccgagcaacttaaaatatttagctcactttactttaataaaccatttttagtgctatctatgatagggtccttccagtgggaggtacacaaatttaacttaactatagttaaacaagagccagaaaggtaaagaaggtattgttgagaacaaatacggctggatgcacttttggggtgcaaatttgtctcttctctgtgtcagttgtatctccccaaagcaaggaataagtgctggagttgagtgcgtcagagcagggcttgtggcaaggcaggaagaggctgcacaaagcacagatgtgcagtttcattagtcaatatggaggaatcctgaggtacccactggctatgttgagtaaaggaaagaaaaaacaaaggcataccatgtggaaaagaagaaataaaactacctcttttgggagtatctggaaaaccctagagcagtcctgtccagtagaaatacaaaattaatatgcaaacgtcaatgttattcatatatacaaaaataatcagaagatattatggaagagacaaccccattaacaatagcaacaacgagaaaatatttaggaataaatgtaatgagaactgttcaaaagctaagtgaagaaaacaataagttgagaaagacacagaagtcgccttgagcaggtgaagacaccttgttctcggttaagatggcttggctcattaagatgtcagttgtcaggtaattttcaaatttaatgtgatgctaatatttgaaagcaaaaagactcagcttttttttcttgggctggacatgtcgattctaaaattgaaatagcatgaatacctagaaaacttagaaaagaaagagccaagaaaaggagaatagctctactagatattaaaacatactacaaaggctatatggaaaatagtgtggcaaggttgcatgaagaaccagacagaccaatggaggaaataagcccatatatagatggaaatctagtatatgataaagatagtatctcagattgttgggtcaaagatagattgttagagtcaacgttcttgggacaattggactccattttgtaaaatacatcattaggatttatagcttacaccacatgcaaaaataggctgcaagtgggtcagagaactcagtgtgaaaaaggcaactgttccaatgttagacacaaacatggttgaatattacctatgtgttgggaaaggcttttttaaaggcgtaactcaaaattcagcttcaacaaagaaaagatggatgaatttgactgcattccaaaatactgcgaccagcctgggcaacatggcaaaacctatttttacaaaaaatacaaaaataatttgggtgtggtggcacacacctgtagtcccagctacttgggaggctgaggtgggaggatcacttgagcccaggaggttaaggttgcaatgagccatgatggtgccactccagcctcggtgacagagcgagaccctgtctcaaaaaaaaagtaacaactttgcctgaccaaaaacaaaacagaaaaacacaataaggtcaaaagacaaaaataccaattgtgtgaaaacctttgtagcatatcataaatgttttaaaagttgagggagaagaaacccgaaattctaggaaaatgggaaaaaggtatgaacagacacatatgcacatatacacgtacataaacatggcccatacactttaccaagataccatttcttacagatgtgcaaataatcaaaagtctcacttgatagctatttctaataatgttgctatttctcatgtacgtgcttaattggaaatggtgtattaaataaaggtgaagaggcagttgccttttcagcttaaaagagcattaaagtttatgattgttaacttctaaatttattctcagtgtgctttgaaatagactttataacaaaagcagcactaactctccctagatttcctaggaagcaggtaccaaattcttatgcacctgcatgcacaggctgccaggatgcccccgctctactgtggattattctaggctgtttctccttccttccaaccaccacacccacatccctaaacctaggggtttaaatttaggtaacacacctagggcttgttaaatttaggtagtttccacacttcgaccttttttcttaggatggctctgtattcattatggatttcataagtcacatggctggaaggtacctgatattcttaggatggctctgtattcattatggatttcataagtcacatggctggaaggtacctgatacagattaaacacagaatttagttaggatagcattctgtctttgaaggctgtgtgattgcagcccaggccaagccaggcagaagttgggtcacttgagcagggccctgcaaacacacctgaaggaggtggcattgctaggactctacttttggggctgaatcagcagaggcaaaaggactgagtaagtccttgctgaggatggcacagctctcagctacagagctaggaccagaccaggctctggggttcatgcgggaatcaccagtctgcgctgctgcctcctcctgtatgcgtgtgtgtgtgcgcgcgtgtgcgtatatgtgtgtgcgcgcgtgtgcgtatatgtgtgtgcacgtgtgtttgcgcgcgtgtgtgcgcgcttgtgtgtatatgtgtgtgcgcgcgtgtgcgtatgtgtgtgcactgcgcgcgtgtgcgcgcttgtgcatatatgtgtgtgcacgtgtgtgcgcgcgtgtgcgtatatgtgtgtgcacgtgtgtgtccccatgagtcctgtggcaccaccgagttgtcatgaatgctttcgtttaacgagtcaggagcagtttcccattttgtaggctgtttttctgtgacctggattttaatggcttggtcaacaggtggaaaagtatccacctttccttatcagtctggaggctggttggttttttctgcgtcgcctgcgtcaccacttcctgatgtcagcgcacggggctctgcgcccccccaggactggaggctccgtgtagatggagacttttgtttttgtcccatcctcctggcatgtagaaggccctcaaatacttgttgaagaataaatggacgggctttggtattttataacctagcaatgcaccttttggttgtttccaggtttactattaaaaccaacgtcttgatgcccctctttctggatgcttttggtgatagagaagccaaatcacgctggttttaagcaaaaatcatgtatttgctcctgaaattttcctttgaaaactttctgtgtgcggttgtacgtcagtatgtggttttcagccacactgggaggcgcctttctctctctttttgtcgctatagacattagtggaaagccacaagtagcgtgggggctgcctctagtcacgcttcagctgcaagtgcggtgtgagcatctatttttacctcacagtcctcgctctgaaaaattctgaccacttttatttttaacattctgctctattagctgggtgcagggaggaaggaagctcaaattagtcagtttactttgtatttatttttacttgaccttttcacttccacattttgagaagaaaatgtgagactctttcctctgcataattttcttccttgaggagaaaccattttcagtcatgcttggaaagaggtggagataacctcagggtagcatgtttagcgttttccattcacgaaacaaaccttaaaatgttcatctgtttattctatgaaataattagtttcttatttcccacgaatttgaaaaccagtacatttctgtgccaagtaatggctgtgttttcttgaccatccggcaagtctctacctgggtgtggtgacttggggaccgcgttgtcaaagagccagtgaggcgggggtgtggagaatttgtttgccctttgtttttcacttacctttttctgcaggaattgaactaaacaattgctactgacaatgatgtattttaattcctaggaggttaaactcctcacctagaacagtttgattaataaacctaatctatttaagcatgtgtcaatccttttggaaattgtaatattcaaggacttgctagcatttatggctctttaaatatttctagttatagttgctgtcaggattcatttattttgattgggtaattagttttttaccattattttaaaaactaataaacattttaatcagatctcatggacagaaagccaagattcttgtgctgcttcctaaatgcagtgggcgcatctctgtcagtttttacctgctggaaggtactcctgagtgctgtgctgagctctgcccatctgtccatcctcttgggacactcatccctttcccattctctgctctgtgaggggatggtgctagtgagagctcaggtcgagagggctggggtgctccttcgtctctcagctcatcagcagtgacttggaagacaatcagggtctacctgtgttgttgagaagcgttacgcaagcaggaaagcgcacaagaggaaggcgcagctgagtgaagcattgcagagcccgccaggctgtgccttccacccaggccagcacacggagcgctgcagtccctgaaggcttcctcaggctcctcctgttggcgtgggtgcctgccactgacctctgtgggtgacaggtttgtcacttgagcttgtatcctgcaacctgtttgtttgggcgtgcctgtttgtttgtttttaacgttttaataaactttattttttagagcagttttatatttacagcaaaattgagggacaggtacaaagatttcccgtatgccccctgcccccacacaggcacagcctcccccattatcaacatccgtatccggagccgtgtatttgttacagttgatgaccccatgttgacacctcattacccagagttcatggtttccatgagggtgcactcttagtgttggacgttctatgggtttgtacacatttatgacgatatggatccatccttacagtatgcagaattgtttcattgcccttaaagtcctatgcttagcctattttttaactatataaatgcagtcaaaggatgtgtttttgtgtgttttcttttgttcagtattacatgtgtgatgagacttgcctgtgttgttgcctgttcgtttttactgctgtacatagtactctgctgtttgaccatatcatatattcattctgctgacgatggatagttagacggtttccagtttggggccattataagcaaaactgttctgaccatactgatacatgtgttttggtaaagaagcacaggtgttgctggggtggatgggctggctgtgagcacacgcacttcagcgtgagtgggtgatgctggcatggtgcctggttgggcactcaactgcctgctttcaccacactccccatgtggcatcaactgctttggaagtttctgtcttcttaatttttaccattctgggcaggtgtgtgtggtatttttctgtagttttgattctcatggacctgcttactagtgagattgagcttttgttacatttcatggaattctggactctctgagatgcctcccaaagtgcccagctacagcctctgtcatcagggaaggagcaggtatgggaatggtgtctctgcacacctcatgtcttgcctacatccttcttcaagaaaatactggttttccccctgaaaatgatagaaattgactcatcatttttgagtctagctcaggtgtcttttctggaattgccttttttattcggtgtaaagaggcacagggacttcatatctgctatagatgagtgaaggttgcctagacatgcacacaaggcccttggtggacttcccctatccctggggctcctcataacccttccctcttctcttccctggactttctgggctggggccagggcttggggtcgggggtgagccttcctctcggtgtgtatctctgtgtagagttgcatggtgagattcggcttctgttctaaatgcagttgggtggaaataaagcagggatggtcctgagtcacccacattcctcttggtcagtctgccctggtgtgaggagctggcagcctctgcagacctttggtcccacttcccatttgggggatgtaggcttgtgttataaaataggtgaacatgtgatttactgatttactgcttgaacagggacacttttgagagtgaaagggcctgcaattattaatgaccccaagatgacatgtgataacgaggaagttctggggagatcaggtcatgatccccagagttatgatctcaaagatggagagtgtcatagggaggatgcccctctgtgagttgtgaggggccacgtgtgtcctgtgtacacaggccctaaggggtgctggggccatgtgggtagtcataggaagatggctggagttgggaggcagaatgtttaagaagtatttcactcattgactaaacttagttgagttttatttgtctgtgaaaagggaaatctacttgccttgcttgcacgcctttcctagggatattttggggactaaaatgtgatagtgaattttaaaatattggttgaaatggccaggctcggtggctcacgcctgtaattccagcactttgggaggccgaggtgggtggatcacaaggtcaggagttcgagaccagcctggccaacatggtgaaaccccatctctactaataatacaaaaattagccaggcgtggtgttgcacacctgtagtcccagctactcgggaggctgaggcaggagaattgcttgaacacaggaggtggaggttgcagtgagctaagatcgtgccactgtactccagcctgggcgacagagcaagactctgtctcaaaaacaaaacaaaacaaaactatatatatatatgtgtgtgtgtgtatatatatatatgtgtgtgtgtgtatatatgtgtgtgtgtgtgtgtgtgtgtgtgtatatatatatatatgttgacatgtgagtttttcagtttactctgaactctctccttgtctgttttttaaagcatcctgaaagggagtgtctgtacagcgtcacctgttaacagccactaggaagctgccctgagagttggacctggccgagctctctgatacttgagcagccctgcccagaggagcctgtgcagcacatgagggttcttcagtattggtcggtgtttcgggagcccttacaatgaatgaacacagctgcagcccagtgacccctcttggacaagtgcggagatcagttttagctcagctgctttctgaatgtttcagatatttcaaactggaagtcacaagtagcttttacttttgcaagcagtctgctgttatgaatagcacgtataagaaaatttataattcagttagttaaaaatatgtttgagcacctgttaaagcaccagaattcttttataaattgaggaaagccatgccatctaacacatatgtggcattaagtgttcttttaataaatattatgcttagtagacatactctacataccaatcagaggttgccatcctaaaccaaaactacatatccagcacattctgatattaggcggtggcttacaccagggaaggcttggaggttgttttggctcctaccctttaaaaggcttaccagcttttagatggagtcatagataagacatggatagtaacagaaaggaagcatggcttatcagctgtgtcaagtcaggacacatgtatccccattcacattgctgaactcaggaagatatccaagcaccattgtgacatacttgtccacagagaccgcagataaccccagcaccctctcagagtggtgccttggtgtttttgttcataaagccttgatgctcaggcccatccgtcatcccgggcaggtgcgtagcctgtgtggtggatgccagggtcaggggagggctttgcttttgcagagtctcgaggcttaggctgaatgtgtttttaaaggtccgactatactgaaacaaacattaaaaaatattcaacatcacttaatttttattgcttaagagcttatctggctctcccattggctcagtaatttggttgctattaataacgttgttgaggttgtcatcgtcaccttaacattgtcatcatcacctccagtaatagctaacatttattgagttcttcctccatgcaggaactgtgctgagttctttttctgcattattttattcagcctttgctgcagccatctgcagcaggcactgttactaaccttctcctgccagagggaacgcttgagatgctgcagggtgacagtagcctcagagccagggggctgcattgctggatcttcaagcaggcaaactgccaactctgtgttcataatcctggtcatgggctcgcactgacctgtagagagctggatatggggaatggattggagagcttttatttgaaacaacagcaaagtggcatgatcttttgggaatacactttttcaagtcatgtatccactcacagacaggctttgtgagcctcttgctttgttaagggcccagggaagattttaaggcgaccaaacttccagtgacaaacaatatttgaaattagtctattcctttaccccagaaatgcagaaatacatggttttggatgtttgacctcattggttggtgggcatgaggaggtggtctgctttggtgccagtgaccgtctgtgagtcacagagtgagtgaatgctgagccgctgtgatgggaaagctctctgctgagttggttcagtctgggtcacagagtgagtgaatgctgggctgctgtgatgggaaagctgtctgctgaattggttcagcagtgcacctgcttcctcacggggcattagccggtcagggcgatgtctctggatcactcaacttgtccctgacagagcaaggaataagaaacccagttagattgtctgtatcatcagatgccatttacatcccagtcaaattagcagccagatcactgatttcttataggtatacatcttttgacttcagcataatctcttcccctttttctgcatccttgggttttaaaggatgtttactatgtaaatgtttaacatgtttactatttaaacttaatagttgaggtagcttttaaaatttgtgtccattaaacccaaggactcttgcagaagtcgtatggtttttcttctttcatctataatgcatgtaaggaattattcacttgctctaaagttcaaatgtgtgagtttctggtgctgttacataacacgtggtattgtgggtcaaggggagttagtgtctcacctaaaatctggggccatgatgtcaccacattaaatagtagggatgcttgctcatcttttaagggtatttcttccccctgcaaagcaaaatgctgaagagatacatatttgttaattaactgatttcaccctcgtcatccatcctctttccataaggaactgtatgttgcattcttgctgagtgcagactaagtcctttgtgcaaggttgggtcatcctggggtgaaaaggtaagtgctttcggggatgctgattaaggtggtatctgctgtgcctctctcagtgtccccagggcgaaattcctcaggttacagtggcaggaacagctgcttgagctcatttttgtcttctgaacaggatcagtcttggaattggccttttctccatcttcagccccagggtggggctggcctgggtagggcctgcgcctgtgcttgctgcgcagcagcacccctgcgtgccttcccttgcctcggctgctaagtctttggagaaaactctacattgccaagcttcttctgaaagatttaattttttatttagaaacagtatgcttattacagactgtgcagactttgcagaaatgcaaaactaggaagagacatattagtccctttgcatagaagcaacttttgttattattttgtatgtttcctttgtatctgtattagtgtgttctcatactgctaataaagacataccaaagactgggtgatttatgaaggaaaaaggtttaacagactcacagttcagcatgactgagaaggcctcaggaaacttacaatcatggtggaaggggaagcaaacacatcattcttcacatggcaacagcaaggagaagtgtccagcaaaatggggaaaagccccttacaaagccgtcagatcccgtgagaactcactcactatcacgaaaacagcatgagggtaactgcccccatgatacaattacctcccactgggtccctcccacagcacgtggggattatgggaactacaattgaagatgagatttgagtggggacatggccaaacaatatctgtgtcttttttcatgtatatgttttttttttcttttctcagcataattgatatactgtggttactctacctatttgtgtaggcctctcaggtcattgaaacaagatgttgtacaaattagcagatgacactggcgcatggaggaatggtttgtattttaattttcactgtataacattttagtaaagcttttactggaaatgttttctacccatatcctcaggaaaccatgtgaagtagacagccttgcatttcctggattgctccctcgaaggatgaagggagcagttctatcagatgctcttcccagcctccttctccagggagacctagccgctgctgttttgagtttcctgggaggacatcccccaaggactctctggcttgtccttgtgaagttggtttgctttttgtgccagctttttaggcttacaaaatgttgtgtgtgtgtacataggaaaaatatggaagggtacgtacccactagtttgtgtcagcactggattctggcatatataatagatgaggagtttctgttatgtatatgggatttctgagatacacaggggttttctgtgcacatctctctataacgcagctgtcccgtcacatcctgcatgtcagtacaggtagtgccgttctcttcgtaggactgtgacactttatctttgttctttcacagttaaaaaaaaaaaagcttctttaaaattctgactttatataactaacgcaatgctcatgctacttcacttgttacaagaacatattattctgtcctatagatgtactgcagttatttaatggatcagctattgataagggggcccttttaatgtaactattttaaaaaatggaagtaataccagcacatggtaaaaaacacattgcagctcatgaatgggtataaattaagttggagatttcctctttctccctccccaccccatgccccgtttccagaggtaaacaatgtacagtttgtgttttcttctcttaagttcttcttgtagtcaccattatagctttaacttttctgtttgtgagttcatgtggaagtcaacagtgccttcacactctgagttttgatgagatttatattgacaaggcttaaaacatttgtagtgtttcccatctatcattaggctccctgtgcttttcctgcaagtgtagtctaaacattttaatataagaaaagtaacatttatagtattatgatagtatattttgccatagaaccaagtggtatgaaatgtaattctgcctcaccaaacctttgccaataaaaggagaatattcagatggaactcccagtttctctttaggtgtccgctgtttctagctgcctcagttgccatggtttctcctatcccatggtgttggtttcttggattctatttttgttttgctggagcacctccttaatccacttccttatagaatggatggctgacagacttcttaattcacttccttatagaatggatggctgacagacttcttaattcacttccttatagaatggatggctgacagacttcttgggtttttgcacgtaatgttcaaacatgcaattactttgttctcatacttattgataatttggtagggtctagaattctaggatcgtataattttccttttgaaatcagaaaatattctctattattttccagagtctagtgttggtaatgagaagttggatatccgtttgatccttgttctactgcaggtaaacatcttctactctctccttctctccctccctgggcttcatgtcctgacggtttgatttttcgttaccctaaacccggatctgcttctcttccagcccgcgtgcccatattgggatcaccccttagaaaacctcaggctttctttggagagcgattctcaggtttcagcccaggaataaaagcgttccctatggctcctgcttcttgggaagacccctcacctctgttgtcttgctctgcagtttcctctgctctctcgcatcaacctgctttcgtctgccttatgccctaaaagccctggcaggctttcttgtgttctgctaaatccctctgtaaatttttagcaccgtgcactattatggttcattcaccaccaaaaagtaccttttctgacattttaacagagctctgggaagaatggagagaagatatggtgtactttatcaccatttttaattaaaagcccttttaattaattaatttagaggcagggtctcgctctgtcacccagggtgaagtgcagtagtgtgatcgtggctcactgcagcctccaccttctgggctcaagcaatactcctgttatcagcctcttgagtagcttggaccacagtcacgtgccacattgactgattaatttttaaattttttgtagaggtggggtcttgccgtgttgcccagactggtctcgaactcctaggctcaagccatcctcccaccttggcctcccaaagtgctgagcacaccactgtgcctagcctaaaagcctttttagatcactctcagtggcaaaattagtgccttggtcacctttaccagtagctgttcttgctctccagtggaaatatcactcaacattatcaaagaatcgggatgaaattaaatgaaccagtttaggtacttttgatacagaagttcttatgagacgtgttgttctttactatgtaagagtgtggccataaacttaaaaatagctgggtaactttgttacacttgccttgatggtgtgttgcaagttagttaaatttcatatactcttaatcagcacatcaccaacaaataaaatgttactgctgcatcagaatttagaggaggttctatacatctgtttcgaaataaagacggagatgacttagggtacttataagttgttgaaaaatcatggctcctgaaactatgaattgtcatcgtggtatatacccagacagcccacattaaactgctgtgaacatgagaaaatggacatcgaaatgataaaagcaagagtgttggtaattgaaatccattataaataaagctgtcattggtaacgcacgaaatgctgtttctgaggatgaggactttgtggcccccacgtgggcgcattaccaagctttgcagctctgcacaggagcctcccttcttgatactgaactagacctctataaagcctagtaacacctcaggtttaggttataaatcttaaattttagtgccccgtaataattcacttcgtaggttaccatggactagcccttagttgcactgagaaaagaaaggctatgaaattttgttggtgaagtgccaaagaaaggattgggttttgggtcatctcacagcccatggtgagggctgtctttggcctctaccgcacggacaagtttgcatgtcagatgttggcacacttgtggggtattgggttcttttgaatatctgattaaatccatttacattttcgttagaaaaattcatctgtgcatatgaacgcatcatttcatatatgatttcacacttctcattgtcttcctgaagcccattcgtgaactgtcgattgaatgcctgctctggagaggagtgtgaagctgcacttcttccgtctcctcctggcactcgctcaggatcctcacaggtgtggaaaacactctaaggaagcctgcgaaggccagatgtctcccttttgccttctttggttctgttcatgatggccttatcacggacacactaggaccctctgaggacaccacccctgccaccgcattgctctgggggcaacttccgagcttattgtcttcctccagcaagggcaggaatgtggagaagctgtgtgtgctgggcctttactttcattattggcgacaatgtttgttttcattttatcagctttctttatcctccatttttttatcttccacaggtagtgtatattttgagaacagcgtgaggtttattctactaatggaaatttacaaaaataccagtttgaatgattgagaaatctaagttaaagaacccttgaatagaaatgtcgctgttcagtgcgttgatcgattctcacatctgaagccagctgtgtattcttggtatgtgtgtattcaactcaggtgtgacctactgtcttttatatgtccctggatttaaatatgctaattttgttatgatttttgtgtctacatttgtaaaagccgctgatagttcatgtctggcacattcttgacagattttactaccgagattatactgggctcgtaaaacgagtgggggatgttccctgtttttttgttcgctggaacggtatgtgtaagctttgtgcttttcctttattcagccagtgctttcacatgctgcttccttttatagccactcttttttgctacatattctttctctacaagagcacagttcttctggaatgtgtcccttaggattaactatctcaggtgtgatttgtgtgaaaacatctttattcttattgtggaaagactgttgttaggtggggagtttactttcccgtctgcacattgaagatctcatcctgctccactactggtctcttccctgggccctgggcatccgctctcagcctgactgtccccctgtgctcccgcatcatttctctgtgctgtgtctgggttcatgcttatttgtatttattctgctgcgggttagttggccgaatctgtttctgtgagagctcccatgcttttggtactttctgtctctcgtgtgtctctgcactgctttctgggttattgcttcggttctactgcccagtttggccattttctctttaactgtgtctaatatgctgctaaaacctgtccactgagcttttagcgttagtcattatagctattatttctggagggtctctctgcttccctgtcctgccaagtccaattggtcattcttagtttacctgtttactaactgtttgtatctcctttagccgttgttttctgtacgtatatggtgtgtttgacttttccagcatgttcaaggctgttttcccagctgtatcccctcctctcgggccatcaactttttgttccccattgttgctactaattcttaggactaataaagcacttcaaatggcagctactgtcaaaaattaggaagaaggcttctttgccgtagcagcctccagttgattactttctcttgacctgtactttacttgccacgagcatatcatgcctctgtacttgctgcagtaattactgtctcgaaacagtgaaatctcatcagttgcccatatgtgtttaactgcacacgcgtgcatagtcttggctttatgcgaggtagaaaatgagagtacttagtttttggcagagcagagcctcaatttccacagtctaattaaattataatgataaatatcactttaaaaggaaacagttgcttcgtttaatcaatatgattattactggcacagcaaatccatcaagtgctgtgaatgataaatgtgttttaatacaacttgcagtgtacttgctgttggtacaaggcatgttaaatcctcagtggtccctcttttcatagcattgctgtggcactggcatttccctttgttaggagatagtggggtataaacccattgtggaaaccccttcagcttgacaaatttggagtcatgctattttcagaagaggatttcctgcgactaggagcagtcacccagagaaagctctggaaaggtggtggtgctggggttgaagatgagctgctggcccctggcatgtcagtgggcggaggtgggagacgtgcagagctgcctatcccacagtacttccctttccccatccaccctttcaggtggctcactccccaccagtttcgcaggatggctcaaggcaaatggagaaaacggcacaggttgaaactcttggccgtagcttgcgagcttgcctcttagcacctccaaccacgatctccttgaatgtagtctcctcagtctctcttttttgtgtgaggaatataaagtttctagttgccttttcgcataatctcatagctcttctgcacctgtggttccttagctcttatctgagaccgtggcaggcagacagctggttgcagtggttggttagttgtttcatatggttgatcatacagcagctacttggtcccattgttattgatagtattgtataaaatcagttgtcattgctggcatttttttttgttctgttgcctgattatttgttttctaatacatttttattgtgagatacctttcttgaacatggacacatatataagagaataattttaattgcatgtccatgtaactctcacccaggttaaatagacactgtgtacctcacagtttccttcatgctcctccctgatgataactccccctcatccatatgacacatctaatatatactacgtgtgtgtgtgtgtgtgtgtataattaattataattattattattttgagacaatgttttgctctgtggcccaggccagaatgcagtggtgtgatcacagttctctgcagtctcaacttcctaggcataggtgatcctcccactgcagcttccagagcagttgggattacagacatgagccaccactcctggctaattttgtttactttttatagagatggtgtctccctgtgttgcccaggctgttcttgaactcttgggctcaagcgatccttccgcctctgtctcccaaagtgctgggcttacaggtgtgagccatcgtgctggcctttttgtttgtttttgagacagtgtctcactctgtcactcaggctggagtgcagtggcaggattatggctcactgcagccttgaactcccaggttcaaacagtcctcccgccttagcctgctgagcagctgacaccacaggtgcacaccagcatgcctcgctgagtttttaattttttgtagagatggggtttccatgtgttgcctaggctgatcttgaactcctggcctcacgtgatcctcctgccttggtctcccagagtgctgggcttataagtgtgagccactgtgtttggtaatatcctatattttgaaataatactgtccttttctttttaattttaccatgtaagaatgcatccccaatcaatgtagttcagttttgcctgtgatggaactttatccaaggggagtcatcagtatattcttttgtgtttctcttgatttattaatgaagtggattacataaatcgattttcatacattaaatcatgtttgcattcccatcataaattcatcttaatcatgtttgatcgctttaaaaaatattattggattgagtgtgatcacattttgtatacgatgtttacactgtatttgtaagattgacttactgcttccttttcatcttcacagaagtgtcttgttgaatgttggattcactttctagagaagccatctagtcatggagtgttctttccaggatgatttttgtttactgactataatccatccctccctccctgcattccttccttccttcccttttcttctcttttctttttcttgagacaaggtctcactctgtctcccaggctctagagtgtgatggtgcaatttcggctcactgcagcctctgcctcctgggctcagacgatcctcctgcctcagccttctgagtagctgtgactacaggtgcacgccaccacacctggctaattttctttattttttttgtagagacaaggtctcactatgttgccaggactgatcttgaattcctgggctcaagcagtctgcctgcctcggcctcccaaagtgctgggattccatgcatgagctactgcatctggcttctaattctttaatgtttgtagttttgtcagattttctgtttcctcctgagttagtgttaataagttgtatttcttttctttttaaatggtgtgtgtgtgtgtgtgtgtatgtgtgtgtgtgtgtgtgtgtgtgtgtgtgacagggtctcactctggttgcctaggccggagtgcagtggtgcaatctcagctcactgcagcctcgaccattcaggctcaggtgatttctcacacctcagcctccgaagtagctgggatgacaggcgtgtgttactacgcctggctaatttttgtatttttagtacagatggttttgctatgttgctcaggcttgtcttgaactcctgggctcaagtgatccacctgcctcagcctcccagagtgctgggatgacagacgtgagctaccgcacccagcctaataagttgtatttctcttggagtttcttcatttaacctaagcttacaagctttttggaataaagtttataaagcctcttactatatttttagtgttgtcagagtttaagtgataattccattttggtttctcttgccgcctgatgacccattcccaacttagtgacataaacaacaatcactttattaatgctcagccaggtagcctgagtgtctggagctctgcttctggctgtcagctgtggctttcttggttcttctcagtgtcctgtatgagaaggcttcttcagtgaggtggctggctcccgcctggggctgactagacatccttctctgcatgtagcccctgtgatctcttcagagcatctgagttggctccccagagacagtgttcccagaaataggaggtggaatctggcttcctcttcaggtgctggtctggacctggcagtaccacgcctgctgcgttcaatgggccagagcagtcacccgcctgctgggactcattgggggaagtaagatcttcccacacaaggacaggagagtcacattgtggccatcaggccttcctgccctccaattcaattccaaggctggttaatttgggctttttctcttgtgttccctttctgtgtttccatgagtcttgccagagatcactggttcactgcattgtcttttcaaagaaccaatgtttatctttgtgtacctgccgttatatgtaattaatacaggttgaatttcttactagttccctttttctgttttctttgagcttactttgttcttctctccctgacttgttcaggtaggcactctttaatttttttactcctattctagcttgagcaccgagctataaaggtccctctgatgtactgctttatctgtgtgccacacaattctgtacataatcttttctagttttaagttctaagtgttttctgttttctcctgtgattattttcttttgtctatggattatttagaagtgtattgctgaactctcagacatatgggactttctagttatacttggcttgttaatttctaggctcatggtattacgatcagaggatgagctctgtctgatttcagccacctgaaatatgttgagattttctttacggctgggatatggtctatttttagaagtggctcatgtgtccttgaggagctgatgtgtgatgcactgttaggagcagcgtcttgcatgtgaccaccatgcagcttgttaattgtgttgtgcagatcttccatctctccactgttttgttttttcagccgctgtctgctgtctctgtcacctgctcctctccactccctccatgacaaaaagactccggtgtttttgaccatcttttattgcgcccctactgtgatcttagtcacggggccaagcactctacatctgttcctccatttaatcctcacggcaccatctgcggcgggtgttccttgtgtcctcgtcctgtcctcataggagcaagcctggaaggggctgagtcactgttcaagtcacacgactgcaaggctgaggtctagggtggtggcctggacccctctttcctggaagccatgcttttcctgaaaccccttgcaatactcctggcaagtatggcagttttacctcagttggtatgagtgtactcaaatgggaggcaaccattctcacacttgatgtttagactttgcagcttccaaaacccactctgcatatcacctgctccctcctcaaagtggctgggcttcccatgcagtttcccatcctgcagacggcccagggaggtcagatttcttggccaggcttgcagagttggtgggacatgatgtgggcactagaacccagttctgtaaatcttggtttcatgtcctttctgctgtgtttttctttctctgtttaggcggtggactttttggtgtgtaaagcttctagaatggattttacttctttgtggctctttggattgagggaggggctaggtgccatctccagagaagcttgttcagctcatgctcactcggggcccttgctctctgcccactggggaggggctgtggtggagctggattcggactgagtggaggcaacgctgaaggtcagaggccaacgtccttgcacttcttgacactctccacccaggcgtggtgattgggaccgctggggagggtgatttgggagcttgaatctggtgtggggatgatgggggtcattgatagtggggacagttctggacatgtggccctcattctctgtgctggacaagatgactctgtgacctgtaattccaggctgatagagcattttcagtgacagcccatttgacttgatggtgctagtgcaggacacaggtgagcttgtctctgtgtcttaggtctgtcccagcagacgagctgacgtgtgttgtagatgaatgtcagctggtcacaggtgggaggtttggaaggtagcctccaatctcctctgaggactgcagcagcgaccggggcagcaggaacgcattgtgatggcctggccaagtctgcatagcgagagtcgagccactttcacgcgcaccttatcccacacttcacctccttcctccaggttcccactcagaaacccgctcacccctggacacacctcccagagacttctctttggaactctgcaatggagaaacccattgcagacttccccttcttttggatatcagtttgcttttcaggaagaaaattttaatactccatattgaggttttataattatattagcatgttgaaacattttctctaatggcttgctggttgaaaacgctttcacacagagcagaaactagatggagatactgtttcacaacctctgcttcagaagcagaggtggcctgtagcttccaaacccgggcagagcacgtgcagggatggtgcgtctctgtatctggactcacattcacatgtgtgcatgtgtaggggtgtgtgcatattgaattgtaaaaaagatgagtacgtgtgagattctgcctgagactccagtcctcagtgtgtggcctggtgccgctgatgccgagatgttgggctggcagcgatctgcctccgtctgtcacaggtgcctctacctgctgcaggcagacggacggagacgtgatggattgcgcatatcccctttacagattcggaagagtacatttaaaataacttaaatttgtatttagaagacttttcatggagagtatttattgttatagagttcacttctgaaatggtgacaaagcttttgatactgaatcaaacaagtgtgaagttaccgaatctctctgttacacagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaaggtgagtaaaaacctgtaaagatctgatcaaatctgactggtagaaatgcctttttcttgatataaaccgcttaattaagccttttggcttgcctttgaaagatgctttattgaatacttcccggcacagatgatctgttactgttggttgatttctaatcttactgcagccttagctcacccatgagtccctcctgcttgttctggggtggtgcctgctgccctccagtggcatgtgtggcacctgctgccctccagtggcatgtgtggcacttgctgccctctttggggtcagttcaccatttattgagtcagtgcttcatgccgggcactagacttggtgaaagccttttaccatcaattattattttcttaggagtaattaaaagaaaattttcctgtaatcccagcacattgggaggctgaggcaggcagattacttgaggccaggagtttgagaccagcctggccaacgtgacgaaaccccatctctaccaaaaatacaaaaattagccaggtgtgatggtgcacgcttgtagtcccagcctcgggagactgaggcaggagaatcgcttgaacccgggaggcagaggctgcagtgagctgagatcatgccgttgcattccagcctgggtgacagagcaagactctttctcaaaaaaaaaaagaagaacatttctttagtacttatttttggcgactatctcatgattcagcgtctgcttttgagagaagttgtgacaaatactaaaatcccagtaaaattagtatggtgtcagattaatttacttatgagcagctgagtgactaactcaggaagtccagttgtacatttccagggaagctttttcatgggttcagatgagatgaggggaaagagaaggtgtcagagggctgctgctggctggaggaacgcaggtgtgctcctgtgtccatttgctctgtggatactgacgagcgcccactgggcctcagatgccctctgggcatggcagggaccaggcgctcgcttggcagctctcatgtgagccgctcactggacacagccgtgctcccgcctgggagttcgggatggcatgcagagctgtggggagggagcggtcaccagggcgtgagtgtggacagatgggagtggctggtgcagagccataggtagggggcggtcaccagggcgtgagcgtggatggatgagagtggctgggagcctaggggggacgccgtctttggggagtagagacacacccatgtctgactactgggttttgagtttgtgccagcaaaggtcctgcttgccatttctgtctgtaaatgtcaggaatttcaggtaactggttccctagcgagacctttaaaggaggctttatcttcaaccgatgctttttttgggggggtacacaggcagtccaagtatgggaaggtcaaaatcaggtcacctttatcatggcttgtgctgtgggatgggattttattttcagccacagcgcttcttctagcttaattagtgataggaaatcagcttctctgtaaccagaggttattgaaagaatgaggatcccagagttggaatgagtctgaaagagacgttgtggtttaatattgctaagttaagtgtcgatttgtgactacctatttttaacatgccacagaagtaaaacattgcattaattatgccatatatgtgaaatagcaagtatttttatataatataactgtgcattggagaaatgaattatttataatcctttgcaccaataaattgttcttaaaagcatagaaaaaataatcaggccagaaggagatatctaaagcatgtgctgagaaagcaaaactgaagagctggaaattataaaatattacgacatgatgagtcatatctcctcctcctgattctgtgttactaaatgctagctgcgaatagaaatcgtgtatttcctttctttcataaaataagagctaatttcggcagcaaacagtttggcgtgttattcttttcccttttcagggtggtttaaataaaaataaataaacatgaaagattttggctggaacatctttggaagcacggccgtcctcagcctcactgcactgtctggtttccctctgagcctccctcccgggtcctgccttagtgctgtctgtgccgtgtagccacaggtcgcactgcagggctgtggggagttatttttagtttcaggcagactcactgtttttgcctttctttttgcttgaaaagactgaagttatttcttgtgtttttatacatgagattatcttctgaggctggaacatcttggggggatacaatagatagaattcctatagtaattcccctgcgcaagaggaattgctgaggagggcttcgggaaaccttgactcttgttgaagcctggaaagctttctcagtctttctcattgccaccccacaccacatcttctttttgtaacaaatatttattaactcatctttttattttaaaatgaagttcacagaagatattaccttatataattatagccatataatgttaaaaagcagtgtcatgctgaaatgtaatataaagagaaactgaagatacataataaaatagttttctatgccactgtatggacatttaggcactgctgctttcactcggatcactgagtggtgtgggcctgtcagtgcaggcagatgtggggtaggtactgagctggtgacctgaaaaccataagcaatagagctgagtggcattactttctgaaatggtcaaacctgaaggaagcagtgttcagtcttccctgtctctaggtagtctctgtatttctggaacattgagtgtatgttaaaagtatagaaaaatgcattgtgtcaatccaaaactcagctgggctgggcttagagaattatgagcagcctttccacctgcatggaagtccttttgtgcaggacagttccttgtttccggggtggccctgctccctccaggaggtttaggagtgcccatgtcaccatgatgcctacgccacttctcatgttgctacctgttgctaccaccgggcatcgctgccgcctcctgctctgtgcacagtgtggtgtggccgcctgaccgactggtcaggaactaaagttctctcgaagccttgactgaaaggagaagtgaggaggggcatggagcccagtgccaagaggcagctgcgtctttaggggctggcacttttcagaggggctcttggggccagaaggaaagagccgtcattcaaggcttacacagcgtggaggtgccctccctggggtgtcctgtgtgctgacctctgtcctggtgcctggcggtgtcctggcgcagagctccgcaagcctctgcggggctcttctctgtgtggaggttctcgagatgggcagtccgggtggatggtcaggccaatgagggccttcgaatgaagcacattattgtaaggatgctaattctggatcctcagatattgtgacaaaaacttgacatttttcttccttcaaagtaatttattgactaaaataaccaactgagcaaaggtgatgttttagtatctaaatattccaaaagattactgaaattttaaagtaaaaatttggccaagaacgagaagtctctgaatgtgcttttctggcatgacccctgtcaccaggaagctgtcagtgtggtgttgggcctgattgattcgcatcagctcaggtggcgtcctattggaaggtcggcagtgggagagcagctggccaggtcagaggattcatttctgtctgaagctttgtgaggaactaagatggcttttccagtagcctctgtcattccagagagttttaagattgcttttatttgttcttctaccctggaactaggaagccagacccaagaaatgtatccacaccaggttttgcccatagtttttaaaaatgttgaatttctttaacttgaggccctcacaattttctgggcccccataagttatagaacagggaccaggcctgctaccttgtgggggctgggtgggcactggctccccagggcacagatccttcctgtgggtgggcttaggggatgtgagggattcactttcagatgtgacactccagatgtggggttggtggcacattttttttgtccggttacatccaagtaaaaaggaggacaaattcttactgaacctatgcagtaaactccattgtcaggaagagtaaagtgtcttagcatgagtgttcctgaattctgaaagttcaggagagtaagatgttacctagagagtgttttatttcagctttgaaagcagagtctactggatttagggctagagatagacgaagaagaaagagaaggggcttctttgagcgcacattagaaaatacaccataaaagaaaataccgacaatcttccaaagccacagtcagcgtttccctgccagctcctccagtcttccttccttcctgtctgctgggtggcggctcatctgtcaagttttcacagtcatgtgcttctgggcgcaaagccctggtgagcctggctcgtttccctggtggaatcggacagttgtcgaaggggtgtcagcctctgttcagaagcctgagcccctgattctgttccttgaagtgtcaggagttaaggtgcctgtattgagcaggggctgccgttgcttctgactgagggtcctcttcaggcccactggctcttggcagagctcagttccttgtgaccataggcctgtggcgcttggctcctggagactgcccatagcccctgccctgtggccctcttcccagcatggcagtttgcctctcaaggcgtataggcagggtctcccctcttcctttcctctctgacttctctcatccttcaggggtttacctgatcaggccaggcccacccaggaaaatctcccttttgatgaactcagtcagctgatgagatgccttaattgcatctgtaaaatcccttcacctttgccttatgtaacactatatcccatcatgttcacagttcctcccgcctgcaaggcaggggagtgtacaaggtgtgtaccccaggggcaggatgctaacactgcactgactgagaaaagaatttgtcttacctgtacctgacaggtgtgtacctgaaagaggtgtgtgcccgacggtgtgtgcgaccgatgggtgtatgctcgacagtggtgtgtgcgcccaccgggtgtgtgcccgacggtgtgtgcgcccgatgggtgtgtgtgcccgacagtggtgtgtgcgcccgatgggtgtgtgtgcccgacagtggtgtgtgcgcccgccgggtgtgcgcccgacgggggtgtgtgcccgacagtggtgtgtgcgcccgacgggggtgtgtgcccgacagtggtgtgtgcgcccgacgggggtgtgtgcccgacagtggtgtgtgcgcccgacgggggtgtgtgcccgactggtgtgtgcgcccgacgggtgtgtgtgcccgacagtggtgtgtgcgcccgatgggtgtgtgtgcccgacagtggtgtgtgcgcccgccgggtgtgtgcccgacagtggtgtgtgcccgacagtggtgtgtgcgcccgacgggggtgtgtgcccgacagtggtgtgtgcgcccgctgggtgtgtgcccaacagtggtgtgtgcgcccgatgggtgtgtgtgcccgacagtggtgtgtgcgcccgccgggtgtgtgcccgacagtggtgtgtgcccgacagtggtgtgtgcacccgacgggggtgtgtgcccgacagtggtgtgtgcgcccgccgggtgtgtgcccgacagtggtgtgtgcgcccgacgggggtgtgtgcccgacagtggtgtgtgcgcccgatgggtgtgtgtgcccgacagtggtgtgtgcgcccgacgggtgtgtgcgcctgacaggagtgtgtctgacatgggtgtgtgagcgcccggcaggggtacgtacactcggggtgtgtgtgcctgacgtgtgtgtgtgtctgacatgggtgtgtgcacctggcagaggtgtgtgcgcccagcagaggcatatgcctgacagaggcgtggcttagtgttcagggtccatagtacatgaagaatcctacagatccctatggacaaggcagtacagtagaatttggggcaaaagacttgcacagattttttttttttttttttacacaagatgaaattgaaatggccaatgagcacaccctcattcatccagcgagcattgaggaccccctagaggccaggcccatgagtgatgaagatcccgaggatgaagacgccttgccagccaggtcagtgggtgatggcatttgtggtcaggggcacccagcaccacacccctggctgccgttgacagctgggtgagtcccctgctgcctgggcagagccacctctgcagatgcccaggtgggtctcctggggcagggactggcaggctgtagcctgtgagcagattctgggacctgaaagctaaggatggtttttacatttttaaggagttataaaacaaacagaaaaggaagaatctgcaacagagaccataagtggtctgcaaagccaaaggtttatagaaatgggcagacctgctctaaggggcctgcttgctgatggggccttgtctggattgccagttctactaattctggaattggaagttctcatggaggactgtgtgctgggtaggatttccagatcccaagatgctttggctgcattcaaacccacagggcagagagagccctccgccctgttccttggcagaggcctccacactccgtgtgctgaccggcctgccagaatgacaacaactgtcagctgtctgcatcctcctggcaccccttagtgtggctgcatactgaggggagttaaaaccataaacaggtggagaatatctccttccagggaatctcagaggactcagtgatttaagaggaaaagaccaaactgctgctttcagcaggaccactgtgtgctgcctgcctgtcagtgcatacagatacggggtcctgagttggtgacctcaaaaccgtgagcggtagatagacagagtagcccctaatgaagcagaaagactagaagagacaggacctaatttaggtcgaaaagcaaagtgaggcctcagaagatgaaggcagagtgcgagaaaggctttctggaactgacaagtctgccatccacatttcgaaatgtattagaaaaattggaaaaaaaacatatgaagtgtagaatgtcagcagaaaggtgtggccacagtcaagagggccctctgtgggtcctgtggtcctggactgcaggtgggcccagtggagactgtgctgcccctcaccctccccggtgggtcctctgtgatgggggtgggtgaagctgagtgctgtcctgaaaatctgaccatgcacagcccctttccaaagacccttctaattttagaggccgccagcagccacgggactaggcagcatcagagcagggacacaatgtgagtcatatgcgcctgtgttcatcctgtggtgtccctgggcccatgggggtgggagggatcagagggatcggagggaggggagtaaaaccaggggaaggagtggaggaccacgaactccctccccttcttggtggccagctgctgtgaggactcgctctcttaggacaggtccactgtctctgagctctggttctggcctcctgtcaggtgccctcgtgcgggaatgagtgagggacagcagggcaggctttccaggcttccagcaagctctacatgatgggtggggagaccctgctcttaaaaacatgtggacccttagcattcttcttcctcagacctggggcctcagcctaagctgagatgacagggaagaactacagatacaccagatttagggaaaataacgtcaagtggtgcagacaagtggaactgctgcttgtgaagtgggctgtggagtcgtgatgtttgctacgcccggcaccatgtttcagaacctgtagcagcgctcaagagagaatcattcctttaacaacaaacatgtactgagcccctgtggggaggcactgaccgaggcctggggacaaatgtggggacagaccagtcctgtggggacagctggcgggggtagaaaacagtagagctgccccaccagccagcggctgctgggagagcaggggtgtccccgcacccagaggaggcaccctgccgctctcccccaggttgcttggtgtgtgcgctgcagggagaatcccgcccccagctggtgtccacaggggccagggacactggtaggtaggtgtggaacaagggagtttgtgacttgggattgttttctacttaaaaaataatctgagtaaagcttggtttaaacagcatcaagttaaaaaaattcctaagaagtggttggattcccagtttatatgtggctttaaggttctgaagaagtacacaattaaccacagaagtatgacttgaatagataagaatttaacaaaatacacactgttgggtgtaaaatcataaatatctgaagttcttagaaattggtaattttcttttagctttgctgtgctctgagcatgactaaactaaaagtaatgaatccagaccttgaagactggtgtgtgtgtaaaaggcaagaagtgagaagattcacgtgtagatccaggacaatctgaatttacttctgttcagtagttcccaaaggctttttctacatggagggactcggagtgacacagcagctccctcttgtgggcagattcccctgtgtaaggtgctggaggctgaggttccagcctgcagccgcttgtgatcctgatatgtcgagagttctggaagactgatgactgctgacccccttcttaacctacgccatcgccatgctggtggtggggatggggctcttggccattcctgccccttggctgcccttccttggtctgagggtacgtgggtggcccttcgggtgtgccaggagctttgtgctttagtgaccaacagtcccctgatgtgtgaaggcccatcaatccgatttaaaataaaacatttgaagtctcttcagaggacggtgtgaggatgtctgcgttcagtgatggagcttggcctctgccttgcccctgattgaggctctgagggttcagatacagtctctgcccactgcatgtgaacagcctggtgggtgtggaggggaggaagcctgtgatgatggtggcactgtgaggaaagtggggatggaaggaggtgtgcccaggaggcagggcaggagagttcatggatgtagggttgcagcaagtctggaaagctgggtttgttttccagggagatggcatgggaggtgggcaccccaggcaggaggggctctggatatgactccagaagcctggtgggctggaggggagggagaggctgggcctgctgggggcaggaaaagggcagacctgtgcttaatttcaatttctatgggagtgatgccctcaaacttagaagggcttttgatgagaagcgatagagtatagctcttgccctcctcagtggcatcactgattttttaaaatgcattttagatatttgtatttctatattaattagtattaggattggctataagtgacagagatgcaacataataggagcttaaccaagagaaagggctgcatcctgcacttgctattgtttgatttatgaactttagacattaactgtgcactgttagttcacatggaggaggatttagctccgtgacgtttctccaaccttcttttcctgtatcatttaggattgattctgggtgaaggtcacagcatgactcacagtatcttacacaccttggatgtatatacgcacttcttatgtcgtaagtaatccagagggaggagtttgctagagctagtccagagttcagccatcttagggctctgggtgagtatcgctgcagtacagcagcagcagctttagacaccacttctgtgtttaaggcaggaacaactgagaaggagcaggccgtggagctcttgtctattccttttgtcagagacattgtggaagccctcagcatattttcacctgtctttcaccagaactgtgtctttctccttggcaagaagtgtgttttgtggccagctttagtcacaaaagagacagaaaatgagcctttcatttttgtggcacccttggtagaggggtaggggaaagggcttcaggacgagcactggatcagcttaccaagcctgaaaccacgccccctgctggtcatcctagagactgagtggcccatgtgctcgtggcctgtgggccctgggcggcctctcagtttcctgcatggaaggcagcagaagcacttatctggccctcagctcctcggtggtgtcagtttgtctgacctctgtcagtttgttgtcttcttttttttttttttttaagacagagtctcgctctgttgcctaggctggagtgcagtggcacaatcttggctcactgcaagctccgcctctcgggttcaagcgattcacctgccacagcctcctgagtagctgagactacaggcgcatgccaccatgcctggctaatttttgtagtttttgtagagacggggttttgctgtgttgcccaggctggtcttgaactcctgggctcaggtgatccacccatctcagcctcccactgtgctgggattacaggcgtgagtcactgctcccagccttgtttgtcttctgtgttaccaaagtagaaaacttcttctgttctgtaaccttggttcaatcaaagttccaaattcataaatggcacttatattattatgacgattgctgaaagtcatgccacagtttaatttgctttatacttggatttggtatacttgattttttggttctgttttctctttttcctgatttccttgatttttttggttccgttttctctttctcctggtttccttgattttttggctccgttttctctttttcccatattcttgcctggcatggagtggtagagcagagtggggaatggagttgagtttggatccagcggtcgagcaagtgtctcaactcccatgctcagcttcctcctctgtcacgtggggcagggaaggtgcctgtcgggcgcagcgagcgtggtgagtggtagtgtggggccgcgtgcgcccgtgggccctgagcatcagcacttctgcctctccgtgttctcttgttgagagggaccactgcctttcttatgctatcgccagccttttccagcttattcattctgtttcttggaacccatttaattcattcttcttgaaatatgtgtattttctattttatttcaaattgagacttacctttcttatagaatttgttttcttctgggatctcttgatttttttaaaattggatttactgaggtaaaatgtacagacaataaaactctttttttttttttttttttttttttttgacacagagtttcgctcttgtcacccaggctggagtgcaatggcatgatctctactcactgcaacctctgccttccaggctcaagcgattctcctgcctcagcctccctagtagctgggattacaggcgcccgccaccatgcccggctaattttgtatttttagtagagatggggtgttgccatgttggccaggctagtctcaaactcctgacctcgggtgatccacccacctcaacccagccaaaaatcattcttctaaagtgtgcactctaatatattctgacaaatgtatgccagtgccacaccaccaagcagctgaggtagagaatattcttaccccaaaaagtttcctcttaccccgtgcagatgtcctacccatcagggcccagggcgaccttgtctgatgttgatgtcccatcagatggtttgtattcagcagagcacctagaccaggctgtgaggtacaggtccgcccctggcagcccatgccttgtagcttctgggtggctcctggcttggttgctgtggtgtggagcgttgagtgacctctgcagaacagcagatggtgctgtagggccgcttctaagactcagtggaggaggctcagtggcgttctgagcggtggccaccaggacaaacctcttgtctttacaccatctgtgtgtgtgtgcgtgagtgtatgtgtgtgtgcattccagtgtgcgtccagaagccagtttccttcagaaagctttctgttccctggcttcatttttaccatttagaggacctgtgaagcaatgagatggaatacttatagctggtttaattcagtgagtgatctgaattgtaaataaaattttatcaagtaatttataaatttgatataataaattaagtctgcggaaggggctgattgtgttatggaatgagaagttttgtacatcttttgcaattctaaaaattgtggccaggtgtggtgctcaagcctataatcctagaactttgggaggctgagacaggaggattgcttaagcccaggagtttgagaccagtctgggtaacatggtgaacccctgtctgtacaaaaaataaaagtaaaaataaattagccaggcatggtggcacatgcctgtagtcccagctactcgagaggctgaggtgggagaattgcttgatcccaggagacgggtggcaatgagccaagattgtgccaatgcactccagcctgggcgacagagcgagaccctgtctcaaaaaaaaaagttgtgactttgctgtgtagtctttgtgtaacataattttatgattctattgttttaagcttaatattccaaataggtaataattatgttaaaatgcaaaaaattagcctatactctcatgatctaaatatgtagtagtggttttacagaatatatttcaaaggattgccattctgttttatttttagtagccagttatagaaagcattatttttaaataatgcctaagaatctttaaagaaatacctgtcaatgtatgttccagtttagtatcaaatttatattcagagctcataagaatttaaaaagtttcccagagtctgtaaatggggatggagctgtccttcaagggtgatagtccccctaggtttgagttgtcctctgctgctagcatagtaccacctgagctacctgtgggccaccttcaccacccgtgggtccctccagccaccccagggacaccttagcctccctgggtcgccttagccacccctgggccatgttagccaccacaggatcaccttagcatccctgggtcaccttagccaccccagggtcaccttagcatccctgggtcgccttagccacgcctgggccatgttaactaccacaggatcaccttagcatccctgggtcgccttagccaccccagggtctccttagccatcccagggccaccttagccacctgtgggttacctcagccaccagtgagtcaccttagctaccccaggatcaccttagccatttgtgggtcaccttacccaccctttcaccttagtcactcatggtcagcttagctgtttgtgggtcacttagccacccctgggccactgtagccacctctgggtgtccttagccacccccgggccaccttggccactctgggtcaccttgtctacccctgggttacctgagccacccttggtcactgtctgtgggtgcttgcttgctttaagccacattatgctactgcagctaattaaggtcgctcaattcaagtgtctcctttttttgggctcctgccttctttttgtttttcaaatcgaacacccgctatactcatttgagaagtgtagactttgatttttaaccctaagttgcatggtaaagtcacctttaaagccaatggaaaaagcttaattgaattcatttgtttgaagaagtagaggaatgttgcaagtagactgaaagttatacttagtctgttctgtttgaaaccattctcattcagaaaacagaaatgtgtttatgtaaagaaatatgttacttgacttaatattgtaaggaatcttaattgagaaaataagtagttgtgttttttctttaactgggcagcattgtagcggggtggagtgtgggtccccaggttggagagctctggatttggagtggatcctagcacatggccaccatgtgaccttgggcagtgactcagcccagctggctgccaggctgctccccatgaggtggtgggagccgtgtgggatctgcctactgggtgtgcagctgctgcggcctaagcggcgtccttgcttggtccccccatgaactcaggggtgtggcctggctccgtcatgtgttttgcagggggatctgaggggcccagaaggtaagaaattgcctacggcccttggctaatagaagagggagcagggctttgaccagggggaccagctagtgactctgtgctggttactactttaccaacaccatggccatgctgcacagctgtgcagcctccacccacaaaggccaaagctccaatggcatctgcgatgcttgtaaaacaagtagcagccgtgtccagcctgctgctctgaaacctcagtctcctttactgagatttgatgatgtttaaatgagcaaatgcatgtgtagtgattggcaggtggccatcgctcagccgacttttcctgtgccctctgcttcggcaggtgcccttcctggctccctgcttcttcctctcctaacctcctggcactgtgctcctcactcaggaattgcacccagcatcacctctgcaggtgagtcccacaccttccccctgctctccaaactcagaccccaagtccagcagcatcttctctcaggcatctatagacctccacaacttaagacatccaaattctcattcccttgccttgccataatcttcccatctcagcagctccttccttccaggctctcaggctgaaggtggcctatcctttcttttctatcccacatggcagccaggaggcctgtgggcggtgccttcaggacatgcctcttgtgcccctgtcccctactctggcctgagtgttccttttaaaactaggtcagaactagattaaagcccgtgtccaagatgctgccacagtctcttgccaccatatgactgccatgtcctcactgtggcccaggaggtcccatgtgcagagccgctggacctccgtctcctctcactctctgttaactgtgctgctgtcagactggctgcctggctgttcctgggcggtttcaggtgctgcggctacctagaaccttccatcttcctttcttcactcttcccagaagagaacactcttcccagctgtcttacggccagcttcctcaccacctcgctgcagtcttttccgcaatggcatcgccactactgccctcccacatccagccatcatcctagaataacagccactgttgtcccctgacacttgacggcagttcatcttttatgacccccattgtccccattgtcagttgtctttttttttccttattagaacataagctccaggaaagcagatgttaacgtctttgttcactgatgtatctcaggcatttaggacagtactggtacatagtagatgctcagtaaatagttagatgaatgaatatttgctacttttcttattgacagacatttctgaggtactttaatattacgttaagtaatgttacaatttcccatgtgttgattttatgtaaataatgagtaaattactctcatagagattttagaattctaataaactcatatttccccttcttataagagtagaaaaatgcttttaagagttttcctaaattaatattctgggaacattaaattttagaactttactctgagggcatagataaaaataaaattaattagataccaggaatgtcagatgctaaatggtgtatggctatttgtgacattctcctagaattaaacagttattaacttgcaaagacatggcagctgaagtcagaaattgatgaacttttaaagttgggaaaaaaagagctttaaggtatcttattaaaattgtaaactgtcagtttaatcatcatagaaaccatacctgatacagtaaatcgttgctattctgctttgaatttctggattctcatgaatcagacattctatttttatgtttctcttcaataatcctaaaggtggaagaaagaaatgggaagaaaaaggaagagaaccatagctacgttgtgagggcattgcttcaactctggtaacttcatgtgaaatgactacaaaatgaattaatatgcagtaagagagccagtgccccaccagggcacctttccacttgctggcacacagatttaccacaattaggatactgcttgtcctgtcatgccgggagagtctaaattactctgactttcaagaaaccaaaaatatgcatttttgatgttaggaagatttactgtgcattgggctgtgtcatttgatgaggaaaaaaccaaatgatctctttatgaaaatgaaggtaaaatatatgtaaatgccattttaatctaactttttatatgaatgtagaacaaatatcaaacaggattatacagtgtgatagtcaggaaagtagcatgcttttgtgttttatagactagtctaaaaggagccccagtagacttggtattgttaaaccaaggagatcttgagaactgttctgtctcccttgtgcccatagaattgtagcctgtggaggtgaccaaggaaccagatcccaagaggcctctgccactgaaaggagatttttattacttgcgtttcctagacgggggggcactcgcgccaagcaggcccacggggcacactggtgtcagtcaaggggcagaaaggagccacaggaaagcccaggacagagcctgagtggggtttctgtgggaaaggcagggcagggcacccgtgtaggaatggctagtgtgaacagttccagtgggccctgggctgtaggagagatcactagctgcctgctaccaggccctggggtgatttcgggcaggcgggcagttagataagggaggtgggtagagccgaccacctgcctggaaccctgtgctggctataagccctgggagggccagtctctccctgtgtctgtaaggcccacaaatgccaaagcattaggaataagaaaatggacgtaatagaattgatcctgtgaggactggatgcctaactgccacatacagaatgtgagaaagcacagaacaactgccttcattgacaagatggtgcccagagctcaagacaggcacacagcaggaggatgccggcaggatccctcaacaagcttaccgtggtatctttcacaatgttaactgtcatcccagatgaacttttaatgacagtgtatctctgaagattgtgcttttagcgtattttcacttaaagtcatatctcatttagtagacctgccagattcctgaaaagttacacacaagccagctgacatgacctttgccagtcatgttgaccacgttctcaccgagctgtggactcctcactaggagcctttacctacggccagatggctgttgtcactgcctgtggtggggttacggtttcggactcacctgatccgttctgccgggattacctacggccagatggctgttgtcactgcctgtggtggggttatggtttcggacttacctgatccgttctgccgggattacctacggccagatggctgttgtcactgcctgtggtggggttatggtttcggacgcacctgatccgttctgccgggattttaaagtatgggagtttaggcatactttgcaagttgtttcttgaatatacttttctgaattatggcttgctatacaagttttggtcttttaaggtaagagttacaatggagatggggaaattatacttttctcatttcaaggaaagcaacagtcatgagttatgcatcagttgggaaacgggatgataggaagttgcaaggcaacctggtttcagccggaccgggactctcccggggctgcgtcctgctagagctggcaggacacagaataccactagcagcctccctgggagtggcttggcgtcttggccacctctttccacggatgtggtggatgtgggggtaaactagagagactaaagcccactattgggctcagcttcctgtagaaatcaaatcagatgaaaaccctgacccagagggagaaggcagagagttggacttttgaaaacgtgagtgtgtccagcaaccaggcagcaacagtccttgtttttatcgaacttctataagcactttatttctccagaataatttcatcataaagaatccagagctcagacagctctttaccatctgtcttttccttttttcttaccctgtgtttggcttgatctggactgcacttaaccatgacaatgttaagtgctttcttctgggtaaaaattctggcttcttctccagaaattctggctccacttctcaaattgtttctgtccctgttaggagacccctggggcctcggctggagagacagtgcagctagtcccagcagccactgtgcttgggcctggccagcccctcctcaggggtcacggcactgctcacctggtgactaggtcttctcagccagatcagttcatgtgctctggtgtttttgagcttctggctagtcctcagtttctcagacctggttaatcacagtgtggagtcatttttcataactgtgcacctcacttgtttgatgcatggcaagggaataattaaattaataaacctacagatattcccccttacagttttcaaatacagtaagtgaatttctactataaaataggtccaaagaggttttattgtttcttatttgaaataattaaagaacatttatgtttcccttttgtggtttcttggttctaatcctgtgggttgcttttgacgtcctctgttggggatacactgtgcatccgtatttaacaggagatcccgaactcccagcagggagctaagcacagatgtgtgcacagatgcgtgcttaggtaaggattttgtgcaaggtgacttgtaatatgaaactgtaaaacgtgctaccttagactggagagagaagggggtggtctgatgttttccacacgcctcttttaccaaaatgggtcatcttatctgtctcaggccaggcccccgggggtgcacaggaacagcacagctgcagtgaaggaggggctcctgcagccgggctggccccagagctgtgggtcgtgccccgcgtgttgctcagcgcgttctgcagttgccctggccttagtcccccatctcgctgtgatagccatgcaggtcagcaactgtgagccttcctggctcccacgctgcccccggcacctctctctgtttctgctcccagcatcctctcagcttctcttctgagccccacgcagcggttcctgctttaccagcaccacttctcctctgtcaccgagagagagcaagaggctgccgcgcctgtgccaactgcctggtgaggctccgtcgagtgatgtgcagggccttgcggtacagccctctcgaactcaccccaccagaggcctgtcggcatcactgtcagaaacaggcgttctcccctcccagcccccgtcacaagctaagcatctgtgagaacggaggctctgcttccccgaggatcctgccccagacgtgggggcagcctttgcagacagcttctgtcccactcacctcctccttggttttcactcctttatgccctcacggacctgcccaccagttcccaagccctcagggccatggcagcctccgtgagggtgtgagctgggtaaaaggaattaaggtggagtcacagctaccagtggctgattgcccgtgggtgtcaggctggccctaggtgccccattgctagttcactgtcctgggacggccccagtattgtcagcattgaaggaaagaatccggacaggcagcagaggctcccacctgatgacactgaggctcctgccttagcaccagggcctgggctcccctttgctgtaatgtcgtaaagtatgtcaggaaggtttgcccatgacctggtggagagagaagagatgtgacaaggcgactctggcttgtgtatcccgcccacaggggaagcttggaggagtcggtttgtgaaaaatcagggctctgagggcactggagctggtgctgagttctgcagcagtcaagaagtagagcagagctgaaatcctggctgctcatgggcatcacagatgcattcgccagcagctgggctcggctttgctctaacatccgcccctcctctgggagcgttgtttctctactcctggctgcccagcccagctccctggcctggcgagatctctgcatcatttcttctccccagcttctctctccacccatgccgccatgggagagtttaggctgtctcgtccctgactggcctgaggtagggctgtgactgtctccttttccctctctcctgtcttcctcacctatgcccacataatcagtccaccttccttactgctggatgcaaacctgctgagtctctatggctttcaggatggagttcaaagacatcacctcagcgtgaaaggccctttcaggtctggcccggcacaaccctgacacccgcatgttcctgggtgcaacaacatggggccccagggcagcttcccatgatgcatcagcctctgctggctcctgatgtggcctctgttcctgtcttaggcccctattcctctcggcaggctccacacttgccttactctatctcagaagctcatcctgacaccagctctgtcctctgtactgggaacatggagcagaaatccatcacggctgctgatccatgcatgctgatgagttgctggctgcctccttgtgcacagcatctgggggcactcaggtggccctgctgtctctgggcctgtccctgacactggcaggggttggggcaccagagttcaaatgggggccgcatatcttgtctaaatcttccagagttttaagtcaagccagtgcactattgatacaatatgttgtgtcttcttctttgacaactacatcttcaaaatggaaaaaatatgtggggacctatggtttttatatgaattaatgttggcaaaatatcaaagaccactgaatttaactgttaatttaactgttatctaggtgttctgttcagaggccactcatgtttgaatgagtaacaggatcaagacatgatttatcaataagtgcatatatctcccataacattgattattttgtttttatttctgcaaatgactaatcatgttttatattaagcattttcggataatgcttgttctgttggtgctcacggcctaatgcggggctagcgcacagcggcctacatcctgttttttgtgcagtgtttacagtttttaaagagttgttaaaaaataaaatagtgcaacagagacatggccacgaagtctaaagtacttactctttgcccctttacagaaaatgtttgctaccacttgatctaaaggattaaaaaataaaacatgtcattgggccagatgcggtggctcacgcctgtagtcccagcattttgggaggccaaggagggcggttcacctgaggtcgggagttcgagaccagcctgaccaacatggtgaaaccccgtctctactaaaaatacaaaagaaattagccagacgtggtggcgcacgctacttgggaggccaaggcaggagaatcgcttgaatccaggaggtggaggttgcagtgagctgagatcctgccgctgcattccagcctgggcaacagagcaaaactctgtctcagacaaacaaacaaacaaaaatgtcattgaatttgaagtatacaaaatttgaatatctttctatcaaaaatttgaattttaaggaaataacaaagcaaaaattataattttttgtgttttcaaaaaattattttttctaaattattaagttataagatataaagtagttaatgtgaaatgtttaaatcaaaattgtttaaagctgagttttaaatttaatactttgaaaatttagttaaatcatattaataattttataagaaataaaactattgataattctgatgtctgacatctgtctgattgctgacatggatcctgagtcttacagtgttttgagggcctccagctacattggggttccagtgccagagtggctggcagccccaccctaacgagaagtgaaggggctgggcatgctgtttccagtgctttcatgagatgctgctttgcctggcggtcgggcctgatgtctcgttgttccacctgtgaccaaggggtccctctggaaatgtgtgtgtactgacacatgccctggtggctcttgtctgatccatgtccaggttattcctgcctgaccgtcactcgtgccaggagcccaacacaaattcaggcacaaattcagtacaccacacaatgggggaaacatgttcaaagatttttacttacaggtcctgagcagggagggtgccatgagtcaggagggcagtcctctgtccctgggtcatgcaagcaggaacaaagggtcaggcagagagagagagcactgcagccaaccagcagaacaaataagggagtagggtggggtcacttgaagtgtgtgggcaggtgcctgagtgaaagatgcctctaggttctcatctctggtactggcttgagccactgggtgtggtgtagaactacaaagtgtcaggggtggctgaactctgccgctactaggagaaagtgcagctcatattccagatagatgctgaggcaatagaaaatgaaaagaattcactatgcttacgcagagtgtgtctggacacacacaaatttaagagtaataagaattgcttaatatggcataatttccttaggtgccatgtgcagttgtcacaagcattgcactaattggaataatgaattagaaagtggatgttggtcattattaggaaaaggtactttgttacacgagacagtaattgcattgtggcaagagaaagaatctgactaattaatttgtcttttttttcttttgcctatgagtgcttcttctgcttgactcctccccataatcggactccttccaagacagcctaatcttcagggcatttggatgcagctgccttttgttccagagacacaggccatctcaggggaggtatctccctggggcctgaacagcgtttttctagacaagaggaggctgagggctgtgggttctgctttgccagccctgaatgctggatcccgagtggcagaggcaccaagtgctgtatgatgtgtgtatgtgatgtgtgtgcatgtacatgtgtgtgatgtgtgtccctgctcgccccaggctggccatggtactgtgctagtcacagactggctgtgctgatcaagccaggcacagtggaaaatgggaagatgttggcgtttgcccctcccttggctgtgtgtcattcacctggggcatgagctgtgcccctgctctgcagtaatgaacaaggcaggtcagcattggtccgagacacgtgagttaagagaggaggaagagcactctctgggggcggggggatccatttgtcagtggcctgcagtttcctgtcccagggatttcactggtgacatcctgaccactcacctgcactttatatggagctgttttcatcagctggcgtctgctgagcctctgcattgtgttgtgtggtagcctgttactttttgcagttttattttctaaactgtactcttttattgatagattttttgtattaggatttccatttaaacaggactttggtacgtctgctgtgggagatttgtttccctagaagattcacggctgtcgttctctcccctctgctcgtggtgttttactgtgactgcgctgaacggttagctgtcacatgtcattctctgggtggtgtgctctgaagtcattgtggtgtgtgggccccttcagcctagttctgcctaactgcggcatgatgaatgggcccgaggcagaggaggaggctccctcgtcggtaggggctgctgttgtcgcagctgccggcacacggaagtgagtcggtgtgctgctgccccgagtgactgagggacagaatgaggctggggccggccggactggcattggcgtgtctgcatggcgtcgtccaccactgggcctttgcacatggggacctttttcagcatcatggggcgtcggtataaaaggaggcgcaagaagcgctctgagaggaaaggtaattcatttagtttttattcttcagtgtgaagcatttgtctttaatgcaatacagaagtgttttctgggatagacggctttgtgaattaatcttgctgatgccagttacttcctattttccctttttgagtgccttttttgttgttggcattttatagaattttagataggggcacttaaaaaggaagattcaaaaacatgtctgtaaacatgaatagaaatcatttagcttcagagtctggagtatgtctttggaaagatatttataaaactttaaagtttgtagctttgagctacagaaaaggtttttctcccagagacagatgcttatatgagatttcctttgccgcactcttcattaatgacttttctacattaaaactgttcttcatgctgcagaaagcaaggctgagcaaccattgtgaaaatatttcccctttaaaagaatggagagcaaattccttacattctgcactccaggttaataccagtttttaattcaacttaatgttttaagtcattaaaatctagattttttttctcaaaaccagattcaaaagttgtccatgactatacacatcacaagctactggtttttggacctaaattgctgctttaaaagctgttgatgttttttttttctctttgtataatatgaaataattaatagaaaatgccttagtgaaaagatgtgtctagcccggagaacagctgaacacaggcgtgatcagtgcctctgcctctgtgtcttctgggcgcccccttagtgtcccccacccgacaggactggagtacagcgcttcaccaccacagggcccttgggacatgctgtggcaggagatggctgtttcttcaggaagtaaaattaacctcggttttttggtgtggcttcctaagaagaagaacagatgaatctcaaagtcagcaatcttgtaatagtaccttgtaatataacaaaggtgacagcacctaatggaagtctgtgtctgggagtggggaacccctgaccctgggccctctgtgcaccgtgctgccaggtgcttgtgtccagggctggggatgccacaccctcgatgctttcctggactgacgggcggtctcaggacagccagtctgtgcggccccctctgccctcacctcaagaggtcacagcattggcctgtttttgtttcctcagttaagctttggaaattgagatgtcactaagacaggcaatagggagtaaaacaaaggcacaggcaaaaactaaaggacatttttaccaaataccctcaatttagaattaccaccacttttcccatggacactcatcactaattatttaagttgggaaaaatattgagaagtacaagaataattctgtcatcattcttttggaatttactgtgattcaagcttaaaatgtctttttcatgcattccataatctcattctgcagtgggaaaaccactctcaaatatgttgcattttcagaccaaggttataagaaattgagagggttataagatgtaacaatgaggcccacatattaaatggcttgtgttccttggtcattcctatgtgagtaagttcattgtgagtgttactaaacagtatcatgttatgtgttagttctcgctgttggtattttgtaataagcattatctttgaaactaataaaaatacctttgaaattatcgatattattaagattggccatcacatttataccaaactggcaaagttttataagatgtaaaatagtcttttatactgtatatttctaaggtactgtaaatcatgtgtattgcatggttttttccctaagactgatacaatgtacgccttttaaaatgtaattctttgatgaaaacaatgtagtagcaagttacgggttttagttggcttcagtggcaatataatttcagtgatttttttcatcactcctggattatacttgcagttactgccttccacagggcaaataattgactgttgactgtgtgtgagcctcagatgggttagcttaatcatcaggaaaatagggctaaagaataatgtaccatttaaatactggccagagtccccatcaagcagacactgccaccctggcagatgctgccagcacgagacctgggagaggtctgggagccacagggcaggattctgagtagcagttagtgcccatatatggagcgcttcctgcacccagccagtgctcagtggctgctgctgtagcctcattcactcacagcactgctgctaagttcatgaccagtgggaggggagagagatgggaacaaagaggcagtccttcagtccccaccctcctgctgtctgaatagcatcctgtatttccagatgtatttctcactgagtgttttgtttgtcccctatgtgataacatccttatctgtgcttagtcgtgtatgcacatgtgaagaccactgtcctctggcagcagttctgaactgtgttttagtctgaggctgggctcccccatgtttccaggatagaggtgaacagggtgtggggacctctgtggagctggaggtccaaacgtagagaggcctgctccccctgagtacttctggaggagaagccctggaactcctgaccttcacccttcacagagtgagcagagccagttggccaaggggaggaagcaggcggctgtcgtaccagcctccttctctggtgccagccatgactctcaccttacaaagagagcaaccctttgtgagatgcagagcatggtagcacctggaggtataggacgggatggcatttatccacccatccatataccagtccatctactcattgtagtccatccatctgtccgtcaacctatcatccatctgttcactcatttacccatctacccacccatccatcatccatccactcacccatccatccacccatctacccatgcatccatcatccatctctccatgcatccatcatccatctctccatctagtcatccatctatctgcgcatctacccatcacccatctattcatccatccacccacccacccacccatcatcacctatcatccatcatccattcatccatccatccacccacccacccacccatcatcacccattacccattatccatcatccatccatccatccacccacccacccatcatccattcatccaaccattcatccacccacccaccctcatcacccattacccatcatccatcatccacccacccacccatcatcccccatcatccatcatccagccatccacccacccacccaccatcacccattacccatcatccatcatccactcacccacccaccatcacccatcatccacccacccaaccacccaccatcacccatcatccattcatccatccatctacccacccacccatcatccattcatccatccatccatccacccatcatcacctatcatccatcatccattcatccatccatccatccacctacccatcatcacccatcatctgtcatccatccatccatccacccacccacccatcatcacccatcacccatcatctatccagccatccatccacccacccatcatcacccatcacccatcatccatccatccatccacccacccatcatcacccatcacccatcatccatctatccatccacccacccatcatcacccatcacccatcatccatccatccatccatccacccacccatcatcacccatcatccatcatccattcgtccatccatccacccacccatcatcacccatcatccatcatccattcatccatccacccacgcacccacccacccacccatcatcacccatcacccatcatccattcatccatccatccacccatgcacccactcatcatcatccatcatctgtcttccatccatccacccacccactcacccatcacccatcagccatcatctgtcatccattcatccatccacccccccacgcacccacttctctacattgttccgttcatccaacaagtactcattacacccttctctgcatgctggcaccaggggtttgaacatgcttagggaagatgggggtaatgggatggcagtggcagggggcagccacagctttcaggcttgaggtttgttctggaatgggccacctgaaatcccactaggtgcatgaagaggatggatttatgtgatttgtcactgctgcactgtatgtgtagtagtggggagggatattctccagtatctggtgagaaaggaagacaccattctctagcagtgtctgccaggagaggggcccaagtaaggaaagttgaacccccagtggacagcagcgttatggatagaaggcccagatctcctagaacccgttgtaatggctatgtgtgtacctttcactgcatctgtgctgatgggcctcgcagcacaagaaagactctgctgcctgggcaggagctcctctcagctacagggtgcatttcaagcacaggtgcatacactctaggttaacagttgaaattctaaagtaagcatgtagaagtagatttgtgaaattgcacttgaaataccatggaaattggatccaaagcagattgaacagtgccaattcttagtgcagttataagtgttaatattgaaaataaagtttacatcgttgtcttttttttccctttgattccagaaaattaactacaattttcaaataagcaggaacttacttaggttgtgttaagtagagcaaagtggacagtctttcaaatgcattgctgctgcgtttgcactgtgaaggacggagcaacttcacgaaggcagggccctgtgaaggtttgtgctctcgtgtgccggctctgacctgtgattttgttgctggatgtctccttcagcagttcatgtggctttctaaagcttgccattgcttaggcatgcctgactgaggcgggaaacaagcgtgtggatcagtgtggctctgtatgtgtgaacatgtatggacatatgtgcatagggtgggggtaacgagggagagggacaagaagggccagggcttgtgaccacatcagaagcaagggtgatgctctgtggcacagctggccctcgaagtcactcagggacctaggtttcttccatccttaagctctgttctctaacagaagtcaccctggcagttgcttctagtccagcaatagaaaggtgagaaagaatacagagaagcacgcaggaagctgtgtgagttggcccagatgcagtggcacacaccacaaattgcacagcacccccacaggaggcgagcctgtgtccttgcccatcacctctttccagctggtgtccagacctcggggtgatcactgattgttgtttcgttggtctggctgtggctcttcttgggccagcagcctgggagccacacagggacagggtaactgcgataaaatacaattatgcaggagaggaggcggaagggcccagcctggccctgtctggccagcttcctgcaccctgcacagcagggagcatcctcattctccagaccctgattcttctcgggttggggcgggaggggggaactcccttgtccattgttctctcagccactggcctcatcctttgggggttctttctgatcatcgcctccagagtcccatctgaagagggtatcagtgtagaacacagtgaggcagaatgtggaagcaaacgggaccatctggaagttttgctctaggccttataaaacacataatttgttaggtgtaaaatatatagtatgttgtagtagtgataataggatggaataaatgccttagatttgcaaaattgggtcagagagtttagggatctttggtcctgtaccagtgacatcattttgtggctcttggggatttggggagggacctccccgaggccactgtgcagcagcctcatgcccagggctcacaggtcccatatgtgtttcctccaccaaagcaccctgagctgtcctaccttcctcacatccccacaccccgcgggtgtccctctgcttagcagctatttattctgcctgtatttgggccaactgcacaggctgtctgagacctgacagtatgctagaatgtacagggcatacaatattttgtgtaatatcatggaaaagtgtgccgttctttcggttgacggtggttgcagataagactgcagagacagcttgtggtgggttggagtgtgactcagtctcccgtgggtctgctccccttccagactgcatgtggaattctgtatagagtaaggcatattcgtgtatgtgggagggaggcttagaataaaatttattttttttcttatggaagcagtacatgttcattgtaagaattcggaaacatagatacaaaataaactttatgaaaaagcaaaggtgatcatctgcattagtctgttttcacactgctaataaagactgaataatttataaagtaaggtttaattgactcaccgttccacatgactgcagaggcctctcaatcatgacggaagatgaaggaggaacaaagggacgtcttatatggcagccagcaaagagagaaatgagaaccaagcgaaaggggaaactccttttaaaaagtcagatctcatgagacttcttcactaccacgagaacagtatgggggaaactgcacctgtgattcaattatctcccactgggtccctcccacactcgtgggaattatgggagctacaattcaagacgagatttgggtggggacacagccaaactatatcatcatccttgaagctaaatctttgaatgggagcaaaaccataataattttcttccaattcgtagtactagaattagatttagaagtgtttaaggctttatatttttgtcttactatgaccaggggctcagtaatgccttacttctgccttggaggatgatgtgagcatacaagaggggtggccgcatccctccagcttcattcctggtgtccaatgggaggcgaataggcccctttgcacctcttaaccaccatagtcctctcccattgccagcctcttctgacttttgggattgttttaccctctggacagcagtgtgaacaaggtatgtcaggccaagggggctgctccccatgggaggcctggccgtgttggcttccaagaggccagatgggtgctgctcaccatagaaagtgacccttttccctgttcctgagccaacctgtcacttccatgcgctgtgtgtcactttgaaaactatctttgctttctgcaaaatgaaaggaaactttcaaaagtcaacgtattaaagcctgtttgcatttattcttttatgaattttgctcacattttttaattgggtgtttgtctaaagacaattatcgatcatagtaggctgctggaaggttgaccacagaaacctggttctctttcagggaggtcaccatgtctgcctccaggcccatcgggtaggggctgccttctgtcaaggcacatgctccaggtcccttagatggaaggaaaacacatggtctttatccagtggactcagggtgcaggtaactgaaggaattaacctccatcattttcacagatcctcgtagagctggaccgaaggaggtgggagatccctgccgggagccgctgcagtgggagggcttacagacgttcgcatagtctctttctgtttggttgttttaactcccattaaaaggagtggctttcagccttcttgcttactgtcttgtgatgtatgtgtgttcacatgttccatgcacatttgtaacgctcaccatgctctctgattcagctttgttcccttagagttgccccagcactgctttgccatgatgattgtgttttttaaaatacttccagttgcttacttctgtttagttatctcagtgctaaatattgttaattaattaaatataagcagcatgttctagattttatgtgtctggaattcttactaaaaatcttcctggatatgacttccagtcataacgttatggattttattgtaaacaaggtagaattttatttgccttttaatcatttcattatggtgagtgtcctccttacagagcgtgtactgaatttgggttttactccttttttgttcatttccacaagttgaactctgtgttattatcctattttctgttagggtcattgtgttgttaagtaatcgacttacatagaaggtgtgcacctagaaggttaacagaaaacaagttgaaacatgactgaaaatatatttctgtaagaattactgtaattcttctgagagtataaatagccagggttttaaagatctgctttataggatttatactgcaaataacttggcaggattaattggcctgcatttgcttgctgtagtcagtaccatctagtgttttagtcaatatcagtttttgtagtgtggatgaggctggtgatggcagctgcagcctgtctggagttgctgctgccgtggtgtcagctgcagcgggggaggctagggctctgtgctccgcaagttggtgggaaccgggaacaggtggaagccccacccccttccaagttggaggggcaggagccctgccatcctgggcacagctgcagccgtccattagaagctgtggacccaggcatccctgcactcaccagggcccaggaagcccccctgccccgacaggctgagaagtgcctgctcccactgcttggtctgtccccactcccagcacctgctccagtttcagatcaaagttgtggccgagctgggacactgtcacaacctggctgggtgtgtgtttgctcagggcagtgctgacatgccagcaccctgctgcctcggcacccccagactttgggtgctgacaagcatgagagggaggccaacgcggggctgagggaagcacagcgcaggccttgcagccgcccctcggcaggaacactctggatgccatgcacactgtggatggcaggataatggtggccggaggcagacaagctcctgggaagaaaggggagggtccctggtgaaactccaccttcagcttacagaggacttaaggcctggggcccaggctgtcagttccacagaccggagtgagaacttacggtgcttttccagggctcacccgtgactgcccatgcaccaatcagcacacactttcctctgaagcccataaaaacccccggactcagccagacttgggcagaagacaggatgacctgcttatggagaatagctgcccactgtgggtctctctgagctgttctgtcactcaatgaagcacctcttcacattgctcaccttccacttgtccacgcacctcattcttcctggacatgggagaagaactcaggacctgctgaatggcaggtctgaaagagctgtaacacaaacagggctgaaacacacccattgtttgccacattgcaggcaatgaggagaggaggagagaaggagagaagagctgcagcccttcaaggagcccagacctaggagctccctgagccagggcagtgacgccccctttggggccctgcggttcctggtgtttccaagcttctgggcactaccgtattccctggtttcagccatggaagctgtgtgtggtatgcctggttcagctgcagccttgcagggagccagtgtccatgccagtgcctaggtctgcccgtctcgcctgcctggctgtacacaatggctggaccccacgcccactcactcacacaccccttgccactccacacctggctcccccttggcaggcatgggatccaggctggaagtgtgagccgagcgcagcctgccaggctgtgtgggcagaatgagcccagcaggcccaagcaaaactcgggtaaaggcgccaccagtgatggaggtttctggccagaaaaatgataccctgaggatcctatgacactgggttctgatttaccaaaaagagccacacctgactagggacatggggaagcaggggcatgcagatctgtccatgaaagccccactccttgctttagggacagtagctgatgcccatgagcgctccttcatgcaggtgctgtgctagcactgaatcaccagggcttgctccgcctatagaaccacaaccaagaagatgggagagactctcagctcacagcaccagacacttcagacccaggttggagagctcaaaggcctgaaacaggctccaagaagatgtgagtctgaattcacagcaccagacacttcagacccagatgtgaatcttaactcacagcaccagacacttcagacccaggtcggagagctcgagggcctgaaacaggctcagtcccagactctcacccagtgctcccttgcccactcggccaactgtcgttttgcagacggcaggctggtcagaggcttcccatccagagtgacccatgaggtgtttctgttccttagaagaggatgctaatagctgcctgggaaaacagttgttaatgaggattgtactaagtagatccctttcacatcaatagtaaccagtttaaagccttttcatttacaaatatttctgatttaaggacttagaggtcagttcgtatacagtcaagtttagatgtgttttggagaaagtggatacagcccacaaggtcccaaaaggcaacagggcacaggtaacattccctggctgtgattagttggttgaggacatcacaattggaagcatccacgttcttcctcacaggaagcacttggctgagagctgtggacactgaggatgaggcttgagtctgtcctagcagagctcagggcctggtgggaaaagcagggtggtcaggccagcgggggagtgagcggggaggggcaaccagctttgcacaaggagccaggaatctcccccccacctccaccctgcaccaggggcgctgactctgggccctcaaggccccccactggggacgctgactctgggccctcaaggccagtggaatccacagctccatccacagcagcgagccttgtgcagtttcaccacaatagtagcacatgtgtgacctcctgggggctgctggggcctatgggagtcgggtgtggacggtgtgctccctgggcctgctcggggatgctgagtaccaggcagcagtgagtggggtgactgaagggaaactcgagggacatctggccctctgtgctctgccacgcttgtccccatgcttgctgtgtttggtttggggccattggccctgctcctgtagactcagagtagctgtctgtcccacgttgccatagctgagttcactcggcacagtcaccttgggctgtgtgctttttttgctgatcccttaactggtgagaactagtgtacatttgaacacttgccatccagttgacacctttcaataaaaattgcagattaataataaatgatagaagttcatgctttttccttctggtgaagaccaacacatggccctgttttaaagagcagaaagctgcagagccactgccacgtcgcaggcaccatcgaggatgtgtaggcgtctcagggatgttacggcactcagaggattggtttatttttaggaaacaactgtagcagccaagtgaagactctggacaggggaggacagctgttgaatgtgtccacagggcctgaagtaggccacgaaagccccaagtttgcccctgcgttggcacaagtactggggctgccaaggaaaaggcgggggtggaggaactcagtgtacagcatgcctgtgggggcaggcatggcgcccggggtggaggggtggaggagaccgagcctgccccagccatgtgggcctcgcagcccactgggagaggcaggccacaaacagggagacaaattgtggattgcactgtgcgtggagggagagggagcggggcggtggggtgggttggtgccgtgtgagctgggacttgagcagtaaggtggggtctgatgaagccttgcgcgaggacatggcagggagggaacagggaagcaccccaggaagttggagaggctctggtgggcatagcgaagggctgacgatgagcacatgggcatgtgttagagcacgttttttatttataaggacataaccctggctgctgcgaggagaggggctctcagggtcaagagaaggcagagaggctcctgcacaagctgagtggtaacagcagcgcagaagcagacaggctgatgtgtttagcccaactttgggagaagagctggtgacatggggtgtggggtgagaggggagagagaaccaggtagtctccaggtgtctggcctgatggctgcagcgaggtgacaggatttacacatgtgcattggtacacctgctgcccgggatggccaggtgaacaaggagttggcctttgtcaaagctgaaaacaccttacttgaggccccctggagcgcccaggcctcaccaggcccacccccgcccagccaccctagagttgccttgctgggccagtctactactgtctgtgcgactggcatgtggttctcccgtgatgcatcccttttagtgaggaaggaactagagccacagtttgatgaagttgctgactggaccactgaggtgttagtgccctgtgcaaggtgccctaactgacacctctgcatgtttctttctgtcatttgtccttgctagaatttcctcttctgtttcagtagattcctattctcatcaatatttcccacttaatatgatgaatattgtacattattattcttattttaattatctccttttgcattgcactagaaaaaatgtgtttgctgaaaattaggcacaaatcttgcttgctctgtgtacaagatctataaagattcacttagcagcttgcagggacggtttcctagaaggtaaaatatttcactgaaaatattatcaattgaatattttggaacacttcagtgatattgtttggtttagataatactgaaagcaaaatataaattatgaggtgaagtgtatctctaaacatgcatgattcgcttgttgagtttcagattgttttcgttcaaatgatgtaagaggtttatacttcagttgcttttgttaaataagcaaatcatctttcaatttttttgctacaaagttaatctagctttggaatgctgcttgatgtatagtaaagaatgaacacgaataatctccactttaataccgtttctttttttttttttagtttgcagttcaaagctattaaatatggaacccatagcagtcataaagaatatgtaaaagttttctcaaagctatccatttttgaggggaaaatggatttaatccagtaatatatgttagtaattttaatcaagttcaccagttgtcttaaacagtttttaatctataaacttttagtggactcctaaagatgacattttttaccagcacaatagaaactattcaagttctgatgcatctttaatgtaaataagtcatgtttttaatattttattccaggatatgttttttcattaagggaaggggagaaaaagggtaggtatgctcattgtccaaagttgataagaacattatatttatatatattgtttatacttgtggttgcaatgtatctataaaaaggtataaagaataatataacaatcatttacctacccccagtacaaaacgtataacattgtcaatttgaccatgttagctgaaatcaaaagcgagctcatgaagaaatgatcaggacacggtgagggaacggccttgtttgatccagcttgatcttcttccatgtcggcacccagtgtctggtcctgtttattaaaaataaaaagcatgttcatatgtccctgatttaaaatgccacctttaccaaatattctgtgtctggatgtgttgtgtctgattctgggtttttcttccatcacattgaccctctttgtccgtgagccacgctgtgttgcgttaggcactgaggctctttatttctaataggaaggactaagccacctgctcctttggttcagagttttcctgagtatttgagtctgtttatccttttcacgtaaatgttagaatcagcttgtctagttccattaaaacaagttggatttgtacctggaaccaagtgaaactgaagtctcaggtcttctgcagtcaagttcaatgttcttccacactcaccacctcccagctctgtcttcttactgcattaggaggcattctgagaaatgaagaggttgttttgaatattgctatcaaataagtctttttttttttaattgaccattcttggaattttgttccataggggatatttgatagggttttaattcttatttgtttgtagttcaggtcataagaggttcttttaaaaagggaagaaaaaatagctctgtgaaatgtgctaaagtgcttgcatgtgctgttttgctttgttttataacctttggtacaagagttggcattcgtcaaaactgaaaacgttggcttctgctctgcaagagatttgtagctcccattcttaatgtgggcggtacctgcaggtactcacctgccaccacactcggcatgactattttctactgcgagacattttccatgtccttttaaaagaattttaatatgtaagggcaggaaaacaaagtgaactgtatgaattaggtgaactacatgagctgggctcactcctgtgcctctgcacttttattgttgttgtaaagtttgtttttcctggtcccagaaatctgagagaagtcagccttctcaggcaaaccaattattgattaattatgtataagaattaaattagccatttgtgtgtcttctgcctattattaataaactttttattttgaaggctgggtgcggtgactcatgcctgtaatcccagcactttggaggtcaaggcaggcagatcacctgaggtcaggagttcaagaccagcctggccaacatggtgaaaccccatctctactaaaaatacaaaaattagccaggcatggtggcacatccctgtaatcccagctactcgggaggctgaggcaggcagcttgaacctgggaggtagaggttgcagtgagccgagatagcgccactgcactccagcctgggtgagcgagattctcaaaaataaaaaataaaaaatactttttattttgagataatatagattcacatgtagttgtaagaagtaatacttatatgaacgtaagccttcatttctctgggataaatgcccaggagtacaattgctgagtcatgtggtagttgcatattttatttttaagaaactgccaaactactttctagagtagctatcccattttacatttctgccagcagtctatgagagatcccttttctccacagcctcatttcacctggggctgtcactatctttaaagcaacactatgttgaatagcccttctcggaggtgtgcagcggagttatctcacggtagttctcagctgcatttccctagtgactcgtgatcctgagcatcttttcatgagtttattttccatctgtagatcctcttcgtgtcctttgcccattttctaattggactatttgtatattttactgttgagctttgagaatttcttatatattctatttgttggatatatatttttcaaatattttctcccagtctgtagcttgttttttcatctttttaacagggacgtttgcagagaaaaagtttttaacttccagtttatcagttgtttcttttgtggattgtgcttttggtgtgaagtctaaaaactctttgcctagccctagatcctgaggattttctcctgtaactttctaaaagttttatagttttatgttttgcatgtaagcccataatctattttgagttaagttttgaataaggtaggagacctgaattgaggttcatttttttggaactctagttgccccaataaggctgtgcctcttcacgaaattgcttttgcacctttgtccaaaatcagttggacatatttgtgtggtgtattcggggttctctgtgctatcctcttgtgatctgctcgtctgccccttgccaacactgtaccgtaccgatgactgtagctttgtaataaatgctgagatcagctagactgattgctcccactttattttttttttatggtggttacattaaagtctttctaagagaattctaacacctgtgtcatctccgtgttggcatctgttcattgtcttttttcatttagtttgatatcttctgtttctcgatgtgacaagtgattttttattggaacctgattatatgatattatgagactctaaatcttactgaagccttctgttttagctgactttctcatacaccacggtgtcagaggaagcggggatgctgtctcattactgctggatgggggataagtccaagttccccactggggctcccggatagctccctgttgtgagagggcctcatcactgctccatctggagccttcactggcagcaccggctagcgtcgtttctaccaggtggaaagagagcccagcttccccacatagtctctcatgactctgcactgtggcgtgggaagggaaggggttgttagagcctggtggaaatgaagattgtggcttgtcactcagccttgtctgacaccacccaacaaggggactctggggttgtccttacagcctggcacgggtggggcgtggttgaggttttttgtttggtgtttggctggaataaagcaattcttgtctaagaagttttctgtcttgctgggctacctctttcctggtcctttggccagagagagcagcttttgttgcagctttttgtgtgttttgtttctgccaatgcctgctgatgtttctggcttcctcagctctatgttgagaaaatgaagcaaaaggaaaatgcagggtcgcttctcaggtcctgaggccccctggcttgtcagctttctctacatctctcagtctttttatgtgtgttttatgtataatatccaggatttttagttgtatttaatgggaggaaaaaggagaagaactctgtcttcccactgaggaagttcctttgcctatttaaaaccagtttcagccaataagaacagagctatttggacaggcttattcgttgttcctccagtttatagtttgggcttctgagaagcgccttgccatcactttgcctgcataacctcagtgccctcacacaagccacctgttttcccgtcttcgtgatatgctcagccagaccccttgtctgaagctcagtttgacgagcatgtcctcattttttggcctgatccctccagccaggaggctcctgggagcacccacagcctactgagggcatctgccctgactgcaggggtcttgccctctgtgcctacatctcacctcccattctagaccttaacccaattactttttatcggtccttccataatggaaatattaaaacatatacaaatatacaattgtatcaagaactctgcatgcccgtcagccacatcagtaattaccaaccagggcccatttgttggttttgtctacactcatctatgtttttctcaccacactgaattattttgaagtaaatcctagatattgtcctttcatttgtaaatacttcagtatatgtcactaaaagagaactgccatttctacacctaaaataatttatcataattccttaatataatcagctgttcaggcagtatttacatttaagtttctcagaatctgatttaggttcttgtatctagcacaagtgctttgcacgtaatagattctcagaaaatatatcttgaaatagttaatgactataaaataataatgcttttaaaactatctggaaaactttgttgaataaaggattctaaagagaaactcatttaacttttagcaacacatttgcctgaaatatagtgagattgaaagttattaacatgatttcatgaaaaactatatatataaaatatatatttttagatatatgatatttgatatagatatataagatatatgcatgttttagtacattttagtcaccattttctaagagcaatgaatttgccttttagtgatttataagttttatttgtacacaaagtaacgtgtgattataaaatttgcaaatcttctttttcctcaattgcaatttgatgatattatttattatagaacatgtattaatacagtctgacaaagtataactaaaatatttaagaagaggaaactcttaaatttgttagtaactagaaattgtaatacctgttctttgaggatttcctgtggtttctcctgccaacaaaataatacttatatgtaactaagaaattagattgaattttagcagtcttgtgcactttagttttgtctgcataaggagctattcaaggtgagagagaagtagctaagtgagaagctgtaggttctggttctgctgtgtggctttagtttacagctggaagccaaaagtctacccagagtaaagatagatggcaagtatgtgagcgcccttctgaggtctgtcgccatctgtcatggcgtgttgtgtccttagtccatcctgcagcaggcgtctttccagagtgcaaatgccagtgcctttgtccctagttcagcgctcttcatggccctccattgcctggaatcaaacccaccctcctcagagtggtgtgaggtccctgggcactggccctgaacctcccttgctgggacctggtcccaccctcatcatccctccatgtgggagaatccacgcgagacgtcctttgctgtgctggaatccacgcgagaagtcttttgctggactggaatgtgccaaggaggagtattttgtaccagatggcagatctgacttctctaacaagacctagttcttattttatgatttttttcctttaatttgtaataatgttgtaattatttccttagagtagacttacttcatattactcctgtcataggcacactaaatgctattttcttactgtctttcagacagaaacagtctccgccagtcaagaaaccctcaaaagtattttgccatggatatagaagatgaagaaaacatgagtaagatctaggcctatcacgtagtatcagatagctaattttatgttaacattttggtgtttttgcaaatgtatttcatgagaccagtgtggggattgtgttttttcccgtaacatcttctactgacagtggcatgtttttaatttttggtgtgttctctgcaacaggtgtcagaatttgctgcagacgtttttccttcctcgttatcgtcgtggggcatcactgtgccccgtggaatgggcttctgggtatatctcatgaagccccactgtttcatgtggagtcctgtcacggcatgcctctcagaataatgctccgagtattcacacatacaaatcgaagataacgtctgagattgatttaaatacccaggcctttgcaataataggacagaaatatttcccttcaaaatgcaggttctcgctgcattttgaaggaaggggattcacacgtgtctgttgatctaaagttcgcaaaggtgctaatgagagctgggactggtgtgggcctcctccttccgtgctgttctctctggtgccggggtggtggaaggccgctggggtacgttggtgtttcggtgaaggtacttatctcttctagttcatcttcagtcccagaaaacaggtttagatgcttccacggaagttgggagagtttagtagagaaattacaacaaaggcatcattgctctaactaatataaatatctgtatttaccttcttacttgtctgaaggaataacatgcagctgtcaatgatgagtgacatgtcactgggagtgattattgagcattagaacttagcactttccctttgactttacgcacaaccgatgatctggggtcttggagtcactcttgcgtaccatgtagaacccaaaccatgacccagtgaagcatttctgcatggtattgatttctgcatggtattgatttctgcgtggtattgctgccccatgggtgtgctgtggaggcggctgggcctctgctctatggactgtgtgctaagtgttggctttggttgaagtcagccatctggggtgtgagggtgagaccacctcctgcagtgctacccaggaaccacgggaccagcgtgctcacctcacttccgctgttgtgtgcgcagcccgtgcctgcctgctggtgattgtttttttcaggtttttatcctcatcaatcctgctcttgagatcttttaaaaacccagcttcatgtttttactgggcagttctactcactgtttccaagtttgtgacaagttttaagagagaggttacgtccatactcctcatttgagaaaatgtgacctgtgcttggcccgtgcagtagcccaccaacggagcatgtgcaggggtcctcagggcctctgtgtcaggactgtggcctacagcctacagctgcagtcacctcgcatagacagaggctttgtgatcgtgtaggttctggaactatccccaaactgatcctgtgatcacttgacatgataaagaatcctcccacatttttctgtgaagagaagccgatgttgtagtgctaaaacgtggacattctggtcctgtatttgtatcattttgaaagcaatgcaaagccctgtcatgatcagtatttacatttatgaagtgtagtagcatgatacagaaagagaaggcatctgttgaagaaaagctgtgaaagtggcatctttctctagttttagtattttcctttatgatagtagcattttcagtgacagtgagagtagtatttcagtgtgcccctgaggtgaataagaatttagaatgtatggaatctgtatcacagaaagtgtattcttctcaagattatttgtcaatccaatagtaattatttttatttctgaaaggaaagcatttggttatttcagaggttataaatatttggttaaatgcatgtccaaatacatttataatgatttgatttttgatattgataattgtttagcaacaaagtcaaaatgtaagcagtaatctagtatgtcatgttcttgctcagtttattaatctctgaattccatcttggctctattttttttaaccttttgttccctttgagcaccgaaaggagtaacctatcgagcttttgctggaggatgttataaatgaaaatttagtgtccattccatcagctttgtcaactgggagaagtggtgtgtgtgtgaggattattttggagaaataatgtctgtagagaaagttttaaatctcttagcctctaccacagtgtggcatcagttttcccatggattgtgtctaaaccaggtttatgctctgctgtcttggccgaatgatgacagccctggaattagagatctttaacctcaaagattggcagccaagggcgaggacttggtccctttaaacattcccatggatgaagctgatgaatattttcacaacttttcagtttgcttaacgtaatgagaatctaccattttacacatgtagtagaaatagaccctaaagccaccatatggggcactcgtaaattggtttacaattttagtaatattttggttactttaaaaaatacagatttttgaaatctagtggtagatgtctttaactttcattcacattacaaccttgcagggcactgtagccctcacccttgggctccatgtgacagctgcctagccatgatggaaaggaattatttcttcttctcctttttaaaaagcttgatgaacactttatactcctctttttaaaataaaaaattagggctgggcacggtggctcacacctgtaatcccagcactttgggaggccaaggcaggcggatcacctgaggtcaggagttccagaccagcctgaccaatgtgatgaaaccccgtctctactaaaaatacaaaaattagccgggcatggtagcccacgcctgtagtcccagctactcgggaggctgaggcaggagaatcacttgaacccgggaggtggaggttgcagtgagccgagatcgcgccactgcaccccagtctcaaaaatacatacatacatacatacatacatacatacatacatacatacatgtataaatccataaataaataaaatttaaaaattatgtttattttgccatgtaattttacaattctaaaattgtctgtattaattcaaaatctgaaatacctttaaaagttaggataaacaaattattctggaaattcatcaaataattgttttaaaaaagacaaaatcaccagaaagtgtatttatgaagttaggaagttgtaacctgcctacagcttcagttttgtgtcttgttcttacacacttttcctatcatggaacgatattaaggattcagacttagtcagcccccatatataatattctcatttttaaatagatactagaaataaaaccataccctcctaaacacaacaactaaaaagccataatactttacacaattacataagcagcttttaaagattggttcataaactaaatcaaataattgcatttattgattgaatattttaaacctgaaaaactaattatcttgtgaatgcatgtttttaaatagttttctcttctgagagacgctgcaatttaaaacccttagatagcatgagggtaaacaacagtgaaaggaagatgctaaaataaatatatatttatccatatattgatattaaattgtcatttcattagacttattaatgtaaggtctttctggattaatttatcatcccacattttgataaggttgaaaaagtctaggtacttcagaatattctcagaagaaaaaaaattatttaaagattttactttttaaagcaaaagcagttggtgacactaaatagaaatggtattagtcactaagcaaagtgtcagattacttgtttagttgaggctgatagttctttaactaaatgtataactcttcatgtatacatcaaggaataaaatttataagcacacatcacttaaccagttacaaagagagctaaaggaatctataaattttgcatttacaagatcctgcaacgaaggcattgtaagttactctttctgggcaccacaggttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggtgaggaactatgctgctgctttaaaacacggggtcattgctcttggtaatgcttctagacagcattttagtttcaggattactgttgactttccaccttgacatcactctgtccccaccaggaggagttactggtaagtctggctgcttgatttccatggccatgtggccactgagaagccgtctgcatcctagtgcatgctgggtctgtcgcaatgcaaggcagggacacctgagaccccgtccaccagagcagtgtttacaacactatccataactcccttcccgttaggcaaccccccccatgaccctcatcccacagcaagcctttagcaggagagacggaagaagagcccagtctttgaaaccttgcccccagttcagcaccattttccttcaaaggtctcatccaagaatctcacattcaagataagtgacaccagcccgtcagcagctgaaaacccaagtctgggtcaagatggcagcctctgggctcccacatgactggctggtggctgtttgctgttcctaagccgaggagcccatcaaagcagcgaatgagccagcacagcagtgagcacctatcagagcgcagggagggaggggcctccaacaactgttctagggcctgccagttgcctgggagtctctactttgaatttcctacatgggctgtatgaggacttccccgcatgcccaggctggaggtggacagccacccttccatttgacctccccagcgcagtgaaatcaggatgaaggaaggggaagttccagggtgggcttagattggcttacgtgaaagagaaaaagtaaaggagaaaatcacctttagttctcatctctaaatcctaaaactctctgattatgtattccttcttttcttggaaatccaaagttcttctggtctattgcaaaagttatttttttgaccctctattcatttattactttgtatcagagtcttcttcactttgaagataacatgtatactacccttgaccacaagacttgaaggtggcttgtgttcccctggaagaatccaagtgtcttatagtttcttttttgctgttggctacaattagaacaacctctgtgcagttgtagtctgagatgaccaggagttctgttttaaaggaaggaaatgtattttattttgcctaaaggaatcaaatgcaacatcagtataaaataatatattcaaggtatttcactgatttttttaacgaaccaaatacttgcttcccttattaacctctcgtcaacattgtttataaggattattagtccatttgtactttaacaaatcagtgctactagatcccatgtgattttttattttcaggattactctttgctaaaatattaaagcctgagttcaaaatattgtctgatgtgacttgtcttcccttaatattgacagagtggcatataagaccattgaaatgacatcaaatgccgtggatcccagatgtctgaaccttcagtgtgtaggctaggagcaccttaggcggacgcagatcgaagtgccagtagagatgtcacccctgcctccctggcttggctgtgcgcctgcagtgacttctgtgtggagcatgaccagagcccctggcttgggaaggctggagggacatctgttgggctccagcctggggaggggtgcaggtgggcagggctgcctcagccccctgacgccacgttcctctgggctctgtaggtgctgaacaccaggctctaggcctcatgtccagaaccactagggcatgaggggatggagctgcacttcgagtctctgccggagtggaacctgccaccttgtgtctttggagcccccaggatagccccggaatgtgacgtgttccttgtaggacccgggtggccctcccagaagcagtccttagggctttgttggtgggctctattgtccttcaacaggaaatttccaaatgtgcattctaggatgggtggaaaaccctcactctttttctagagtaacccttgaaggacgtaggtcagtcatccctgcgtgtcactgcaggtaaatggtgctgcctgggactgtgtggcatgggtttaactcttaagagcattttttttgttcttatatctgtcccccaaattaagagggaagtccttcattaaccatacaggttaatgagaccagtaatcccctcaacggggtgctgagccctggccatgtgcctcagatgtctgcgttaacaagcatcagccccagcaccagaccttcagagtgaggctctcggaactcactctgaagttaaagttcttcgcctctctttgaaagtttggagattcgcctaatcttatatgaaatggaaacttttatttcctctggcttatccctaatcttcttatgactttttcttctctgtaaactcgaatgaatcgccctttccctctggcaccctggccaattggaatgcgtcgccccttccctctggcaccctggccacgtcctgtgtttctgtcacagcctcagttcctcgcgtccgctcacccctgcattgcagatgccgctgcctgcgggtgcatggatccctgccaccaaagcctctgtccattctccacatgacttgtcttgaacactgtcctctggggctcactgatacttgctggtgcaatgataagagaaaaacatcctgacaactatcttttctactcatttcagaaatattttattaaggaccaacctggggatgctgggttttcctagtagtcatttgattttccagacaagtgtgaaattggtgggacatgagttgaaactggctcttaacacccacctcccagcagacatcatttcccaaaatgccatgggctcattatatccaagataaatcataagccataagaccatgtccaaaatccaacaaatacatctgttctcagaagcactttaatacagatgtctgtctgacctgagcatatacctgtgcaggtgttccgaacgtctaagcgctttccctccccgtgctgttctctggtacatgattctatcgtaccgtctgggcgagtgagcggagtcagagtgcatttgtgtggagaggctggaatgactgagaagcctctcggtggcgcctttgagggaggtgctgtgcacagcttgtggcttccttcactggatcgcatctccaagctgcccctttctcttgcctttgattttgcacatcatcctgggctgtgctcccagctgtgtgtggccctggagctgactgagccacaccgtgtgtgcatgtgagagagggcaaggggggtgggagggccatactaggtgggcgtaggcgtgggcaggtggccctgagcaggcagctttgcctgtttgcctcggtttcctcctgagggccgggctggcctgcggtgaggattggagggatgctcatgtgtggtgcccacactccacactggccccacgcgggtggcgaaggactcagccagagcctggcaggatcctggggtgtctatttccaaggaatgttctggaagaaacatacacacatacttgtttgccagatttacctgtgtggtcttccagatgagaagcagcctgtgtcactccataagggagagtgcgtgcagcattgagagagtgagccctgctcccagctgcatctggcccctaacctgcatctgtgcttcccacacaggttttagctgacgctgtctcacgcctggtcctgggtaagtttggtgacctgaccgacaacttctcctcccctcacgctcgcagaaaagtgctggctggagtcgtcatgacaacaggtaaccatcttggtgttgtatgtaaccctgcctgttttcatgtctgacaaatgtgaaatgttctcaatcgacaaaaaccactgtgccacaccgacgggagatggttacttcttttcttcttcaaaatgtctgccatatgcaagtttacgaactgcacttacaagcttttttcccaaaatgttcatctttttaacctaagtttgttttatctggagaaagcacactatattaatatttgattcctgtcatcttcatcctgtgaatggcctcaatctgctctggaagatggcaaggggcttactaattcttcctttatttgaaagtagagcctatctattgtatcagttaatgttaacgatgccagataagtttcagtgtgacttcctttgaggagggagagagctctagcaagagtagaaaatccgtggggaaaaaaagcacaatttagaacgatagaagaaaccctattaaattagtctagaagttcccagtagcaaaaggaacccccgagtcctctccccacatcccgcgagtgagaacacgcagcagcatctctgtgggtagctcctgggaagggaagccacatccttggccagtgtctggcaccccagggtggagcaagactcagggagaggacccctgtcatgtggggccgtctctgtacccagcatctgctcagcccagcctggacagccagatgcaggaagcagaccctagaggtcagggaggaagctggggacagtttctctgtctacatccaccagcccaggagaaacccccagttctcggtatgtgactttcttgttctttccccctgaggggtcacctctatcagactctgcagccctcttcactgacccacctcttgctgccctaggaaacctggctgctctgctcatgaccattgtttccttgccgtgccgtgtccagggaggaggaagcacccgaacagcagcttctattctaatgttttgtacctgtatcttctcccccttttacctctctccttactgctatcttttacattaatcaaaggtgaacaccacaacgactgaatagaatagttccctaggtaagactccctgcctcttccagcagcatgggtgagtgagctggtcatgttctttcatcgttttgttgttgttgttgttttgtttttgttgttgttgtttttaacgaccttagaagaggccgatcaccttctgggaacaccttacatcttagtgtgtatttcacctgagaccacttgctcagagccatagtttacatctgaagccaggacgctggagcacttggcactccagacagctggttcagggggctcccgctggttgagtggacttgggcaggttacaaggcctctgtgcctcagttccctcatctatacagtggagacattagtagcatgagcctcagaggacatcgtgggaatgcagtgaggacaatttacctaacagacctggtgcttacctgccacatggtgtgcacaccattggttcagctgcagtggatgcgagtttcccggcaggtgacttccagggtcctggcatcacacctctggtcagtggtttatctcacaaagttgagacggagtgatctgtctgtgggagttcaccactgcttgtgatttcactccgagtgtggttaatggtgacagtttactaatgaaaacatcacaagttaattctgttttccttcttattcctctgggtgccgttaacccctccttcctaatctcttcagtactttgatatttgatgtcaagattaattaccagaccagttagtccacctttccatagtgttgcccagctgtgttctagttgtgggcattcaagaaaagatgctattgcataccagaggaaatgacttccttgagtttagtgtctggacactaagcaatgacgatggttggctttccagaaatgtcacaaagtgagtcctcaataggaggttgtttgcgtgtatacatttgcccacttaaaaaataggtggtaagaatatgcatgaagatgagcttgaaaagtctgttggcccctgaaaagttaagtcactgagaataagagtcagacttcaggagcacagttaggcaaacattactgtgaattacagaaaatagtgtctctttttttttttttcaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaagtaagtttagtaaacaaataaggacaggaagctctttttaaaaaatattcctctattagaaaacattgcaaaacctttcattgtttctgtaatcatggaaaatctctcaaaatcataactttaattagtaacaataaggctgcatcccattcttccacaatgctcaacacacatatgcacacatacatacaataacataacatggtcataaatttcaagtctgtgtttaagaccatgtgattttgttgtatgctgtataaatagaagttcccaaactgccaggtaaagatggtaatttttattctagtcaccgtttctagaaagagctagtcatgtatccaaactccttttctttacaaagccattttttgtatgtggtctttctgttctgaagtcataaattggaagaaggaaaggttactcacatcctgatgacatatccattattgagtgacaagaactgtattaattaccctaaacatgtaaaataaatattccagttcaaacttatctttcccttgtggaaaatactagcctctgaaaatgatagactaaaatttaactatatacagctttaaatgttacttttgcaacttttttcctttcagtaacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaaggtatgagacgagattcttcaacaagccagtttctcaagaaaatgttaacagataaaaactaacctgtgttaatatcccttttcctttttttctttttatttttagacttggatgtggatctgataagagtctctataaaagcatggatttttttctttccaattaacttaattagaaaactttaatgaatgaaaaatgctgattgtaattaaccaagtaattagaatggagtgagaatattggattaaaattgtatcagtatttaaatttgggtaataaatatctctaaatcagaggtgtatgtgatcctccatatttctgaggaattctaatttgctaaatgtgtaattaaagtatttatttgcctgatatttcagaagcagataaacactagtgaaaagtgaaaccactattgtgatcatatttttttccatccttctttacatttgaggttagcacttttgttttttagtgttttgtatctacatcccttctcccaagcccttaggcattgtttattccaaatagaacgttttattacattactttccttgtttataaaagcaacaggcatactcactgtggaaaattgctaactatttttaaaatataagaacattaaaatcatccgtattcctgtaacccagaaatactcactatggatgttttaccatactttccatgggtttatttctgcatctgtctagatttattttggaaattttaaaaatatagaggaaaataacatggcaaacacccaagtatccatcacccagaattagcaaatgttagcattttgtcctatttgcttcagtgcatttttaatgatagaaataaatcatttcagttaaagtgaaaaccccatttccccaactcccttggagaccacttttgtgaattttgtttgtgttatgtccttcctactcaatttcatataattttttttttttttttttgagacagggtctcgctcttacacccaggctggagtgcagtggtgcaatcatggctcactgcagcctcgacctcctgggctcttaagcgatccttccacctcaaccttccaaggagctgggactacaggcatgtaccactatacctggctaatttttatattttttatagagatggggtttcaccatgttgcccaggctggtcttaaactcctgggctcaagcgatccacctgcctcagcctcccaaagtgctgagattacaggtgtgagccaccatacccagcctctcagcttcacatacttattttgtatgtgtattttgtatgtatggcataaacatatgcatttatatgcacagactgtattttaaatttataagctattgttagatgtgcttttcaataaatcaaatagatggtttactacctgtggggttttaactctttttctctcttagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacggtaaggggcgggggctccctgtggccacctccctgcacacaggattcatccatactgtttgccaacctcccttttccacaaccatttgaattttggccccatttcccactcaggtgttccacagtattctttgaaggactgaggttctaaacaggtgctgctgggacccccgtgaggggcagcagcaggacctagacacaggaggctccacgcttctaacattcctatccaagcgtctcagagtttaccacttatttttaacgtgggcttctgggttaaactgatgtttttaatgggctacaggccatgacatcttaaaactactggcttctcctcattagtagtagatgcaacttcagtggtcactttcatcattcagttaacattttaggtagttgatatgtgcattttaaaagtaatgcaaaccctgtcacaggcattgtgttctaagcacagagagcatccccagccattctgtgcctgggtgtgggttaggcttagaggagggctctgcaagcacacttctgtagtcagcaggcacctgggagatattcatctttcagaggcctgtatccagagcagattatagaaaacccatttcttcagatggtatcagttccagtagttctttgttttcatttttaaactaatgtttatttggaaaaaaaaagtaacataagcagatggcaaaaagcatacaatgataaagtttaaaacctccctcttcagagccctcctgtggcacccacagtgagtgggttttgactgtccatccagaagctgtcaaaattgatgcatacgcatgtgcacgtgcacatcttttcattgtttgtgtgccctttatgttgatttccttcagtgggtcttgtcaggcaacctcaagtacagggagctggattaatcacacattttgggccattgcccacagcccaggtgaccactgtgatgtgtttatttattatttgtccttccagtccacctccacacgtgcatatgtcaactttgtgtgtgtgtgatgtgggggaggggggtgtactcttgaaaaatacacaatagaattatttggagtatttgttgctaatttacagaaatgatactatgctgtaaatcctatctgattcttacattttcattcaacctatatttttggagctatttctgttgctctaaccaacagccagttcactactgacttttgcaaatcttccttcatagtcatgggccatttccttcatgatgggacacccatatttcttctaactcccttatacatgtagtcctgtatatccttcaacttatgcaaactccatcacaatattatagactttgctagagtttcttggggcatatattcaggagttatgcacatatataacttcacagaataatatcagattgcatcccagggcagtcacactagttgacacttacaccaatagtgcattaagttagcttctcccacattctgtaaactgatatcttcatagtttcaatttttatttctctttatcactaggaatgttgggcatctcttcaattacatattaactgttcatcttacaccttctttgagttgtctgttaatatcatttgttcatttgtcttttgaatctcatgcctttttcctcttgattttcagagttccttttacagttgatattgtaatccttagccctttgagaagatgcagtgtcttttgcaagtcctttcccctttgagtagtcttgcactctgttgaagatgatttgaacatatacacaagggtttattactgtgctgtctgttctattccatatgtctattctttatgccagtgtcatgctgttttgattactgtagctttgtaatatgttttgaaatgaggaagtttgaatcctccaactttattcttcttttttcaaaatccttttggctatccagggtctcctgatatttcataaagatttttggatgaagtttttcaaaaaatgccatcgttattttgatagggattatgttgactctatagattgctttggttaatatggacatcttaacaatattaagtcttctaactcatgaacatgcgatatatttccatttatttgtatcttcatttctttcagcagtgttttataatttttattttacaagccattcacccccttggttaggcttattactaagtaatttattcttttttgtgctattgaaaattgttttcttaattcccttttcagatcattcattgttagtgcatggaaatgcaactgatttttgtgtgttgattttgtatcctatgattttgctgaatgtgtttattatttaaacagttttatggaatctttagggttttctacatataaaattatgtcatctgcaaacagatataattttacttcttcctttccattttggatgccctttatttctttttcatgcctacttactgtggctagaacttctaatactgtgttaaatagaagtggcaaaagtggacatccttgcattgtacctgatcttagaggaacagttttcagtctttcaccgttgagtacagtattaactgtggtcttttcataaatgtcctttattacgttgagttagttttttttctattcctagtttgttgaatgtatttattattattaagaaagggtgttaaatcttgtcagatgctttttctgcatcaattgagatgatcatgtggcttttgcccttcattctgttaatgtaatgtattaattgattttcatatgttgaaccatccttgcattccaggagtatcataatgtataatccttttaatatgctattgaatttggtttgttgagaatttttgcatcagtagtcatcagagatactggtttgtagctttttttacccttcttcatgtctttggctttgatatcagggtactgctggcatcatagagtgagcttggaaatgttctctttagtttttttgggagtctcaggaggattggtggtaattattcttaaatgtttggtagaattctctagtgaaaacatttggtcctgggcttttttttttgagatggagtctcgctctgtcacccaggttagagtgcagtggcacaatcttggctcactgcagcctctgcctcctgggttcaagtgattctcctgcttcagcctcccgagtagctgggattacaggtgcctaccaccatgcccagctaatttttgtatttttagtagagatagagtttcaccatgttggtcaggctgatcttgaattcctgacctcaggtgattcacctgcctcggcctcccaaagtgctgggattacaggcatgagccactgcccccagccatgggcttttcttaattgggaaatttttgattactgacccaatattcttatccattaatagtttgaatgaattgtttttcatattcattattcctgctatcatttggttaccatctgcatggaatatatttttccatcctttcactttcggcctatgtatccttagatccaaaattagtctcttatagacagtacatagttgaattgttttttttttttaatccatttacccaatctgtatcttttgattggggagtttattcattgacatttaaagtaatcactgatagggaagacttactgttgccattttgctgttttctatatgcttgtagctttttgcttgtttttcccttattctcttactgccttcctttgtgtttctttcattattttttctaatgataggtgtattagtccatttccattttcattgctgataaagacatacctgagactgggcaatttacaaaagaaagaggtttaatggactaacagttccacctggctggggaggcctcacaatcatggcagaatgtgaaaggcacaattcacatggcagcagacaaaagagagctagcttgtgcagggaaactcccctttataaaatcatcacatctcatgatacttattcactatcacaagagtagcatggtaaagacctgcccctatgattcgattacctcccactgggtccctccgacaatacatgggaattgtgggagctacaattcaagatgggattttggtggggacatagctaaaccatatctataggattctcatttattttattttttccttttgtctccgtggggtacaaaatctcatttctttttgtgtatattctacaggtattttctttgtggttaccattgcaattacataagacatctttaaattatagcattctattttaacttaaacttcaattacatagtaaaactttacttctttacttccaccccttcacactttgttattgaagtcacaaattacatctttatatactgtatatccattaatatacattgtagttgtaatgtttttgtcatttaaattttatgcaccaaaattacaatagtattggttactgtatttgtccatgtgcctccctttacaggagaaccttatttttccatacagcttaatgttgctatttactgtctttctatttcaacttgaaggactcactttagcatttcttgtaaagcaggctagtggtaatgtactccctctacttttgtttatctggaaaagtcttaatttcttcttcatttttgaaggacagttttgccagatcaaatatgcttggttgacagggttgtttttttttttttttctttcagcacttaaaatatatcattccactcctttctggcttgcaaggtttctgctgagaaagccacaggtcttatgaatcctcccttgtatatgacaaatggcttttcacttgatgcttttaagattctctgtcttcactttagacagtttgattaaaatgtgtcttagtgtggttctccttggatttatctgtatttcatttctttgagcttgaacttgtatggtccatttttttccacagatttgggaaactgttagcaattatttcttcaaataagctcttagcccctttctctccctcttctccttctggtattcctagaatacttgtataagtctgcttgatagtgttccgtaagtcccttagtctcgcttcacttttcttcattcttttttctttttgctcctctgactcagtgatttcaaaaaaagacagtgacctgtcttcttttttccacctcatcaagtcttctgttgcatgcctttaatgatattttcagttcagttattgtatttttcagctccagaatgtttggctcatttttatactaatatctctttgttgatatgctcattttgttcttgctaagtttttcttattttgtttagttgtctatgttctcttctagctcattaggcatctttatgacagatattttaaattcttttttagacagctgatagatgtgcatttctttagggtcagtttctggaaatttacttttggtcctttggttgggctatgttttcctgtttcttgtatgccttgtttatttgtgtgctttgctaatatttgggcatttgaaaaaagaaccatctctcccagtctttgtgtactggctgtgtacagagaaagttcttcactaacaagctggctaaaaaatctaggacctcttatgctttttctgatttcctgcttctcctggtgtcttcctggaaaactgtagctctaatgtgctgcttgcctctgtttttagtggctcccaaactctggcaccagtctcatcaccgagtctgatgagactcaggcaagacagaaaccagccctttgggcagactccagacagccagaacatcagactaatgatccactcttttgtttccatcccaagagaagagccccagtatggaggcttcctcccacttagggggcaccttgctatttagggaaaggggaacaaacaggcatgccaaacatcgtgaaatttcctatccctttcattggaatctcttcctagttttacaatggactggatactgtagcttctcagttggtctccagagttctcacagagccattctggtctgtatattgttgttaactcagggtctctatgggggaaagagggcctgtagcttcctagactgccatcttgttgaagtcgtagtccaaacaccattgattttttaatgttaaccttatggccagcaacttaactcacttcttattctatttatactttcctggttgttcttgaatgtaccaagtcacagtctgtagatattgactgttctatatcttcttttgttataccagtgttatttttctttattcctgctgtccaggaccttggatgatatgttacagcactgtccatgttttcttcctgaatctcagagagattgtgactgaagtttctccatgatgtacagtttttcctacagggttttagtaggtagccttcatcatgctaggaaaattctgttctattcctattgtcttagagcctttttattatcatatattggtgttactttatcaaatgttttatgtgtgtctatttttaataatggtaaataattaatagatttcctgatgttgaccacctttttgcaattttgacataaaccttactttattatagtcactcattgttttaacatactgtttgatttggatgactaatattttacttaggatttttgtttataagttaaataggcctatactttttctaaactttttaattgttcttatctgattttggaatccaggttaatatagcctcataaagtgtgtttgtcttcttgttctactttctgaagtctcttctgtgagacagcagtgtatagaacccaagagtgaaaacatccagtccatatatatatatatatatatatatatatatatttttttttttttttttttttttttttttttgtagttatcttcatggtcatcctcatcattttggcaggagaccagtctagttgtaatttcaggtccttttctggttactagtttcttaaatttttgtttcttctagaacaaatttttagccttcatattattctagaaatttatctagaatttgaaggtttgaggcttctttgaaataagccagtcgattgtggcattcaggcagagaaggtggatctataattagagaatagagtagtggtagtaagagaatgagagctaaaaaagagtcagctaatgcagtcagaaagaagaatgctagaattttactatagtagagctacaataatttctgtggttatggtttcaaagagaaggtatgggaaggagtaaccaaataaggtggacatttgaaaattatgatgtattgtattttacaaagatagccccaccccaatgcctctcatctaaaatcctctccaacaatgtgaccttgccactgtaccattaagaggtgacgtctctgtcccatgcccctgaatctgagcctgtcatgtggctgctttgaataagagaatgtggtggaagtaatgcagtgctagttctggcatagccttaattggcctgacaacttccatttcttgcctcttggtggcagccaccatgtgagagttgtgactaccttgagaccaccgggctataagaagctgcccctccgtgtagagaggccctggaagatgagatgccacttgaagacagagagagggcaaggaacagtgaagcaccaaatgtgtaagaaaagagttcacctggaaaatggaagagagaagacaaaattaccaatatcggaatgggagaggtgaaattaccacagatgctacagatactaaaaggattgtgaagagaaattataaacaaggctatgccaattgacaatttagatgaaatggacatatttcctgaaagacacatactaccaaagctcacttaagaagaagtagataacttgggctatctatatgtattagagaaaatgaatttgtaatttaaagcctttcccaccaaaaatgacaacaaaagaaaaaccccaagctcagatggcttcactattgaattccaaacatttaaggaagaaatacccattttgcacaaaatattccaaaattgaagtgaaagagatacttcccaactcattctgtgaggccagcatttccctggttccaaaaccagatgaagacaccacaagaaaataaaactacatgttaaaatgtgtcatgaacatagatccaaaagttctagcaaaactttagcaaaccaaatacagcatcatgaccaagtaggggctatcccaggaattccaagctaaatgaaacatttgaaaaatcaatataattcaccatattaacaaactaaaaaagacacagaaaaggcattttgcaaaatccaacatgtgttcctcataaaaactcatagcaaaatagaaatagaaggaaaccttctcaacctgataaaggaaatctatgaaaaatctacaggtaatgtcattcttaacagggaaggactgaatgtgtttgcctaagatcaggaacaaaacaagattgtctgctctccccacttctgttcaacattgtattggaagttctagccagtgctataaggtcctaagaaatcagtggtatccatattgaaaaggaaaaagtaaaactgtctttatttgcagacatacttatctatgtaggaaatgagatggatattatacaaaactatgagaatgaatgaatgattttagcattgtggcaaaatataagatccaaaatgtaaaatacaaaatcagttatattttttacacctgcaacaagcagttgaaattgaaatgtgtaaagcaatacactgaaagctgtatattgaaaactgtaacacattgcctagagaaattaaagaactaaataaatggagagatacatcatggtcactggttggaaaactcattattgtcaagataccagttttcaccagattgatctatagactcaatgcaatcctaatcaaaatctcaacaggattttttggagaaattgacaaactgattccaaaatccatatggaaatgcaaaggacatagaataggtaaaacaactttcaaaaggaagaacaaagtaaaaggctaatactacctgatttcaagatagtaattaagaaagtatgattttggcataaagataagtatacaaacaagtgattccttattatttagagtggttttaggtttataggaaaattgagtggtagatacagaatttcccatatacccagtgccctcacgtatgcacagcctccccatcatcagcatctcccactctagtgctatattcattacaatcgaagacacatcatcatcacccaaagcccacagtttacaatggggctcactcttgatgctgcacattgtctggctttggacaaatgtataatgacctgtatccaccatcacagtgtgagaccagagtagtttcactgccctaaaaatcctctgtactctgcctgttcaccccctctcacctcctaacctctactctgcctgttcacccctctcacctcttaacctctgtattctgcctgttcacccctctcacctcctaacctctgtactctgcctgttcacccctctcacctcctaacctctgtactctgcctgttcacccctctcacctcctaacctctggcaacagctaatcttcttaatgtctttgtagttttgccttttccagaatgtgatctagttggaatcatacagtatgtagccttttcagattggctttttacacatagtaatttacattcaagattctttgatgccttttcatggcttgatagctcattttttttaagtgctaaataatagtttggatgtgccacagtttattcattcacttcctgaaggttcattgcttccacgctttggcaattacaaataaagcagctataaatatctgtgtgcaggtttttttgtggacatgagttttcaagtcctttgggtaagtaccaaggagcacgaatgctgggtagtatggtgaggatatgttgagttttgtcagaaactgccaaactgtccttcaaagtggctgcactgttttgcattcccaccaacaatgaatgttgtcccacattgtcaccagtattcagtgttgtcagcagttctggttttgggccattctaatacacatgtagtagtatctcgttttaatttgcagattcctaatgacatatgatgtggagcatcttttcatgtgtttatttgccatctgtatatcttcttgaatgacgtgtctgttaaatttttttggccaatttttaatcaggttgttcattttcttattgttgagtttagagagttttttgtatatttggaagagttcttcatagatttatcagatatgtcttttgcaaatattttctcctagtctgtggcttgtcttttcactcccttgtctttcacagagtagaactttttaattttaataaagtctagcaaatcagttatttctgtcatagattgtgcctttgatgttacatctgaaaagtcatcaccaaacccaagatcatctagattttcttctgtgttatcttctaggaattttatagttttgcattttacatttaggttgtgacctactttgagttaatttttgtgaagggtgtaaaacctatgcctagattctttttttttttttctgcatgtttatgtccattggttctagcactgtttgtagaaaatactaccttttgtccatttcattgtctttgctcttttgtcaaagatcagttgactgtatttatgtaggtctgtttctagactttttattctgtcccattgatctatttgtgtattctttcaccaataccatgctgtcctgattactctagtatagtaagtctttaagtcaggtaatgttagtattacagcttcattatattccttcaatactgtgtttgctcttctggatttccctttttatatcagccttaggaacagttcatcaatatctacaaaataacttgttgaaatattgattgggattgtgttgaatctctatgtcaagttggacagaaccaacgctgagtcttcctagccataaatatggaatatccatttatttagttctttgatttctttctttggaattttatagttttacttatacagatcttgtacatactttgtcaaatttatacctaaatatttcagttttgggggtgttagtgtaaatgatgttgtgtttttaatttccaattctgctgttcattgctggtcacagttaatttttgaccaaggcacaaaggcaattcagtggagaaagaatagtcttttcaacagtgatgctgaaataagtggatatccctgtgcagaaaaaaaaaaagcaaaaaaaatcaagcaaccaaacaaatggacttcacttatattttgcaccttatacaaaatgaatttgtaatgggccatagacctaaatgcataaaaattctggaaacaggagataatgtttgtgacattgagttaggcaagtttttagctacactaaaaaagactttccataaaaggaaaaaaactgtcaaagtttaaaaattacttctttcaaaaagcactgtttaaacagtgagaaataaactgacaaacagggagaaaatgtttgcaaatcatatatctaataaacgattggtatccacaatccactgttactctcaaaacgcaacaaggggaaaatagtttttaaaatgggcaaaatgtttgaatggacacttcaccaaaaaaagatacacaaatgtgaaataagcacatgaaaagctggtcaacaccattagtcactgatgaaatgcaaaggagatgccacaacacatctcttggagtggctgaaattaaaaagactggccaaaccaaatgttgacagtgatatggaggaactggtactgtcatccactgtggctaggtatgtaaatagaacaatcacttttaaagacagtttgacacagccaggcacggtggctcatgcttttaattccagcactttgggccaaggcagatggatcgcttgaggtcaggagttcgaaaccagcctggccaacatgacgaaaccccatctctactaaaaatacaagtattagccaggcatggaatcccgtctactctggaggttgaggcagaagaatcactcaaacccaggaggcggaggttgcagtgagctgagattgcgccactgcactccagcttgggcatcagaataagactcaaaacaaaacaaagagagtttgacagttccttaaaaagttacagatatggccaggcgtggtggctcacgcctgtaatcccaactctttgggaggccgaggcgggtggatcacaaggtcaggagttcaaaaccagcctggccagtatggtgaaaccctgtctctactaaaaatacaaaaattagccgggcatggtggcacacacctgtagtcccagctactcaggaggctgaggcaggagtatcgcttaaacctgggaggtagaggttgtggtgagctgagatcacgccactgcgctccagcctggggaacagagcaagactctgtctcaaaaaaaaaaaaaaaaagttacagatatgcctgccatgtagcctagccatttcactcctagtggtttaccaaagagaaatgaaagcgtatgtccacgcagacttgtaaatgaatgtttgtaggactttctttgtaatagacaaaatagtcaaaaactggaagcaatccacgcagccatcaaccggtaaatagatagaacagacggtggcatatccatgcagtggagtactactgggtgaaaaaaagaacagtgatacacactacagcatagagaaatctcaaaataattacgcagagtgaaagaagccagatgaaaaagaggaattaccatacagtcccatttgtatatatctcgggagaatgcagactaagctgcagtggcagaaagcaggtcagttattgcctagtggggacagaacgagatgtaaggagacaggaggtttggggagtgaggtcacatgggtacatacaaatgtcaaaacttaccacagtgtccctttaagcgtgtgcagtttattgtatgtcagttgtaccgcagtaactccaggggaagaaatcacatgagaaaatgcttatataagtaaatgacagaaagcaccacaactatatgaattagaaaaattcaaataagttagaaggatgcaaacagtaaagttaagagcagaaattagttttgtaagcaacaaagatgtagcagtgagcagtaacaaagcctctaagatgtcagtacttagagcaggcaggttgattaaagtcaacagaaccggtgaggctgatcaagaagacagaaggcactaccaaaacgtatctggaatgaaaacacggatatccttcagggtccagcagagattgctacagtggagagtcctagacacttcagcactgataggttttaaaactgagacaaaatagaacattttctagaaaagtgtacattgctaaaagtgacttaagcatatgcagaaaattggaatagaactctgcctattaaattaaatcacacacacacacacacacacacatacacacacacacagagaataaattaagaaaatagaaggaaggagagtctgtggagagaggggaagtggttggcccagacaacattgagtgagttctagacatcgtttgtgggatgatgatccccattttatgtaatattttccaaggatagaaaagtagggaagaattctgcagctcattgtgtggctcataactcaaaggttactacaacctttatctccacaccagacaaggacagtaaaggaaaacaaaacaacaacatgtcatggaaatacacatttatacacttacattatctttaaaaatttagcaagccaaattctattttatattttttaaagcttcattaattcctcttaaatctatcatttcaatgtgattttaataaaaatcttattttttcatagtacttaaaagttgaatcccaacatggcaatagaaaactaacaatataaaaccatagtaatcaaaagtgagtggtaattttcggcagaacagtggcacaacatacaatctgaaaagacctgcagacccatggggcagcactggtgatcaggcctgcctgtgtttaaaagaaaatgtaaactagatggaggcttgtctctctcacagaaaattaagtccaaaaataggtggcccagagaagctctggtggctccatggtctggagcctgatccctctttgtcccgcaccatctaagaggtctcttctgagttcagggtcttcataatccctagagctgacgaaatccctgagtacccagtctgaattccaggcacagggacacttcagccagctcagctcatcatccagagctcaggcacagggctccactcgctatggggcagctggggtggccgggcttacacactcagccacctggaagaggactggggctctgtcatgcaggaggaagggaagaaaggcagggctgcagccagcagtctgtgctagacgtggtgctcgcagaagacatggacaaagtagccaacgaccagtcctggagaaacaggctgtctgtgcagagaagcagcccaccatacactatccaaagcacatgctaggacagttaaggacctgagtatgcagagcagtgcctggcagttgcagggttcttcagtaaggcacagaaaaccccaattataaagaaaagtgaataaatttgactaaattaaaatttcaggaattatttactataacccacatatttggaaaagaaaagccacatattgggaagagatttctgatgtctcatgtgaccaacaaaggattcgacttggttacaggctgactcctgcacctgcatagcacaaagccatccatttggaggatccttgctggggcgtggggatgtcacacacataaatgcaggagtcggggctcatggacctgaacccttcagatccaagccttttattatatagtaattagactttacctcaaggaagaaacaaacacaagctgatagaacctagcatgggtgggccaagaaatagcaaatggccagaaaagttgcccggaaagagccctggtggccaaaatgatgccagttggctgcagctgtgtccctgctctgggagagttgagagtggggagcagccaccttggagggccaggtggatggggctgggtgaggctgaactgttccccttacacaggacacagtgacaggcagagggcccagggccatggtaggttgggggtggggtgggagccacagcactgccattggaggtcaccagggtgtccatcccactggcaggcagtttggcggtgaatgcagccccagagagttgtccacaagaccatggggtgagaggctcccatggggttggccaccccacggtgattatgttggcgcgggagccgtgggaaggaacgagagtcttggttcagatgacctcggcctgtgtcctcagctgcacagagctgtgggaacaaacaagaccatccagaggaggaccagcagcctgtctattcagagtcggctatggcaagggggccagagcactgtgttgggcagactcaaaggcacgcacaggaagggggatggctttattgtagggaaagggggaggctttgggtatgttctgatggaggtaggggaagccaagatgggctctgcagaaggtggcctcccgtgcagctgcttgaagaacccaggggcatctctggctggtcctgggttgaaagcaggaaggaatgggcgtggggcaaccactaggaagctgtagtccttcctgaaagcctggctgactgggccgagtgctgtggaggctgtggtttgggtcagagtagttctcctgccctgtgtggtctggccgacgtctgtctgcagctcagtctctcaggccgggccctttactgaatcaggggacagatcagatgatagcagtctggactctgttcctaaagaaatggcacaaggaaaatgaaagacgaagaaggccaggcacagatgcctagacccgggtgcactgagccgaggccatgctgtgagagtggggacacctgtaggttccttgggtgtcagccaaacacacttcatggcacgctgtgagtgggcacctcccatggggtccgcaggacaggtggctgtggacatgtagtgggtatctctaggagacgtcctgcctgcagtcttggcagagctttacttgttttatttgcatggacgctgactgtgtctgacaccctctcgctggcgctaggcgatttcatcctgatgaagtttgtcccagctgtcctttgtgaggtgcattagtggaagctggtgccacaccatttcccacccagggcctctgcagagctgtagacactcttggaattctctttcaaagcatacgttcagaattaatgactcctaacaaatgaaggtttctgcaggatcactgctttaaagtttgcccagaagacctaattcagcttaaagatgctgagtccatagaggcttctaatctgtagaagaaaggggcctgtgtttcttagaggtattgaatcatttcatgctttttctgtaagttagggaaaccttcattttcatttccattttggaaggtggaaggaatgtgtcataggaattggaggatttgtccattcgacacatatttattgatcttctgtatgtgccaggtacatattgtaagtgctgggataggtcagtaaagaaagcagacagaaacctcttcctgcactggggtaggatgggagcagagagtccaacatggatctgtaaattatgtggaagtcagaatggggttggagggcttgggcggcagggaagggagacctcaggcagcaggtaagcaaaaggcttgagtggctgggaagggaggcctccctcagaacggcttttgtacagggacctaaagtgggggcagccatggctgcctctgggattggtgttccagctggtggacctgtggacagaagctttgggcaagcagcaaggaggtccctgagggtggccagaagcttggggacaggtgcagggtgagaggtgacagggctgggggatctggccggaggactgctggcattttcttgggagccactggactgttttgtgccagggaatggcctgtgctggcccacgtgttcacaggggtcaagaggagagggcttggggcaggcaccgggttccccttaggagagggcgtcatgacacaggcaggggggcatgacttgacccatggcgtagcagtggcagtggccagaagtcaggtcctatatctcttccaaaagtggatcccaggtgatctgctgatgactgctgtgacagggatgagcagggtgagggtgaccccagagtggggactgagcagctggaggtcagtgctggggcatatccagaatgaggcgtaaacaggtgaggttggcggctgtttgtcatgtgctgcctaccccacttgccagctctgccctgctaggttcttgagggggcatggagtggccctgagacttcaggcctccaaatacaactgtgggcattgtcaggcagaggctgtgccacggagtgagtgacagaggggggatatatggaggctggttccagtctgggcgtcagcctcctccagtctcaagtcctgccacatccgcagatctaagcccgaatgtttctcatctgccctggcctccctgtccccacactgcccagtcgaccttcatttctgacctgtactgctgagcgtcttcccctgcagcgtgtgctgagcatcttcccctgcagtgcgtgccacactgtgctgagcgtctaaccctgcagcgcgtgccacactgtgctgagcatcttcccctgcagcctgtgccacactgtgctgagcgtcttcccctgcagcctgtgccacactgtgctgagcgtcttcccctgaagcgcatgccacactgtgctgagcgtctaaccctgcagcgcgtgccacactgtgctgagcgtcttcccttgcagcctgtgccacactgtgctgagcgtcttcccctgcagcgtgtgccacactgctgagcgtgtaaccctgcagcgcgtgccacactgctgacgccacttcgtaaaatgcgcatgcgccagcccctcccctgagacactccatgaaattagattgggccactccagaggcctctctctgccatctgaataccgccccctccctcatcaagctcctggctgcttaggggcccctgccctgcccctctgccctggctgcccttgctgctgtcctgtgtcccctgccccccaggctgggacatgcgttcctccctcagcctcacagccccctcctttggggctaagcttcagggtcaccccaggagcattccttcaagtacatacacccctttttctttttcacagaaccccgccctttctcccaaattgattttacctcaatttatagttcttcatttgtctttttattgcattattgtttagctcctgagctgtatctccccccaggtacttcacaccctgtgtatgtagcgcccagcaaagggtgctccagacacagcaactcccaggctgagcagagcatctctgctctttgtggggctcagaaagagagaacaggcatattgtgaaggcatgtgtgtgttggagctgataatgaatacctaagttgccattggcatgcatcattggtgtcatgcatgtcagctgcacacgtgcagtcgctgtaaatccccacaccctacctgcctgtgcattcagtgccattgtcacttgcagagaacaggaaataagcagtttaatgttttgaaggacctcttgaagagctgtccttttttaagaagtatagtggtccccgcttctccgtagatgtgtctcaagacccccagtagactcctgaaactgtagatagtactgaaccctgtacgtgctggtatttttcctgtaagtaccttcctatataaagtttaatttatgattagacacagtaagaaattaacagtcactaataataaaataagagtgacttgaacacaagcacagtgatgctgtggccatcaatcttatcaccaaggcgactgctaatgggccagcggcatctgcaacgtggatggttcacatcccgggctggacagcacaagatcgcaccacactcctcagaacggcatacagttgaaagtctggaagtgtttatttctggaatttttcatttaatatcttcagatcacggttgacagtgagtaactgaaacctctgaaagtgaaacctcagataaggggacctgctataattaaatatgtaatttcctttctgatatttcccacagatttctcacaagaaacatatgtggctcattgattgtgggaaaacgtaatggtaaaaacaaacacagtgtaaaataacttttaagtagatttttgtctttgtgatcgtaagctgctaaatcagtctgttaactttttgttgcactccttcgtcagttggttgggatcctgcggaattgccagtgcatccctgtaaccacgcaggcttgggctgggctgcgtcgacactgagtccgagctccctgaagactgtgctttcttctccctccagctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcaagtatctctagagtgtgctgatttaatctctgtcttgattttgcaatgttttcatcctcatgaatgaaaaaaacaccacctgagctgctctgtggctatcaaaagaacatcagagtccttctaaagagacccaaggtgatgtttctgaggctctccgggccttgtctctagggccttttaagtgagtctctctgtaagattaatctcctttaccaatcacaaacctagccattcatagaagaattgatgggttcacacctgtcatcccaacactttgggaggccaaggcctagtggattgcttgagcccagaagttcaagaccagcctgagaaaaatggcaaaaccccatctctacaaaaaatacaaaaaaatcagccagatgaggtggggcatgcctgtggtcccagctacttgggaggctgaggtgggaggatcacctgagcccaggaggtcaaggttgcagtaagccaagattgtaccactgcactccagcctggacaacagagtgagaccctgtctttaaaagaaagaaagaaagaaagaaagaaatgaaaaatgaaaagaatgaaattatgactgggctgggcacctgtctgttttcctctcactcaggcactgtattcattcctgtctcagcagcagagactcaacagacactgaaaattatgtcagcattggctttcccagactaaccctgagccaggtctccgggacgtttacgctgtcttagagccaccagggtgtccacagcggtgagctgcctagagcctgccctgggctccctggagaggccctgttggctccgagagatggtgacaggtggaaccaggggtgccaatggcaggcagaggctgtctccctggtgtctgcacctaccctcgattcccttcattgctggttttcttttttctttttttagaatttcagtggctaacagtaaagtgaacaggagcttttgaattcaaaggtcctaacttctaagctcacctttatttaaaaggacacagttaaggtatttttatctttttaaacatataatttcactacttttttaaaagctcaaaactaaaaccataatcctaacctgaaacacgtttattttggggtgtgtgtgtgcttgtgtttgtgctgccttgttttctagtgcctggcaactagcacgcctttaatttgagaaaaagcagtgtggaattttatttgaaagcatgcctgtcagagcacatgaaggaggcagggatggggaaaaacagttgtctttaattaaattttacagttccgtaacttaaccattgtgttttaagaaaaacaaaatagataaaacttgatggtaggtaggttgaaattgtagcatcaatgtcttttgaagtattttgttgtgtattggtgtgtgaatttctcatgattcagaaaatttccctctttgctctctgtcttctgtacttgagcaaagagtgctttaattttagctgtcactcatcttttatatgcatagatacttaaaacattgcatgtggaatatgggacacataggtgatactcaaaaatagttgttaattagggccttgttgaatagcgctgtctaagcaatatctcatccgtaactaaaatctgcaaagacagaatcattttgctaaagaaattttctaagatattgaaagtagagctcatttataaaagtcagtgtatttttatcatatttcacttatgtgaaaagcatctatatctgttaaaagaccttgaaagatagtgtctgcaagatagagacttcaaagttactgatgctgctgtttatcctttcctcctcaatatcttctctggtctttttttttttttttttttttttttttttttgagacagagtcttgctctattgcccaggctggagtgcagtggcgtgatcttggctcactgcagcctccacttcccaggttcaagcaattgtcctgcctcagcctcccaagtagctgggattacaggcgtgtgccaccacagccagctaatttttgtatttttagtagagacggggtttcaccatgttgaccaggctggtcttgaattcctgacctcaggtgatctgtccacctcagcctctcaaagtgctaggattacaggcgtgagccaccgtgcctggcctccgttatctctaatcttgatagcctaaagcacattaccaaacccctcccctggtccccgctgcagggggctgtgccgagctgattcagcagcagcagagagagcctgggttggagccatgaggctgcccctgcgtcagctctgcctccttggaagcttctgtgtctcgggttcttcatacgcccagtggcagggatggaccaggcaccccttgcaatccttctggacaaatgtgccactgtcctatgaaaataaaaggacaccactcaagctccaggaggcagaaccttaactcaaatctgagccaataaacaatgtcactctagcaccaaagtctatttcaaaatgcaaactatttgaaatatcttatttttggtaaatgctttattttggaaatgggtttttgttgttgtttccctgaagagagttcagatcagcaaagcaagtagctttggagaagacacctttagacgaggactcctgtgaatcagcaggacagcgtagcaggacattaggtgagccacagggtggagcaggatgggagggcagaggcttctgcttcagaattgaagccgaaggcaagtaatgctgtgggtgttactggagacaaaaggaaccaaacaagaaaaatctggagaggcaaatgttgatgtcttaatagatttgggaggtcacactctttaaaaatgggtcccaaagcaaagctctcaaaacttcattaaaagaaaagtcttacatttgacaagtgacctggacagaggagctaccaggacattggcccccttgctgtgcacctgcactgtgcatcacagctcacgtcgtgtttgttacactttgtcacctcacattttattataaaggtcattcccgtgttaaaaagagagcgcggtatgacagcgcctagtgaattgtagtgtctttagggaggaacaaaaatggacataaatgaatacaaagaaaagattacctgaaactgggagcaaatcaaagtaaaaatgtagggatagggtgttgctttcttttaaaaagataatgctgtcaggattaaagtgagaagaatttaattttcatttcagcctgaacactagttttactttcagaaaggttcttggtgccaagctgtgacacttttgcctttgtgggtatacacacttggtacccttgcttagcactgtggaagaggaagtctctcgagctttctcagactttctctcaaatgagtttcacatccagcacttgcaagtttcaggacaattccagcttcttatttatgtccattgatctcctgagtgtgagctcctcagctggcccagtttgttgtccaacgctcactaagataaaccaagaagaaggagcagggtgcccaaatgccgcatgcgatggctctggggaccttgttgacagacagcctgctccggggtttgcagacaaggcttcctatcctgctggttttcatgttgaatgttggcacgaaacgttaacaaacaaggctacatgatggggtagggtccttgtgaagagcttgcatttaggtatctctgggaggacagcacagggacccaagggggctggcagcaggcccaggtgtgtggcaggaagaaggcaggtgcctgctgagctgctatccacccgagaccatttgacattatgggcaggaagagcaagggaagctggtttaatgaggccctggctggagtgagagagaaggaacatcactgtgagagtgtggaaagtgtgtgtgtgtatgtgtgcgtgtgtgtgtgtgtgagtgcatgtgagtgtgtgcatgagtgcgtgtgtgtatgagtgtgtgtgcatgtgtgtgtgcacgctcacatgagtgtatgagagagagagtgtgtgtgtgtgtgtatgcgtattctccaggtaagagcaggcaccggggttgtgggaaagaggtgtcagtaatgtgagtttcctccttgccctggtttctaggaggagtgaacgtgccatgagtcattgtagaagagaacgaccaccaagcttggctccaagtacagaatcattcttttcatctgacaatttttctttccattttactttctgttttcctcccctttgcttttgctggaccgattaaattgtctttcccctttcttccgactggtgggaagttctaaatcttatttctattctgaccagtggttaccccaattttttaaaacaaatatgtttaaatcactttgaaaaaatgttggcatcaagaattaatatttgtaaagatccaaacttgggaaaagctgaaatattgggctcatttttattccacactcttcccatcctcatcttcctagattctgatgacatcatcttgagttttagaaactcattttatcgtgctttttttttaaaagcctttcgtaatgagtcacatagcctcatgatcaacaattgtttagatgaagccgtaagagctcctggtttctcttctaaccagttttctgtagccagtgctcctgcccttaactccacatccagatttatttttcactttgctggaatatatccttaattggggtgacagggtgatttcttggttggttgtttttgtttggtttttggagaaaagtcctgtgtgggtggggccctggatcttgatgttacctggcccttgcctgtgtgccaggtggactggggactgtggatgtctgggctctgccctaccccaaggacacgtcaagacctccatgccacccctccatggtcaccctttgtcacagagccagtttgagtttctttcctttctagaaggtacctccttgttttctctcctgtagcgttacatttatctattttccctaaaattcaggaatttcaacagattaagcctaggtgtgtggttagtttgtttgagtttctttcctacttactaccctgaaccctctgatctggattgttgagtcttcacttctgagaagtttccttctgtcctgtcacttctgctagaagcatcttctctgccctctctgttgtccctgaaaatgctgctgagcagaactcacaggcctgtgaccagtgtctctcctctcatctgatgtgcttttttgactgtactgcattctaagagaatgcctgacttctgtcaccatctcaggagtgaactgttttccccgcggagcaggctccccgggagctcatgcctggcccacttccctgcaccacggccgccacacggctccgtctcttgctctagttctcctttctgggagagtgactccatttggggctcgtcatctctgttgggttttcagtggctgcatttggggttcctcatgtctgttgggttttcagttctccttttgcatactgagagaacaactttctagtgattggaactgtctagaaaagtttcctgaaaggaattgagctcccctgactggaagagttcaggttggaattggatggacactgttgttacggacacggtgataggggatctggctgaaaggattaacccacgtgatctccaggtgtcttctaaactcgagatcctacggagtgcagtttgcttgtttttaaattctctgtgcagatgactgtaatgctacagtacagttaccattacctattgtatcaatgacacttttgaaggtttttaaaaataataatagttacacttcactgactgccgtcctcaggccatctcccgggcatgcatgtgctcaagtcaggagccagattcttacatgcttccctgaatccacgccgcagccctgtgggccgggcctgccgtcacccttcacagtggaagcagccgcagccggcagacaccacgaggcttgcagctcacagccatattccactgtccctaggacaagtacagcttgaacccacatcccacctttcaccaccccaagccttgcctcccatggacgaagacagtgcacgagagtgccttggggctcccccaggagctgcttcaggaaaaggaggagctggcaggatcactgtgagcctctcagccccactcccccggctgctccccttcatctacatccagttagcatctcctgcccatgcagctctctggacatgagcccacctcactcaggaccacagctctgaggctccttccacagctggtgttctaaaaccctgaggtctcctttgagaaaggactgttatgtggccagaggtcctctgtgtaaagccctcagcacctggctggggttagtggacaaccaggacaaggcacttccgagctggcagagaaagcctgagagcagccctggggagtgggctggaagggtcaggagaacccagccatcttgctctgtacggattctaatggcttgtgtttatttctctgtcagctcaagggctgcccttaagacgatcacaatgaaaggctcaaaggtgctctgctctcagcttaaatggcaggttggttttggacccagaggggctcagaggctccctcctgtgttgcatggcctgtatcatcctcactgggggtgctgtgcacagttttccttatactgtaacttatgcccaggtcttgactctttcttatttgcagaataaaggccactttcagtcgagattgtaagtacacattttccttgatccactaatgaatgtctgatagtttctataacatgaacccataataaccctaaaatatccattaatcattatgtatattattcatttttgattaccctactgtatgaggaacctattggaaaatacctttagggtagaaataagaaaaaacatcaatgccagctcttctgagttttttaattgtagcagttattaggccaattcacagtttctctgtgtttttgctttaaaagttctgattcagcacacttaatttacaacaacagagggattctcgttaccagccaagttgttcttgcttttattggtttctgtaccgcggcctgggattaactcattaccctagttccctctttgcaggctggaaagataagcatctcactcacgtcagcccccacactgcactggcctcagggactcgtagacgtatgcgcttatgaccatttaggggctttctgccccagaaaaagcgtatggttagtattggaagctcgggctattttcttttttccttgtttcctccatttttgtttcaagatgggacttgatttaacttaaaatataaaaaatattttgtactattgggatcttatattttttgttaatcatttagttttagtgaaaaatattgtaattctaaggtttaagtatcattcaacagtaatcctttattttgatgagaagtagtggaattgcaaaggaagataatataagcgttatccatttgtttatgaaagattcaattccattatggtcagagattccccagcagtttaaatggacaccctctcttctagccattcccccacaaaagaaatccttcctgattctgtctgcttgaagggtgtgaccttgaacatgctcctggggctgccgcctctacagagtgacagctcagggacctgcaggaactcagaacatgcaggcaggtgctggaggtagggcaggtgtgctggtaagatggatgacctcagttccactggcaaaactgtgccacaggagaaacctgagcgtgtggtaaaaaccaccccagcagcaatcagtaaatgcaggaacagtgacctcaggaagacatgaggctcctaccagtgcctgtgatgaggccagcccagccctgtgtgtggttagggcacacctgaccaccccgacaaccagggaaggacggtgttggagctctgagttcttggcatgaggacatgatcttggctgattgttttccttcagaccttctgcagaattgaatgcacatcaaagaaacaagcagaagaaaccatgccagctacttgtattgaataaaagtattttacttacaaacttggattatcaaacttatgaggaaaataacacaaaagagaaagatctatatgagaaaacagaacaactgaaagaaacaatttagaaaacaagagaaataagtaatgataaatcttattagtatgttatttagtaagtgctgaaatcaaatattaatttgaaggtctagaaaatattcagtattttttgagtgtgcagtgggcatggttctgggtgttgggattttgcagtgcacaggacaaacaaaacctcttcctcatggagcttttgctctgatgagggcagggggatggtgaagtcagataagtctcagataacttggaacagaaaggcagaattatgagacagtggccagggtgctgcccaaaacctacccaatcagaatctcagaggtaggattcaatgtgcttattgtttaaagcttcatatctgattctactgaacatatctgcttaagaactacaaaatatatattggctgtctctgggttttatagctttaattttctaaggtttgtgtgaatttttggaattgtccatagtgagcaaatgttatttttttaatgagaacaattttttttatttttaaattatctttagtgtcttttcacaactttattgaggtataattggcatatgataaactgcatatttaaagtatacaatttgatacattttggcctatgtttaggtctgtgcaaccatcaccacaataaagataatgagtatacttaatccacttcaaaattgtcttagtactccttcataatccctccctctccccgatccccattcccatccccagtatgtaccatctgtctatatagatgagtttgcattttctgggattttacataaatgtcatcataaggtttgcaccgttttggtctagcttatttcactcagtttaatcacttggagattgatctatgttgttgggtttatccatagttcattccttttcattgctaagtagcattgcactgggtggataaaccacaatttgtttttcccttgaaatattgatggatatttaggttgtctccagtcttttaatattataaagctgctgagaacatttctgtacaaatctttgggcgcttacttccatttctctttagtagatacctaggagtggaatggctgaatcctaagataggtgtatgttgaactttttagaaaactattaacctgttttccaaaatggttgtaccattttcacattaccaccactagtgtgcgggagttgtagttctgtcacttatatgccggcacgcagtacgagcggttgctttagaaattttagcaggtgtttagtgatattccattgtgcttttaatttgcattgctctgatgactaatgaagttgaatgccctttcacatgctgatttgccatccctgtgccttcttcaataaactgttcaaaacttatgcacatttttactgagttgtttaacatcttattactgggttttgagagttatttatattttctagatacagatcctttatcagatatatgatttgaaaaatgctttctcccaatcagtggcttgtcttttaattctcttcatagtgtcttacgcaaaccacataattttaattttgacaaaatctaatttatagaaattttctttgatggatcatgcttttgatattatgtctaagaaatatttgcctaagtcagtactacaaagatttcttcttatattcttggaaattttacagttgcagtttttacatttaagactatatttcacttgagttcatgtttgtgtagggtatgaaggatgaactgaagttcattttttggcatgtaagatatccagttgatttagcaccatttagtgaaaggttcctcatttcttcatggaattgccttgtgcccttgtcaaaaatcagctggcatgtatatatacatgtgggtctgtttctggactctgttgtttgcctttaatctctttgtctaaaggccagtattacattgtcatgattactatagttttattataagttttgaggtcaggtagagttagtcttccaactttgtactttttcaaagttgtcttggctgcttaggtcctttttgtatttccatagcaattttatagtccactcatcagttctacatccttattgcactggttaggacctccagtacaatgttgagtagaagtgatgacagcagacatccttctcttacatgtcatcttgggggaacacattcagtctttcaccattaggtatgatgttggctgtaggattttttattgctgttttttgttttagagacaaggtctcactctttcacccaggctggagtgcagtaacgtgatcatagctcattgtaacctgaaactcctgggcccaagtgatcctcctgtctcagcctcctgagtagctgggactacaggtgcatgccaccatgcctggttcatttttaaattttttatagagacaatgtcttcctatgttgcccagattggtcttgaactcctggcctcaagcaacccgcctgcctcagtctcccaaagtgctgagattataggaatgatccaccatatctggctgctgtaggttttttacagatgtctttatcagctcaagacattttttttttctatttatagcttactcagcgtttttaatcaagaatgtatgctggattttgtctgatgctttttttctgctcttagatgactgttgtcattgcagtgacttaggcctatagtcccagctacttgggaactaaggcaggaggatcacttgagccctggagtttgaggccatcctgggcaatgtagtgagaccccatctgaaacaacaacaacaaaaaatgagatgagcatttagttcatttttcagtttgctagtggtgacgttaaaaaaaaattaaaccaactttgcatcttgggataaacgttatatggttattatgtgctattctttttatatattgttggattcagtttgctaaaatttcatttagaatttttgtatttatatttgtctgtagggatattgggctatcattttagtttaatgtctttgtcaggcataaaatgagttggggtgcatttctttctcttcagttttctggaagagtttgtttggatttggtattatttctttaaatatatggttaaattcaccagtgaaaccattgggcctgaagtttgctttgtaagaaaattctaactacaatttatttttctataatagatttagggctattcatgttatctgtttttatcttttttcttgagtaagcttcagtaatttgtctttcagggaatttgtccatttcatctaatttgtctaatatattggcataaaagcattcagaatattcattttaatatctgtgatatctctaatgatatcgtcttatcccttatattgatgatttgtatcttctcttggttgtttttttctgatcagtctagctggaagtttttcaattctgtttgtctctaagtgccaacttttaggttcagtgatttttgtcttttgttttatatttcaataatttttactctgattttaattatttcttttttttccgcttacctggtgtttcaattgcccatctttttgtagttttttaaggtgctagttgaggtcattgttttaagaccctttttactgcttttgtagcatttaaaaattatgatatgttttcattttcacttatattaaaatactttgtcccttgggttatttagaagtctgctatttagtttcaaaatactagggattttacagagatctttctgttgttggttttttagtttcatttaatgacttcagtccttttaaatttattagacttggttttatggaccagaatatgatctatctttataagtgttccacaaaacttgaaagaatgtgaatctgccactttggggtagagtgatctgtaaatgttgattaggccaagttgtttgattatactatttattttcttttatattcttaccgatcttctacttggtctatcagttattgagaggcaggattgaaaatctcttagttataattgtacattatctatttcttccccttttttagagtttttacttcctgtattttgtagctctgtgattagatgcataaaaatgtaggattgttggtttatcttaataaaccgacctcctttaccattatatgatgaccctctttatttctggtaatagtgtttgttctgaaatttgttttgagattaatataacctcctcaactttcttttgattagtgttagcacagtgtatcttctatccctttatattaaagtactttatcttaaaaatatgtttcttatagacatatatttatatatatttatatgtttggatcttgcttctctctcccaccatggacaatctctgccttttcactgaggtacttagaccatttacatttattgtgattattgatattattaggtttaaatttcatcttgctacttattttctacgtgtttcatatgttctttgttcactttttcctcattttcttactgcttttgccttaattgggtgtgtttgatgattccattttgactccttcttgacttttgagctgtaacttttgttaatttggtggtggtttttagggtttatagtatgcattcttaccacgatctcccttcaagtgatattatactacttcacatatagtaaaagaaccttacaacaggatactttcgtttttccattcccaacctttgtggtattgttttcagacacttttgcatgtgttaaaaaaatccacatcttattattttcatcttaataattatcttttaaaggaatttaaataataagaaaaaaacctcttgtatatttatccatgtagctatcatttccagggctcttcattctttgtatagatctggatttccattttggtatcattttttcttctggctggaggacttccttttacattccttgtagcacaagtcttctgatgatgaattatttcagctttggtatgtctgggaaagtattttgctttcattttgaagtatattttgctgtacaaatatatttctgctggaatggcagggtcctttttctcctttaagcactttaaagacattgcttccctgacttgttgtttgcgttgtttccagtaagaaatgtgttgttatctttattcctctgtgtgttttttgctctgggtttgcttaagattttctcttaatactagtgttgaacaatttgttctgttgtgctttggtatatagttttattcatgtttcttgtgcttgggattcattgaaattctttaatccatgggtttgttggtttcatgaaatttggaaattttttattcatctttcttcagatatattttccgttcccccttctctctcctcaccgtcatgaaatctaattacacatatttcaccctacctaaacctgccccatatcactgattttctgttctttttttctctctttgtgtttcatttttggtagtttctgttactgtgtctttaagttcactaatcttttcttctgcggtttctattctgtggttagtcccatcaagtgtattttttatctaatacattgtagttttcctctctagaaatttggcttaggcctttttatatctttatgtctgtatcttctatatgtgaatgtcaggcacttttccattctctcaggaggctgtttcccagccttgattgagtaacatgcctactctgatcagtgctccgcaggatattcaaggacaccctctgcgtatctccagggctcactctgtctgcatgtctcttccttccggtactctgtcttatgaaatctggctgacttggtttcccttgactctcaattcaggggatctgctacactctgcctgggttccttactctgaacagtgaactgtcatctgggttttgatatctctccaagggagggataaatggtcattgaaagcaagtgagcatggtgacggggtgggggtggcctccacagggcacgaagtgagttgtactgagtcatctgagagtgcagtgtgctgcttctggccagtgggcttgacagttcagtgtctgggttcagaatatgagtctgcccatgttctaagcatgttctaaagattcatatcccaaattagttttgattttggtggcctataacatccatgtgatatgaattatcaagctcaatatataaatgcagatacatgtattcaattccgagttatgcaagtgtctttttaaaaactttcaaccctgcagaattagcctgtgattagttaagatgagatcgtttaaacacagcaagaaaataagtacaagggtacttcaaaaagttcataaagttaaaagataaaaaaatgtttaaagatataaacattatttctcaacataagctccatcaaattcaagacatttttgtaagtgctgatcctagccatttagattgtccctaaagaactgaatggtggctaggtgtggtggctcatgcctgtaatcccaacactttgggaggccgaggcgggaagatcatgaagtcaggagattgagaccatcctggccaacatggtgaaaccccatctctactaaaaatacaaaaaccagctgggcatggtggcacgcgcctgtagtcccaggtacttgggaggcagaggcaggagaatcgcttgaacccaggaggtggaggttgcagcaagccaagatcgcaccacacactccagcctggcaacaagagtgagactccgtctcgaaaaaaagaactgaatgtcttgggagtttaaccatgtcagtgcagtctttcttacattagtaactgaagaaaaattccttaagcatgccccttaaggaatttttgagattaggaaacaaaaagaagtcagaaggagccaaatgaggtggatttgcaaccaccataaggtggatggctcatgatttcctctcgaaaccctcacacacttgcccttgtttgatgagaggaataaataggcgctttgtcatggtgaaggtctctggcgaagcttccccagggggtttctgctaaagctttggctcactttcttgaaacactgtcatcataagcagatattaccatcctttggccctccatgtgaacccaacaagcaaaacgccttgagcatcccaaaaatgctgccatggcctgtgctttggccagtcagcctgtgctttgactgggccccttctgcctcttggtagccttttttttttttttttttggattatgcattttcttcaggattgtctttgtaaaagctatttttatctcctgtttgatgtttgttcttgcttcaattttagcagaagtcatgtagctctgataggagcgcttttcaaacagatgtcttaatcttcttagtgcctcaaactagatcctattcagacatgtttcagcaagttagtacaagtttattttggtgccaaaaaattttgaaatccatgaggttttttcataataagcattttccatgaactttttcaagactcttgttaagaattagggtttcctattgcatcatggatgtcacacatgcaaagccacgtgacctgaacatgcctggcctctcagtggcaggggagcacatgcaggcatgagcgccagaggtggtgtgatacaggagcaacccccacctgcacgacctcatgggaccctgcattagtctcagaagtggctcccacccatccactctcaggctgccaaggttcctggctccgtcagtgccagagtgagaaaagacacacttgtcaggaagtctcatgatttcaggtttctgtcaatcttctgcccacctgccctgtcagacaagtgcatacccgtgggtcagttctgctttctcagcactgctcctattctggtggccgtggaagagtgtgaggccactgccacggcagatgcacgctcaagtctgcgtatattcctcggcaggcagaattcccccaccacgcacttctgtggccatgtctgagcacagtgtgccgcccgtggctgctccctccctgggggtgaaagcgggcttcacaccaccttcctgtgtcttccgtttcaggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggtactgaggcgccctcaccgcaatgcgccggctccacctccccaatagcttgtctgtcctcacacctactgttccttaagttgtttcatcatgtcatcatgcacagcttccgaaaacgatcacttggaatgattcttccttcagattgttttagcttagaagtgtggctacgtccctgaaaccttaatgccatctcaaaggcagctcttttcctccctgctgcagggtaacacccactgccaggccactgtgtgtggtggaaacgtctcttactctcagatattgaaagtcattatgcaaaacgcagggccagtcaccctgctgtcccctccttctcagcaacataaaaattgcttggattgtgataaccctccagtggagtttttaaaccttttgaattagctgtggggcccttttttccccagaataaaactttatatagtaagtcagggtattactagtttgtgtgtattcttcagtcaagtagatggcatctgtttattctgagaccagcattgtgcactggcatgggaggtatagccagaagggacagtgcccgggagggtcctgttcaccaggggcagcacccaggccagctgccacaagtccaaggtccacacagaaggagttactggccgcatgagggaaggcctccgaggtcatcagggtgatgacacacataacatccgtggtgcttcttagagttaaaaatgaaacgtgaatccactattggtggtttcccagaagcatgtcttcagaactcgggggtctgtagctgcctgtttgaccagcaagactggaacttggcaataactcagcccttaggagacgccgcaccttgttctgtgtgaagccgttcccttggcagaaggcgccttcctctgggttgctttccccccagaagccaatgcagttctgaaggccatgttttggtatcttattaggtgttgttttcatctgttacagcgtcaacagttgcatttgtttttttatcccttcacaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtgggtctcctggggccatggggagagattggtgcagaccttaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttttgttcaggcagatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccctgtaccaccccaaataagtgagtgcctcaccttgtggggcctgagcagctaccttgagaccatgtgaggtggcacctttccggggtggactcgtgcggccttgaggacaggcacagggcaccctatcccaagccgtccaggcaggaggaaggcagccaaggcaactgggttctgggagccctgggtggggcagctgtggggaggaactgggttcggggagccctgggcggggcggctgttggggggaactgggttcggggtgccctgggcagggggctactggggggcggctgtgaggaggagttgggttcagggagccctgggcggggtggctgtcagggggaactgggttccgggagccctgggccggggcagggggcggctgtaggaaggaactggtttcggggagccctgggcggggcggctgtggggaggaaggtgacgtgcaggggaccagaggctctgcactgctcctaggacagctcatctgtaatcagaaaaaaaataaacaaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttggagaattttttgtaattaaaagcaattattttaaaatgtgcaagccagtatctcacaaggcatggatttctgtggaatttatttttattcaaataaccatatttatctccaggctgtggaatcgccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcactactc

SEQ ID NO: 428 - DNA, 151986 bp, Homo sapiens; identical to SEQ ID NO: 427
  source 1..151986: mol_type = genomic DNA

SEQ ID NO: 429 - DNA, 151986 bp, Homo sapiens; identical to SEQ ID NO: 427
  source 1..151986: mol_type = genomic DNA

SEQ ID NO: 430 - DNA, 151986 bp, Homo sapiens; identical to SEQ ID NO: 427
  source 1..151986: mol_type = genomic DNA

SEQ ID NO: 431 - DNA, 151986 bp, Homo sapiens; identical to SEQ ID NO: 427
  source 1..151986: mol_type = genomic DNA

SEQ ID NO: 432 - DNA, 151986 bp, Homo sapiens; identical to SEQ ID NO: 427
  source 1..151986: mol_type = genomic DNA

SEQ ID NO: 433 - DNA, 151986 bp, Homo sapiens; identical to SEQ ID NO: 427
  source 1..151986: mol_type = genomic DNA

SEQ ID NO: 434 - DNA, 151986 bp, Homo sapiens; identical to SEQ ID NO: 427
  source 1..151986: mol_type = genomic DNA

SEQ ID NO: 435 - DNA, 5662 bp, Homo sapiens
  source 1..5662: mol_type = genomic DNA
ggagaaggggtggggcagggtatcgctgactcagcagcttccaggttgctctgatgatatattaaggctcctgaatcctaagagaatgttggtgaagatcttaacaccacgccttgagcaagtcgcaagagcgggaggacacagaccaggaaccgagaagggacaagcacatggaagccagcccagcatccgggcccaggtatgggaagcccctccgagcacctctgcgcctcagcctcctctttgagcttttctgatgagcactcacctctcaccctcaaacccctggggcctctcttttcctcctgaccctctctctggacctggcctcttgctctaggttcccagttttggtcccagcgctggtctctcctccgatggtaccaattccaggtctccttccacctcccggggcaggtgcacagggagcctgaaaatcccaatagataatggtgctgtgccccagccagtgaagacggtcagagaggggattctcctcacttgtctttaaatgagcatctactatttcttgcaaatgttccatgtatctggacttggcctaagccctttttatgttcagtgtcatctcgttctccctaatattaagaaaagggggttgcttgtaggactgcttggctatgaggaagccttgtttcctttttttgagaacacagagcaagtgagtggtagagcccagattcatgcccaggtctactcgaaatggtggggaacattttgaaccttccttccttctttccttccttccttcctccttccttccttccttccttcaattctctctctctttctttcttctttctttctctctctctctttccttctttatttctttttcttctttctctctcttccctccctccttccttcccttctgtgcttccttcctttcttccaatatttccctttctctcttcctcccttccttcctttctctttctttctttccttctttctttctttttctttcattctttccttctttctttcttttacttccttcctccctccttccttcctctctttcttctttcctttccttcctttcttccttccttcctctctttctccctttctccctcccttcctttcttttttctttcttttctttctttcttctttccttctttctttcttttccttcctttcttttttctttctttctttccttctttttcttttccttccttcctccctccctcccttccttccttcctccatctctctttctctttctttctttctttctttctttctttccttccttctttctctttccttctttctttctttctttccttccttctttctctttccttctttctttctttcttttgtgctgcctcccaacagagatttttctaattctgattatgtcaggatgcatagagaggggctgggagaggtcttcaaggtggggctggtgtttccagcccaggagtcctgagctgccccatctcaattgcctgagaagcacatttgggagacctcagggcaccctaagggatgtggaaaatcctatgaattacccgaaaagaagtccctggcaggttcctctccccagtcatccccctcaggagtgtccctgtcccgatgctcggtgtggtaggagttaaccctgcaggcaggaggaagccccagagggtccatctccagcaggggctgtgggtgagcagagccaggacaggggtgcatggtgaggccacagaataagacccagctctaccccagggagaggagcagggtcctcctcggagggcctgagcacactgagctgaccctggggagaccctgacaaggcttagacaggccccagggctgcagtgatctcccagtgagccatagaaggggtcagagggggaggtttggaagtgtgctaagggatgtgcggagcagggggaaggagggtggggtgcaagggaggaagtgtggggagggaggaggaggcagggcagtccaggagggctcttcctcctctggtcttttccctggctgtccacagacacttgatggatccacacatattcacttccaactttaacaatggcattggaaggcataagacctacctgtgctacgaagtggagcgcctggacaatggcacctcggtcaagatggaccagcacaggggctttctacacaaccaggtgaccgacccagccatccgaatccgggcagggcccttccaatccagggacattcataggtagaaggttccggattgtacttgtggtttcctgcagtgtttgtcacttgtgcttcctgcagctgctgctgcttggccctggggttggggggagacttcggcttcagtgactatccatgcccaggtggggttgagtctgcccaatggcaaagtgcttcctgaggaccctcccaggatcccctcacagacacagctctcaccaggaacaattcagcaatgtgggatctgaggactcagggcctacctgacctcacaaggccaggatgccccagtgccctctcctgggcttcatcctgcacggagagagactgaggcaggagaggctgaccagggatcctgtcctgcccagggtggagcccacagcaaggccagaacaggtcccatgtcaggatgcagggatgtccagcatttggggaggagctgggccaggccaggctgaggggccctgagcccgggggactttcttccctggcccctacccagcacagcctctgtctggagagaccaggtaatgcttggctccggtgctggaaactgggaccttctctgggctctatgagctcaatgtgggcctcgctggatccacacacactgcttggaacatcctttcaagggtgccagtctccatcaccgcctaagcagtgggactcccccaggaacgacccacagccccttctcagcacaaaccatgtcatccactccaccctgcatcactgctgatggagtccctccctgtctttgtccccatcacaatcacagtccttgctgccctgctgtccccaacttgaccgattcctagtcttagtggaaaatccttttctctggagtttggagtaaataccatatttctataagtcaaaataatgacaattataccatgtcacagggaccttcccacgttggagtgagtcctgctggtcttctcttccccactacttttggtggaattcattttggcctaagtctatatcacatttgggctcagcacaggttgtggcacagaatagaagcttctagaattatgggccacagatgggatgggagtaggggagttgatgagtagagcaggtcaatctccccttgaaggaagcacactcactcagggccatcaggccaatgacctcggggctccgccggcccctcctccctgcccccatctctgtagcccctccctgcagggctgggtctggggtgagggtcctgaaggctctgaccttgggtacaaaattgatgggggctccaaatgctcagtaattagagaaaacacattttaatttaataattaatgcaatattttaaaacgcaaatttaatacaaatagatcatgatgaataaaagcaaagattttaataaagcctggcaggagagtgctgtcctgtgtatagtggagctggggcaaaataaaacctcattgctcctgatctgtttgtatttaaatgggcaacattttgcttatcttgggatttttgcataacatctgatatttttaatattgcatagaaaatcatgcatcctaataaccggggttttggtgacccctctaatttcgtgctggaggcccccgcctccccagccccacctggtccaggcgctccctccctgttcaccacacatcacctcacactctgtttccttttctaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcactgcaaatgctgcgggatgctggggcccaagtctccatcatgacctacgatggtaagaatggaaggttcaggtggggtggggtgggtgggggcaggagaggttcctgggaagaaaaggagaaaggccttggtctgctgcctgcagaaacgatggctggactctgggacctgactttggggtcgatgggaagagagaggccaggccaggagatgtgggcccagggagggcagggagagtggctggaagtggaagcagaacttggggctttctgaaagaatgagaactgggctggcccagattccaatgggaaggaactgcctgatgaaggagctaagtccctaggggagggagagggaaaggagggactgaaaccaggatgtgggaagtctgtcctgagagtcatgggccctaggtgccaccccgatcccacagcgggagcgtgacttatctcccctgtcccttttcagaatttaagcactgctgggacacctttgtggaccaccagggatgtcccttccagccctgggatggactagatgagcacagccaagccctgagtgggaggctgcgggccattctccaggtgagggcttcctccctctgcccggtgccccatcggcctccccctcctccccactcccctgggccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggtggctcacgcctgtaatcccagcactttggaggccaaggcgggtggatcacgaggtcaggagatcgagaccatcctggctaacacggtgaaaccctgtctctactaaaaatacaaaaaattagccaggcgtggtggcgggcgcctgtagtcccagctactctggaggctgaggcaggagagtagcgtgaacccgggaggcagagcttgcggtgagccgagattgcgctactgcactccagcctgggcgacagtaccagactccatctcaaaaaaaaaaaaaccagactgaattaattttaactgaaaatttctcttatgttccaagtacacaatagtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacact

SEQ ID NO: 436 - DNA, 5662 bp, Homo sapiens; identical to SEQ ID NO: 435
  source 1..5662: mol_type = genomic DNA

SEQ ID NO: 437 - DNA, 35257 bp, Homo sapiens
  source 1..35257: mol_type = genomic DNA
ggagaaggggtggggcagggtatcgctgactcagcagcttccaggttgctctgatgatatattaaggctcctgaatcctaagagaatgttggtgaagatcttaacaccacgccttgagcaagtcgcaagagcgggaggacacagaccaggaaccgagaagggacaagcacatggaagccagcccagcatccgggcccaggtatgggaagcccctccgagcacctctgcgcctcagcctcctctttgagcttttctgatgagcactcacctctcaccctcaaacccctggggcctctcttttcctcctgaccctctctctggacctggcctcttgctctaggttcccagttttggtcccagcgctggtctctcctccgatggtaccaattccaggtctccttccacctcccggggcaggtgcacagggagcctgaaaatcccaatagataatggtgctgtgccccagccagtgaagacggtcagagaggggattctcctcacttgtctttaaatgagcatctactatttcttgcaaatgttccatgtatctggacttggcctaagccctttttatgttcagtgtcatctcgttctccctaatattaagaaaagggggttgcttgtaggactgcttggctatgaggaagccttgtttcctttttttgagaacacagagcaagtgagtggtagagcccagattcatgcccaggtctactcgaaatggtggggaacattttgaaccttccttccttctttccttccttccttcctccttccttccttccttccttcaattctctctctctttctttcttctttctttctctctctctctttccttctttatttctttttcttctttctctctcttccctccctccttccttcccttctgtgcttccttcctttcttccaatatttccctttctctcttcctcccttccttcctttctctttctttctttccttctttctttctttttctttcattctttccttctttctttcttttacttccttcctccctccttccttcctctctttcttctttcctttccttcctttcttccttccttcctctctttctccctttctccctcccttcctttcttttttctttcttttctttctttcttctttccttctttctttcttttccttcctttcttttttctttctttctttccttctttttcttttccttccttcctccctccctcccttccttccttcctccatctctctttctctttctttctttctttctttctttctttccttccttctttctctttccttctttctttctttctttccttccttctttctctttccttctttctttctttcttttgtgctgcctcccaacagagatttttctaattctgattatgtcaggatgcatagagaggggctgggagaggtcttcaaggtggggctggtgtttccagcccaggagtcctgagctgccccatctcaattgcctgagaagcacatttgggagacctcagggcaccctaagggatgtggaaaatcctatgaattacccgaaaagaagtccctggcaggttcctctccccagtcatccccctcaggagtgtccctgtcccgatgctcggtgtggtaggagttaaccctgcaggcaggaggaagccccagagggtccatctccagcaggggctgtgggtgagcagagccaggacaggggtgcatggtgaggccacagaataagacccagctctaccccagggagaggagcagggtcctcctcggagggcctgagcacactgagctgaccctggggagaccctgacaaggcttagacaggccccagggctgcagtgatctcccagtgagccatagaaggggtcagagggggaggtttggaagtgtgctaagggatgtgcggagcagggggaaggagggtggggtgcaagggaggaagtgtggggagggaggaggaggcagggcagtccaggagggctcttcctcctctggtcttttccctggctgtccacagacacttgatggatccacacatattcacttccaactttaacaatggcattggaaggcataagacctacctgtgctacgaagtggagcgcctggacaatggcacctcggtcaagatggaccagcacaggggctttctacacaaccaggtgaccgacccagccatccgaatccgggcagggcccttccaatccagggacattcataggtagaaggttccggattgtacttgtggtttcctgcagtgtttgtcacttgtgcttcctgcagctgctgctgcttggccctggggttggggggagacttcggcttcagtgactatccatgcccaggtggggttgagtctgcccaatggcaaagtgcttcctgaggaccctcccaggatcccctcacagacacagctctcaccaggaacaattcagcaatgtgggatctgaggactcagggcctacctgacctcacaaggccaggatgccccagtgccctctcctgggcttcatcctgcacggagagagactgaggcaggagaggctgaccagggatcctgtcctgcccagggtggagcccacagcaaggccagaacaggtcccatgtcaggatgcagggatgtccagcatttggggaggagctgggccaggccaggctgaggggccctgagcccgggggactttcttccctggcccctacccagcacagcctctgtctggagagaccaggtaatgcttggctccggtgctggaaactgggaccttctctgggctctatgagctcaatgtgggcctcgctggatccacacacactgcttggaacatcctttcaagggtgccagtctccatcaccgcctaagcagtgggactcccccaggaacgacccacagccccttctcagcacaaaccatgtcatccactccaccctgcatcactgctgatggagtccctccctgtctttgtccccatcacaatcacagtccttgctgccctgctgtccccaacttgaccgattcctagtcttagtggaaaatccttttctctggagtttggagtaaataccatatttctataagtcaaaataatgacaattataccatgtcacagggaccttcccacgttggagtgagtcctgctggtcttctcttccccactacttttggtggaattcattttggcctaagtctatatcacatttgggctcagcacaggttgtggcacagaatagaagcttctagaattatgggccacagatgggatgggagtaggggagttgatgagtagagcaggtcaatctccccttgaaggaagcacactcactcagggccatcaggccaatgacctcggggctccgccggcccctcctccctgcccccatctctgtagcccctccctgcagggctgggtctggggtgagggtcctgaaggctctgaccttgggtacaaaattgatgggggctccaaatgctcagtaattagagaaaacacattttaatttaataattaatgcaatattttaaaacgcaaatttaatacaaatagatcatgatgaataaaagcaaagattttaataaagcctggcaggagagtgctgtcctgtgtatagtggagctggggcaaaataaaacctcattgctcctgatctgtttgtatttaaatgggcaacattttgcttatcttgggatttttgcataacatctgatatttttaatattgcatagaaaatcatgcatcctaataaccggggttttggtgacccctctaatttcgtgctggaggcccccgcctccccagccccacctggtccaggcgctccctccctgttcaccacacatcacctcacactctgtttccttttctaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcactgcaaatgctgcgggatgctggggcccaagtctccatcatgacctacgatggtaagaatggaaggttcaggtggggtggggtgggtgggggcaggagaggttcctgggaagaaaaggagaaaggccttggtctgctgcctgcagaaacgatggctggactctgggacctgactttggggtcgatgggaagagagaggccaggccaggagatgtgggcccagggagggcagggagagtggctggaagtggaagcagaacttggggctttctgaaagaatgagaactgggctggcccagattccaatgggaaggaactgcctgatgaaggagctaagtccctaggggagggagagggaaaggagggactgaaaccaggatgtgggaagtctgtcctgagagtcatgggccctaggtgccaccccgatcccacagcgggagcgtgacttatctcccctgtcccttttcagaatttaagcactgctgggacacctttgtggaccaccagggatgtcccttccagccctgggatggactagatgagcacagccaagccctgagtgggaggctgcgggccattctccaggtgagggcttcctccctctgcccggtgccccatcggcctccccctcctccccactcccctgggccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggtggctcacgcctgtaatcccagcactttggaggccaaggcgggtggatcacgaggtcaggagatcgagaccatcctggctaacacggtgaaaccctgtctctactaaaaatacaaaaaattagccaggcgtggtggcgggcgcctgtagtcccagctactctggaggctgaggcaggagagtagcgtgaacccgggaggcagagcttgcggtgagccgagattgcgctactgcactccagcctgggcgacagtaccagactccatctcaaaaaaaaaaaaaccagactgaattaattttaactgaaaatttctcttatgttccaagtacacaatagtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacactagcaaatgtgtagatgtctttccttgtgtagcggacctgtagcggggaaaggtcacacaacatccctctggatccagaaaactcagctaaacctcacaggagaggaacctaaatgcagaccccaccctcactcacagagccccgcccaccctcacttacagagccccgggcgctgattggaagggacaggcccagcagtaagaggacagccagcagccagtctccctgttggaaaggaaccacaaacgtgcagtcaggggccctcgggagccgccctctgtccaccccttcctgattccacccccctagagagggagcccaggggaggccatggctgagacccaggacaggcccagtcgggggaaggagcccagggagggggcaggtgtctaggctgggcccaaagagagggctggggagaggagcagcccaggaggcagagcccagccacagaggggaggggagctgagtcccggggacaggaggctccagaggcagagacggagcccagggctagggcggcaggtgtcagggctgtggcttcagcttggcgtctgtcctgggccttctgcgctggttcccaactctgggatgtgtgacttatatgcctgattacagcggcggctcccacctcacgatttctggaaagtcctcagaagccgcatataagaccaagaacgggcctcacatgcagctgctcctgggcagaaacgactcactgtttccctggcctagacacacacaacacacaaacacacacaagacacacatacacacaacacacacaacacatacacacacaacacatgcacaaaacacatacacacacacacccacacacagtgacagagacttcacacaaagaaacctcctccaggtgccccagagcactccggggcgcaccccagccccgccctgagcagaggactttggcatttcccacgcaggggcgggtgcgggagggaccggcttgtcaaagctgccctttgcttgtgtctctgggtttgataacagtcctaactccacttgttggaagcaagtgatgaaaaacgtgcagtcattctgggcaaagggaccagtgtaggggaggcatgagaggctcacctggtgaaagaacaccagagttagtcatgtcacagggcagctcccagagagacctgcccctcgtcccccagaaccccaccttccaagggcccaggctcctgtcccccgggcctcaactcacagctttgcccatgacctgggagccctgggggtcctggtgaggtgactggacacagcctcatgacactgctgggacctgggctgggaactgagagcctgtggtccctctgggctgtaggggtcggggccccacagtggcggcagagccgggacctcgtacacagcagcatggactccagacccaagtggaacctccattctggtctcagggtgacccgggctgcacagcccagcacctgcccagggtccctctgccctgctctgtccctcaatagtctggacccctgctgggtacttgccttgtcccccccttacaggggaccagggtgaatcttgggcgaagcctgcacctgtgaaggaggccattctccttgctcccatccctgccgcccacatggggaaccagctccttcttgttcctggggacctttcctgggctctggtggaaactccagcggaatgtggggtctttcattttccctcagtgttgcagaggccgaaatggagaggggctgtcactccccaggaaagggcacaatctccttccttccctccagctggcccagggacggtgcacactcttatcctagtcaccctgaggactgcagccctggtatgagcccagagtcacccccaggttttatggatgccttacacactctgccctggcctgacctcaagaggaccaggaagtgcccagttgtcactgggttttgctgccctgagagagtcaggctccagtgcacagaggaacgtgtgtgtgcagggtggtggcactgtcagggggcacagcaatcccaggggagcgtgccctgctgttccaggttgtggcacttatggaagatcctgggtccagaggctggagtaaaatcgttcccactcacatctaacctaccctgggctggctcgtgggagtcaaaggcccagacagtggctggccctgtccatccttggccagggagggtcctggcctccctctgcgctggggggggagccccactcaccctctcttctttcctctctggaggcgctgccctgctctccggcttgtacaatttgctactgagaatttaactccagacagtatttttgccccaatttgctgtaaacatttgagcctgaggccatgtttgtcatcagatgaagtggtttacagatgtgaaattgttgtttgtagtctaacatttctggtttgtaaacccatccgtgatgggctcccagcccaacccgctgcagatgaggccgctgagtttctgttgagaatgaagaccgggttcccaattagggcaactcgtccctcacactgctccttacacccccatcttccagatcccagccaagccccctccacccaatacaccccagcgtccttgcatccaattaacatctcagagtggccacctttgcagagacctggctggggagggaggtcacagtaaagacacagcctggctcctgtgggccccctggggacagcagccctgcacacacactctgggcctttctctccccctttcagccttgtccttggatatcccccaggtcactcttgctcaggaccaagcagattgactggggacagcaaatgtaaccataaaaggggattctacaaggactcccctcagggagcaggtgccagcggtggggactggggagtagataagaggtggctgggagctaggataagagcgacagcccagagttcctggatcctggctgaggctgggtcccgggccccaggacagtcctgcagaccccagaatcagagactgaggagtcaaagacaggcaggagacgcccctggggatgcccagcaaagcactgtcccctgcgtgcagctttcccgggtctccccacagaaagctcagtgagggctgtcgtggccactggcgacccaggcacatttgctccggtaagaggccattgctctgggaagcagcagccacacaggaagagttgggggagggcaagggctctgccctccgagggtcctgcagggcacagggtctgcatagcaggaaccccagactctttgtgccccacccccactctaactcagagctctgtgctaaggagagccttatcatgccctcggtggattcagaagcactttgtagggctgagtgacgaaacatttggggctgggagtagagctggctgggtcaggacgacaccccctcctggaagggcaggcctgtggggggcacaagcagggacaacagcccattcgtgtctgctggtacaggtgcagtctctgtgcaggtgggcagtgggtactgcagggcaccatgctgtgtgtgcctcgagtgtgaactgggaaaggtggtctctggtcagactcacacaacacaccaagatgagctcacaccggaaccacccgagactcaattgggagttgacagcccccaggggatatcctcttgactagagaagtccaaggtctggagacagaatgggaggtggcatcctcatggcagagaacagggcctcctctggtctgcccatgaggagtggtgcccaccaagatggcagggacactgtgctgaggagggtggatcactcccaccttcttctgaggtttccacctcagcgagcaccggccaggctgggagggcgaggagctgtgcttggtccgggtggccagggtgggactgtccccaggatgtggactctcttgcatgagacagctggccaaggatggggggtctaagaggagccaagacaggggaatcagcaggacagggggcagcccccaggcccacagggccagtgcattcttcgggcagctgtgctgggtgcagtaggtggacctgggaaaggatggcgccagacctgccgttgggactcaggggctcacttggggcaggagcacagcttcccacacatttctgcagggctggaggtgggagaaagggcacagggtgagccttctgagggcatttgtgtccctgcatcactctgctcactgggagggcctgggcaagtctaggtacctttcagagcctctcgtatctcctctagaggagtaatggggatgaaagcaccccttgctctagtttgccgtaattagatggactgacacaaacaagggctcagcatgtctgtctccttcccttcccagggcctgggatcaagacccaggacacactctgctctctgcactgcacgccctgcagggccctggatgcagcaggcatgccctgtgctggctatagtaggggacgtagggtcggctgctctggagcctactctctgggggcgctgagtcttattcgagacctttctccagggtgtggatacctgtcctcctgcctgtcccctggcctcctgccttcctggtccctgctgcccaaagtgactgaagtgtggccaaggctcgctttcctcattgtcactccacagcatccctgtagggctattgtcagagcagggaaatcaaaaccaatgcttgtgggaagacacagcagagaacttccttattctgtgacactgatgtgggtggcacaggggacctgagttcaggaaggggtggggcaggtcattgctgacccagcagcttgcggtcactctgaagtgatgtaagcctcctgtgtcctaagagcaaccagaggaggaccacaggagcacatgctgtgaccgtcacagaagcaggaggaccctgacctaggaaccgtgaagggactaggacatgatggctaatggctaacacggtgctgacagccagtcctgcagcctctcgaagcctctgctcctgagcctcctcctcgggttccttggtgatggtcacttgcctcctgccctccaggggctccttctggttcccttggggactgtcctctccccttaaccctctctggacctggcttctgctctaggctcccagccctgttcccagccccagtctctagtctgatgctatctattgagtctcctcctgctcctggggcaggtgtgcaggggggcagcaaatcccaggtgatggcactgtgcccagggggcgaagacggttggagagaagattctcctcacccacctttagagtggcacccaccatttctggcaaatgcaccatgtctcccctctgggctaagctcttttcgcgcccaatccaaccctatcttacccaatattgggaatagggagttgctcccgacaccaccgtgctacgaggaaaagccattctttccttttcctgtgaacacacagagggtaagtggtagagcccagattcacaccggtgtctatgcaaaaccataggcagcactgagatttccctaaggccaggctcattagggttatgtagggtgcacagagcggggctgggagaggcctgcaaggcccagtaggtgcttcctgcccaagagtcctgaggtggcccacctggctagagaagcatggtcgttgcttgtttggcagaacacaggactgttgtggtatccttcattgccgtgttcatgtatataatttaaattaaaatgtaaaattaaagaaaagaaagaaagacgttagagcagccccggtcagccccggtcctgggaggtatcacccaggttgtgggctttgcactcctctcccatatgatcacagctcccctcggccccggtggcccccctgccacgccgccttgaatttgacaatgccacattagaagtcttggtcttaatcctgaatgtttcttttgcccaccttccctttcattcgcccagctgtttcaaccccaaaacgctgcttcctccccttcctctcacttccatatctaattagtaactcactctggctgaattcatccccacaattcacccccaatgtaccctgactgccatcactgtcacctgtcgcctgggatgtctgacagtctccggttcaccagctcagctcccattccctttgcatgcagctactggagtgactttgtttttttctttttttagagataagctctgtctctgtcacccaggctggagtgctgcagcgtgatcatatctcactgcagcctcgaactcctgagctcaggcaatcctccaatctcagcctcctgagtagctgggacaacaggaccatgccaccatgcctggggaattttttgtagagacagggtcttgctatgttgcccaggctggtcttcaaactcctggtctcaagcaatcctccatccttgacctcccatagtgccaggattactggcatcagccacctggcccagctctggagtgactcttcaaaagaaaaaccaggtcatgtcactgtttggtgacatgaaacaacccctaccccaaccacacatggatatgcacatgtacacatgcatgtaggctcacacacccatgtatgcatgtgcacgtgcatgtgggcacatgcgggagggtacacccagttgttgtcttttaaaatgaaatcgaggccgagtgcggtggctcacacctgtaatcccagcattttgggaggccgaggcgagtggatcgcttgaggtcgggagttggagaccagcctggccaacatggtgaaactgtgtctctattaaaaatacaaaacttagctgggcatggtagcaggcgcctgtaatcccagctactcaggaggctaaggcaggagactcgcttgaagctgggaggcagaggttgcagtgagccgagatggcaccactgcaatccagcctgggggacagagcaagactctgtctcaaaaaaaaaaaaaaaaaaagaaatttacatttttcccaatgacccatgagactccctcctcccgtgccagctttgtcaccctctactttttttttttttttttttaagacggagtttctctgttgttgcccaggctggagtgcaatggcacaatcttggctaaccacaacctccacatcctgggttcaagtgattctcctgtctcagcctccgagtagctgggattataggaatgcaccaccatgaccaactaattttgtatttttagtagagacagggtttctccatgttggtcaggctggtctcgaactcccgacctcaggtgatctgtccgcctcagcctcccaaagtgctgggattacaggtgtgagccaccgcgcccagctcctctacttgttttctatgctgtctggctggtgtctgttctagtccaggtcacccagccctctctcgcctcagaccacggcacctgccattccctctctctggacaaagcttccctcggctcttcccactgctatcccttctctccctcaggattcagttcccaagtcacctcccctggcctcttaaagcgagctgcccacacagttcccttctgccccatctccatgtctatttcctgcaccgcccttgttacaaaccagatttatcttccctgtgtgtagattctcatttcttgaccatctgcctccacttcccataaacgcactgaggtcagagtccactgcttcctgcccatgcctcgacggcagtgctggcagccagccttgccccctgggtaggaatccatttacaattgttgaaagaaaaaaaatgaatgattaaaaacagtataaaggaatgagaaaacggtggatggtaatacacaaattattcattagccccaaggagtgggctaggaggtacacagagtggacagtcacatcctctgtgatacctgtttgtattgggctcttgagtaattgacagaatgataacactgccaccagagatgagctttccatgacgaccaaggtggaggagtcagattctgggtgctgcggccaaaatacacgtttcaaaataaatgggtaaagaaattcgtcactggagactgcataaaggttggggcaattgccagagccttgcatggagaatcacacctgcttcaaagatccatttctgtgctacaaaccaccccaccttaaagcttaccataaggtgtattgttcaggcttctgtggatcaggactcagatgacctgtccactggatgagccagcagctggctcactcgtgcagctacagtcggaaggcggccaggcgggctggatggtgcccagtggtctcacttacctgcctggtacttggtgtgggctatcagccaggcacccagctgggctgtcagatgctctccctgtggtcaccccatgcatccagcttgagctccctcaccgaatggcatctgggttccaaaataccaagtctggtcaagactctgcctacatcacacttgctaatgccctgttggccaaggtaagtggtcaagctcagtgttgatatgggaggacgaggctgggcatggtggctctcacctgttattccagcactttggaagaccaaggcgggtggatcgcttgaggccaggagttcaggaccagcctgggccatatggtgaaaccctgttgctaccaggtgtgcacctgtagtcccagctactccagaggctgagacaggaggagaatttgagcccagaaggtggaggttgcagtgagccatgatggtaccactgcactccagcctaggtgacagagcgagatgcttttcaaaaagaaaatatacgtgtatgtgtgtgtgtgtttgtgtgtgtctgtgtgttgtgtgggaagccagtcacaaggatgtgaatatcagggggtgtgtttcactggggatcgccaacatgacagtttatcagtcttccctgtgtgccaatgcatcttactccacccacttgaaaataacccacccattcccaacagccacaaagtatcaccccaatatggaatcatgttcagacatcacatccaagatcctgtcatctaaatcaatcccaggtatagacagggcaccttcagtttgttttgtgggggtgagttgcctcaggttcagagatctgtgctctaaaacacaagtgatctccagctgggctcggtggctcaggcctgtaatctcagcactttgggagggtgaggcaggtggattatctgaggtcaggagttcaagaccagcctggccaacatagtgaaaccctgtctctactaaaaaatacaaaaattacctgggtgtggtggcgggtgtctataatcctagctactcggaaggctgaggcaggagaatcgcttgaacccgggaggtggaggttgcagtgagccgagattgcgccattgcactccagcttgggcaacatgagagaaactccatctcaaaaaaaaaaaaaaaaaaaaagggaatcgctagatggggctgaatatccagggggccttcatcacatgcctggaggcttgggcaggctgtcagctggggtgtttcctctctccacctggtctcgcagcatttaggactacaagtctgttttccttgcatgtaggtgagcaagtcctagatatgcaaaaaatgaaacctacaaggctactcaaagcccagccaaggaaatcacatgacatcatttctactgcattttattggccaatgcaagtcacagaccagcccagatggaaggggacaaaaaaatagactgcatcccttgatgagaagagtgtcaaaatctcatggcaaagggttgtaaaaacagaccggaggaagcgtgaggcgtacactgcacccccaccacaccagcccaagcccttagagaaaaatgatgaaaaatccacctttggccagccacggtggctcatacctgtaatcccagcactttgggaggctgaggcaggcagatggcttgattccaggagtttgagaccagcctggacaacatggtgagaccacctctacaaaaaatacaaaaaaattagccaggtgtggtggcgtgagcctgtagtctcagttatgtgggaagctgaggagagaagatgccttgagctccggaggttgaggctgcagtgagcggtgatcgtgccactgcactccagcttgggcaacagagtgagattttgtctcaaaaaaaaaaaaagtcgacatttgttagagtcacccaagcaagggaagatcagacgaataaggtctcaagtgaacattttctacgtgagcatatccaacccggggcctctgcagggcctgttttctctaggagcaaggactattagcaggcaggggatgggcctggggggcctgggaaagggagaacaggtggaggctccatacagggggacgctggggccaagctcaaggtagggcacacccctccatatcgaagtaggtcatcaagagtcatgcagacgggacaaggcaaggagttccggtgcaagctcgctaggaccctcagtaacaccagaatagaacctggacccaggatccagggcagagagaacctttttaccaaagcctgctgtcaccacccaggctgctttgccttgacagtcccactcctcaactgtaggaaggtgagaaaaattcaacttctcaagtgtgctgttcaggtcacaccctctagagggcgagcatgcagcagaggcatgcggcataaacctttgtccctttcctcggcagggtcccgtgaaagtcaggttgcaggacccccaggccacactggaggagaccctgaagctccactttgtcacccaggagtccgtgccttgcagagcctgggccaggtgctgagaaacacagggatggggctgggctgcacctgcccttgcttgttttttttgttttttgttttttggtttttggtttggtttggtttttttgagacagagtcttgctctgccactcagactagagtgcagtggcaccaactcagctcactgcaacctctacctcccgggttcaaatgattctcttgtctcatcctcctgagtagctgggattacaggtgcacgccaccacacccagctaattttttatatttttggtagagatggggtttcaccttgttggccaggctggtctcaaacttctgaccttaagtgatctgcccaccttggcctcccaaagtgctgggattacaagtgtgagccgccgcgcccggcctgcccttgctttttgggttttgtctttgccacccagagtggcgtcacctggataacatgccctaagactgcagggatgtaggtgagtctgtcccagtccaggaaaccaaggctagtatcagattggctttcatggcttctgggcagagcccagatctgcacctcacgtgtcccggagtcagggaagggtgatactggcttccccagttctgccctctggacgggcgctccgttgacagagaccctgaagagcatcatgccaggtgtggcctcaaatagtaaagataagagaaacagaactcgaggaggagaaatatagaggccaggccaaggccgtgcacagccccctacagcatctggcactgtggtcgcttctttactctgcctccctcctctggagctcccgtgaatgtgagcgtcctcctcctggctggacggcatctcctctctctgggccttctgccctggccccatcctccctcggactgggtgccgagtctcaatgttggtcacttatgaccccaaatcgccttctccagctggacacccccagtctcctgggctggactctgcagtcacctttagtgctcccagctcccctgttcctaagccctgctgtttctacctttgggaggacacgcaggctgtcagcccatgtttgccgagtgctacggtgcttgagtgtgcatagccctaaacagggagctggcactgggtgttatgactccccttgctgtaaactttaaggactcaaacagaagcagaaaaaagtgaaaataagcaacatctactgagtactgaccacccaccaggctccgttccttatgcctgaaggggagcggctcatttaaaccttacacctgaatgggagcgctcattgaacccttgcgcccaaccccacagtgaggagccatcattttcaccttccctgttcagatgaggaaatggactattgcagttagaggttgcaaagccaagctggggttgacccagccaggtaggtctctacccaggtgctcaaacgcagctggggcaattgaaacaagtcttgaaatcagttacagagattctttcttttttgtattttaccatttacctaactttacatgcaacttccttagttcagatacaatgtttcattaaaaaaaaaaaaatctgggctggacatggtggctcacgcctgtaatcccagctctttgggaggctaaggcaggcagatcacttgagatcaggaattcgagaccagcctggccaacatggtgaaaccctgtctctactaaaaaaaatacaaaaattagtcaagcatggtggcacatgcctataatcccagctactctagaggctgaggcagcagaatggcttcaacccaggaggcagagtttgcagtgagccgagatcacaccactgcactccagcctgggagacagagtgagactctgtctaaaaaaaaaaaaaaaaaagtctgctcttctttagagcaagggtccccaacccccgggcctcggatgggtacaggtacatggcctgttaggatcccagctgcacagcaggagatgagccgtgggtgagtgagcattaccgcccgagctctgcctcctcttacatcagtggcagtgttagattctcacaagggcgagaaccctattgtgaactgctgtgaactgcacatgcgagggatctaggttgggtgctccttataagaatctaatgctggccaggcacggtggctcacacctgtaattccagcactttgggaagctgaggcaggagaatcacttgaacacgggaggttgcagtgagctgaccctgccattgcactccaacccccggcgacagtgtgagactctgtctcaaaaaaaaaaaaaaaaaaaaaatctaatgcctgatgatctgaggtggaacagtttcatcccaaaagcatccccctcaccctgtcagtggaaaaattgtcttccacaaaacgatcactggtgccaaggagtttgaggactgctgctctagaggaaatcatacagtgtcctactgggaaactacctttaagaaaggaagttaacgtgttctttaattcacagatggaattttcaaatatttgcaacccaaattattcctattttaaattataaatgcaccagtaaaatgctttttttaaaaaaaaggtttttggctgggcgtggtggctcaagcctgtaatcccagcactttgggagcctgaggcgggcagatcacgaggtcaggggatcgagaccatcctggctaacacggtgaaaccccatctctactaaaaatacaaaaaatcagctgggcatggtggtgggtgcctgtagtcccagctactcaggaggctgaggcaggggaatggggtgaacccgggaggcggagcttgcagtgagccgagattgcgccactgcactccagcctgggagacagagcaaaactctacttcaaaaaaaaaaaaaagtttaggctgggtgcggtgactggtgcctataatcgcagcactttgggatgacaaggcaggcagatcacttgaggccaggagttcaagaccagcctggtcaacatggtgaaacccagtctctactaaaactacaaaaattagatgggcttggtggcatatgccagtactcccagctactcgggaggctgaggcaggagaatcgcttgaacccaagaggtggagttgcagtgagccaggatctcaccattgcactccagcctggctgacagagcgagactctgtatcaaaaaaaaaaaaaaaaaattacacacttaataacagaccatcaaaatatatgaagcaaaaattaacagaattgaaggagaattagagttctacaataattggagacttcaatacccaatgctcaataatggacagaacaaccagatagaaaaaaaaggaaggaaatagagaactcaacacaataagccaactagatctaacagacatatatggaacacttcacccaataacagcagacagccgctgtggaaaacagcatggcagttcctcaaaaaattaagaatagaatggccagatgatccagcaattccactgccaggtgtacactcaaaaaaattgaaagcagagtctcaaggaggtatttgtacacccatggaggtaacccaaattttcatcaacacatgaatggagaggccaaatgtggtctacacatgcaatggaatattactcagccttgaaaaggaaggaaattctgactcacgctacaacatggatgaaccttgaggatattatgctgagtaaaataagccaatcacataaagagaaatactgaatgattccatttatatgacgcacttagaatattcccaatggccagtctggcgcagtggctcaagcctgtaatcccagcacttcgggaggcccaggtgagcggatcacctgaggtcaggagttttttgtttttgtttttgtttttgttttgagacaggctgtgtcatccaggcaggagtgcagtggcatgatcttggttcactgcagccttcacctcctgggctgaagcaattctcctgcctcagtagcccgagttgctggtattacgggggggcccaccaccatgctcggctaattttgttttgtttttttttttttttgagacagagtcttgctctgttgcccaggctggagtgcagtggcgtgatctcggctcattgcaacctccacctcctgggttccagtgattcttctgcttcagcctcctgagtagctaagactacaagcacacgccaccacccccggctactttttttggtgtttttagtagagacggggtttcagcatgttggccaggatggtctcaatctcctgaccctgtgattcgcccaccttggcctcccaaagtgctggcattacaggtgtgagccaccattcctggccaatttttgtatttttaatagagacaaggtttcaccatgttggccaggctggtctcgaactcctgacctcgtgatccttccgcctcggcttcccaaagtgctgagattacatgcgtgagccacctcacctggcaggttcaggacttcaagatcggcctggccaacatgccgaaaccacgtctctattgaaaatacaaaaattagctgggcatggtaggatatacctgtaattccagctacttgggaggctaaggcacgaagaatcgcttgaacctgggaggcagaggttgcagtgagccaaaatcgtgccactgcactccagcctgggtgacagagcaaggctccatctcaaaacaaacaaacaaacaaacaaacaaacaaacagagaatattcaaaatgttaaagacagaaagtagcatggtggttgccaggggctggcagaggagagaatggggaggagggaatgaagattttgcattaaacgggtacagagtttcagtcttacaagatgaaaagagccggccgggtgcagcggctcacatctgtaatcccagcactttgggggggccgaggcaggtggatcttttgaggtcaggagttcaagaccatcctggccaacaaggtgtaaccccgtctctactaaaaatacaaaaattagctgggtgtggtggtgcgcacctgtaataccagctactcgggaggctgagggaggagaattgcttgaacctgggaggcggaagttgtggtgagctgtgattgtgccactgcactccagcctgggcaacagagtgagactctgtctcaaaaaaaaaaaagaaaaagaaaaagaaaagagccatggagaaggatggtggtggtggttgcacaacattacaaatatgattaatatgtttaataccactaaactctgtacttaaaaatggtcaagatggtagattttatgttatgtataatttaacacaacatttttttctttttttttattattattatactttaagttttagggtacatgtgcacaacgtgcaggtttgttacatatgtatacatgtgccatgttcacaacatttttaaaattggaaaaaaagaaaaccagcagcaaggattttaccagagcaataagtagatgacagtcacatgaaaaagacattcgacatcattagccattagggaagtgaacattaaaatcacaatattactacagacctatcagaatgttaccacagacttatcaatgggtaaaataaaacttagtggcagtgccaaatgctggagaaactgggtcatttatacattgctggtgagaatataaaatagtacagctattctccaatttagtttagtagtttctttctttctttctttctttcttttttgagatagtttctcactctgtcacccaggctgcagtgcagtgggacgatctcagctcactgcaacctctgcctcccgggttcaagtgattctcctgcctcagcttcctaagtagctgggactacaggtgtgcaccaccatgtccagctaatttttgtatttttaggagagacggggtttcatcatgttggccaggatggtctcgatctcttgacctcatgatccacccgcctcagcctcccaaagtgctggatttttattatttttattattttattttatgttattttgagatggtgtttcattcttgttgcccaggcttgagtgcaatggtgcaatctcggctcactgcaacgtctgtctcccagtttcaagtgattctcctgcctcagcctcccaagtagctgggattacaggcatgcaccaccacacctggctaattttgtattcttttttagtagagatggggtttctccatgttggtcaggatggtctcgaactcccgaccttaggagatccccctgactcggcctcccaaagtgttgggattacaggcatgagacaccacgcctggactatttttttattttttgagatggagtctcactctgtcgcccaggctggaggatactggtgagatctcagctcactgcaatgtccacttcctgggttgcatctattctcctgcctcagcctcccaggtagctgggactacaggtgcgtgccaccatgcctggctaatttttgtaatttttttttttttttagtcgtgacagggtttctccatgttggtcaggctggtctcaatctcctgacctcaggtgatccacccgcctcagcctcccaaagtgctggtattacaggtataagccactgcactcagccatatataaccttcttcaaataaaattacacaggtggaaaatttttttctttctttttttttttttgagacagggtctcactctgtcgcccaggctagtgtgcggtgatgatgtaatcatggcttaagtgatcctccccgcctcaacctccctagtagctggaattacaggtgcacaccaccacatctgactaatttttttgtttttgtttttgtagacacggggtttcagcaagttgcccaggctggtttcgaactcctgacctcaagtcatccgtccacctcggcctcccacagtgctgggattactggtatgagctaccacaccttgcccgaaaacgttttcaaaataataaaatgggctgggcaagtggctcacgcctgcaattagaggcctggagacattaagtaaaccacccaaggtcacacagtaaggaaggggcagatctcagagtcgcctggctgcaaagctggtgtcccttccccactgtgccttaactgccgccttacagctgggttggaggatgcctccctggtctagggtcattattacattttcttttacaaagtatgtttctgataaacggaactgtttattttccaccgatggtcttatcctttgtccatctctttctgacggcaacagaaaacttcaccttccagaggagcgcctctgcctggctgtcccaccgtctgggaagtaaggagcgcctctgcccagcccccgcaccgtctgggaagtgaggagcgcctctggacggcccccgcaccgtctgggaagtgaggagcgcttctggacggctcccagcaaccccccaggtgtgaagtgacagccctgtgtgtgatctttctgccctccccaagtttgcattttcgacaataaaatttacttttaaattaaaagatttatactggggaagatttaaaaaaaaaaaaagaaagaaaagaaaactcaccttccaaaaacaaccactgggagtccgctttgtgcagaggttggacaagcttctgtgcaggtaggggcgctgctgctccccctaccacccacgcatcctcctccctgtctgcattcccgtcgtcgtagccagaggagttcagagcctctacagagagcacaacttctccagctggaacaaactccccttaaaggaatctatttaggaagattatttcaatgtacattcattcctccaaaatatgcttagatggacttaaataatcagaaagctgtgtgtgtatgtgtttcccgttttcttggcccacaaagaaccccttgagaggtccctgggcagtgagcctgtttatagacacccttctcccttccttggtgtcgcagacatcgcagtccctctgaggggctgacctgccccccaccttctggaagctgggaggttggaagaggggacgcatgccatggacccagcacacagctgggaactcgaggcacacctaagccttcccttgtgctgtgcggagtccacacttccttccccactggagtctcaaaacctcccctcactcaacagggtggtgctgctcaaagctctgggcacacattagggctggggagggggtggtggagagggggctccagcctgcccaaccaccaggcaacggggcacctgcccctctctcagctgggtctggacccgcctcccaggctcaggctgcaatgcctttctctttctctttgcaattccgttgggtcctgcccaggacagataaagacagagcagcctgtctttattggaggttcctctgccagcgggaagggtccggggaaaaccagagccagagccagagccagagaaacatgaagcaccccggggcctcccacaccaatgcctgagcaggaatggggaggggccatgactcataaggccctgggaggtcactttaaggagggctgtccaactgcaaggacgctgtaagcaggaagtgaaaccacagagcttcaaaaaaagagcgggacagggacaagcgtatctaagaggctgaacatgaatccacagatcaggtaccgctgcccactctgcctgctgggcccctcctgccccttcctgcctggtggtcctgctgggcctcaaccctggcctccccccgcccctgccccagccctgggctccctcccctctggctcccctgccacacgaatcccagtcaggctctttgtcctgctgtgtggtcaccccactgctgcttctgaatgggctgcctcccctacctgcaccagcccaggccccgtgctgagactctcccttaaagtcatgcccggactggtgctccccgccctgggagggtgctccctctgtgtgcttcctgccactcctgagctcagaaactgggagaattgaaccaaagggtaattggagcaatcaggcatttttgttctcagtgttttgatgaaatttctgtaagaattactttgcttaaatacaaagtcttaggagagggtgcgggggtaggaatggtctctgaagcacatgataaatcgtgtcatccaaggatgactccatggtgagcagatgtccccagacaggttccactccaaggtcactcttcatcttttagaacatgaccagtggttgagcgtggtggctcacacttgtaatcccaacactttgggaggccaaggcgggcggatcatgaggtcgggagtttgagaccaacctggcccatatggtgaaaccccgtctctactaaaaaacatacaaaaattagccaggcatggtggcgcatctctagtcccagatactcaggaggtttaggcaggagaattgcttgaacctgggaggtggaggttgcagtgagctgagatcatgccactgcactccagcctgggcgacagagtgagacttcatcaaaaaaaaaaagaaagaacatgatcagtaacatggaatgtgagaatgtgggaaaaaagtgcaatgatgaggagaaatgctctgattttaaaatttagtgaaaagagagcccagtccccaacagctttctcctacaggatccgtgatgcagaggctggacagggctggcctggaaaggggcccctgctccatccgtccccagctctgtggcctcggcaggttaccccgcctctctgtgcctctggcatctcctctgtaagatgggaatggcccctgcaggcctagggtagcctcacgtgagctcacacccgctcagcacttagaagagtggcctgggcctcagaattcagttctaccatgattttaaaataatgttaacacgcagagtgaaacatcaggaaggaattgagctgaaaggttaaaagctattttttaggggtgaagggttttattctcttttgcattctcctaatgggttggggagtgggttggcagaaatactaggagggtggggaatgtacccctggaaaggccagagttggacccgagctgggagagatcaccccagcccgcctgccagcatcccctcctcttcctctcccctcagtcttcctgcctgggaaggcagcagaaattctcagggctgtggaggggtcggggaggcccagggccatcctgggagctgtgttcagtggacatgagccccgaggactcccgggagggctccctgcatgggccggtttctctcttgtgccttcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtaccacccaaacttcaatcgaatcacaggcagtgttgcaggaattagaggactggagagactgatatgggtgagacaggaggatttatttaggtgcactggttcagcagactcacatccaaaaaggctgagcccttaacaaagacagactgaggtatttataagcaaacttacagaagcagaacaaaggcgattaatcaaacagtgacaggtcacataatctatagcataacagatgacttagcataacttggggccttctatagctggtggccttgcagctacatcaaaaggaaaacaggaactggctaaatacagacatttgtaaaatatagttataatggttctggaaaggagagacagtaaaggaatttgtcttttttttaaaaaatttttttaaaattttcttcaaccttgccctggaggggtgtgggggtggtgtctggagcccattcctttggccttgacttttcaggcagtgttataactgtcgttggagtgagctggctaggcagaggaaaacttgttcttcttttctttttaacccttgctacagtaggacctaagcagctggaaatgcagaaaacacaacaataagtaaaatgcccagcactgggctctcaattgtgtatttttcccacatttcttttttctctttttttccttttttttttttttttttttttccgagatggagtctcgctctggcacccaggttggagtgcaattgcacaatcttggctcactacaacctccacctctcaggttcaagtgattcttcggccttagcctcccgaatagctgggattacagaaggctgccaccacgcccagttaattttttctatttttagttgagactgggtttcaccatgttggccaggctggggaattcctgacctcaggtgagtcacctgccttggcctcccaaagtgctggggttacaagcatgagtcaccgcacctggccacttcccacagttctgtttttttgttttgttttgttttggtttttttttaagactgagtttcactctttgttgcctgggctggagtgcaatgactcactctcaacttccacctgccaggttcaagtgattctcctgcctcagcctgtgagctgaacagtcacatgagggtgaaggttgttgccacaagctcaggggatgctccagacagagtggcctgggatgtcgagtcacagctgctccatgccacggggacaagaggaagcaggagtttagtctgacacactgcccttccagatagagggcaagagacagaaagaggggctgaagtcacccttgaataaccacagcagtggcacccacaaaggtgcagtccccacagcctcatagcctcttctaggtgccacctcttaaggccattacaatagccattaacactgaacgtgagctttggagcagacaatcactcaaactaaacaggggggatggaggaaaggagcttcaatggcaagatcccctgggctcctgtcctggcccctcctctccctgccccacccctgcactcctcctgctccccctctcagagcatcccctgccccctgctcctctcccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaaggtgagaggtggaggggtcaggggagcgtgagcgggaggaacagcatgaaagatggatggatctgcaatgccatggctgggggtgtcccagggcagcctgcaggggtgggactggcactgactgcaactgacagccaggagaccaggcctgggaggacaggccagggtcaggggagagcctgactgcttcccgcttcttcatctcagaatttgcatactgctgggaaaactttgtgtacaatgaaggtcagcaattcatgccttggtacaaattcgatgaaaattatgcattcctgcaccgcacgctaaaggagattctcaggtgagggtctccctctggcctcatcatctctctcctctcacctgctcatcctcctgaggcctccgttggcctggccctcccgccctccctcttgacccactgcctgccctcatggtcacaccaccttcccttaactcctggtgctccctccacactgcctcctccctgctttcctgggcccttcctgtgagtaagaggccccttctgcctctaaggcacctgggtcttggactagaggaacaaacagcaagacagggtggcctgggacaccagccgctgcccttctgtgacatggggacaagaggaggcaagagctcagccttccagggaacaactctgggcaggagatgtggaaggaaggagctcagtgtgggggcacccatggcatcctggggggacatctgagggccacccccacccgctattcctccctccaatggtggcctctgagtgtgaaggcatgggggaaggcagacacctgcccctgactctccctcactaccacatagctgctgggtggctggggacggggggggtccctgggatgattcctgagggcaggatccaggggtccctccagatgtcctcccatccaggtgagaaagcagcataaagtgaggcttgcactcagatgggcctgggaggtcactcacagcgcaggtgtctcctggaacaagggccctggaagatagaaatagaatccaaacccaggactaacatcagggccaagacaagcctgccagggaggctgcacatgaagccccagatcagggaccactgcccgctctgcccatggggcctctgctgccctttcctgcctggtggtcctgctgggcctcagccctggcctccccctgtcccagccccagccctgggctctctcccctcctgttcctctgccacccccactcccagccaggctctttgccctgttgtgtggtcgccccactgctgcttctgaatgggccacctcccccacctgccccaggccagaccccctgctgagactcttccctgaaagtcaccgctgggctggtgctccctgccctgggagggtgctccctgtatatgcttcccaccattcctgagctctggaactgggagaattgaaccaaaggatgattggagcaatcaggcattttgttcttagcattttgatggaatttctgtaagatttactttgtttcaacacaaagtcttaggagagggtgtgggggaggaaatggtctctgtaccagaaaataagtcatttcttccaaagacgcctccgctgtgagcagaggaggatgcacacgaccccagacacaggctcctcctccgtgagcaccattcaccttttagaatgacacctgcaacatggagtgtaggaaaacatatgatcaggagaaatgctcttattttaggcagggcacggtggcttatgcctataatcctagctctttgggaggctgaggtgggtggatcacttgaggtcaggagttggagatctgcctggccagcgtggcaaaacctcctctctactgaaaatacaaaaaatgagccaggcatggtagcgggagccggtaatcccagctacttgggaggctgaagcaggagaatcgcttgaacccgggagggacagcagtgctggtcacggaaacacccaggactcaggactgaagcacaagtgtttccagtccccacacactaaaaaggagacaagaactcctcttcgagcttttctgatgagcactcacctctcaccctcaaacccctggggcctctcttttcctcctgaccctctctctggacctggcctcttgctctaggttcccagttttggtcccagtgctggtctctcctccaatggtaccaattccaggtctccttccacctcctggggcagatgcacagggagcctgaaaatcccagtggataatgatgctgtgccccagccagtgaagacagttggagaggggattctcttcacttgtctttaaatgagcatctactatttcttgcaaatgttccatgtctctggacttggcctaagccatttttatgttcagtgtcatctcgttctccctaatatttagaaaagggtgttgcttgtaggaccactttgctatgaagaagccttgtttccttttcttgagaacacaaagcaagtgagtggtagagcccagattcatacccaggtctactagaaattgtggcaaacagagattccttccttccttcctcccttccttccttccttccttccttgcttcctctctctttctctctttctctttctttctttctttctttctttctttctttctttctttctttctttctttctttctttcttcctttcttctctctcgtctttcttcttttgctgctgcctccaaacagagatttttctaattctggttttgtcaggatgtctacagaggggccgggagaggccttcaaggtggggctggtgtttccagcccaggagtcctgagctgccccatctggcctgagaagcacgtttgggagacctcatggcatccaaagggacgtggaaaatgctatgaattatccaaaaagatgtccctggcaggctcctctccccaatgatccccctcaggagtgtccctgccccaatgctgggtgtggtaggagttaaccctgcaggcaggaggaagccccagcaggtccatctccagcaggggctgtgggtgagcagagccaggacaggggtgcatggtgaggccagggaaggagacccagctctaccccagggagaggggcagggtcctccccggagggcctgagcacactgagctgaccctggggagaccctgacaaggcctaaacaggccccggggctgtgttgacttcctgataatccaccagaaggggtcagagagagaggatcagtggcccccacaaagggagtggaagcgcctcctctgacaggtgcctcagtatatggggagcagggaaggagtggggggtgcaggagaggagcgagaggtagtcccaggaggagtcttagggcttttggtttcccctgtctttgtccacagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggtgaccgacccagccacctgcatccaggcagggccctcccaatccagggacactcatagatagaaggttctgggtggtgcctgtggtttcctgcagtgtttgtcacttgtgcttcctgcagctgctgctgcttggccctggagttggggggagactttggcttcagtgactctccatggccaggtggggttgagtctgcccaatggcaaagtgcttcctgaggaccctcccaggatcccctcacagacacagctctcaccaggaatgattcggaactgtgggatttgaggactcagggcctacctgactcacaaggccaggatgtccctgtgccctctcttgggcttcatcctgcggagagacagactggggcaggagaggctgatcaggggttttgtcctgcccagggtggagcccacagcaaggccagaacaggtcccatgtcaggatgcaaagatggccagcagttggggaagaactgggccaggaaaggctgagggggccaggctaggctggccaggagccctgagcccaagggactttcttccctggcccctacccagcacagcctctgtctggagaggccaagttctgcttggctctgttgctggaaactgggggcttctctgggctctatgagctcaatgtgggcctcgctggatccacacacactgcttggaacatcctttcaagggtgccagtctccatcaccgcctaagcagtgggactcccccaggaatgacccacagccccttctcagcacaaaccatgtcatccacttcaccctgcatcccctctgatggaatccctccctgtctttgtccccatcacaatcacagtccttgctgccctgctgtccccaacttgaccgattcctagtcttagtggaaaatccttttctctgaagtttggagtaaataccatatttctataagtcaaaataatgacaattataccatgtcacagggaccttcccacattggagtgagtcctgctggtcttctcttccccactacttttggtggaattcattttggcctaagtctatatcacatttgggctcagcacaggttgtggcacagaatagaagtttctagaattatgggccacagatgggatgggagtaggggagttgatgagtagagcaggtcaatctccccttgaaggaagcacactcactcaggggcatcaggccaatgaccttggggctccgccggcccctcctccctgcccccatctctgtagcccctccctgcagggctgggtctggggtgagggtcctgaaggctctgaccttgggtacaaaattgatgggggctccaaatgctcagtaattagagaaaacacattttaatttaataattaatgcaatattttaaaacgcaaatttaatacaaatagatcatgatgaataaaagcaaagattttaataaagcctggcaggagagtgctgtcctgtgtatattggagctggggcaaaataaaacctcattgctcctgatctgtttgtatttaaatgggcaacattttgcttatcttgggatttttgcataacatctgatatttttaatattgcatagaaaatcatgcatcctaataaccggggttttggcgacccctctaatttcgtgctggaggcccccgcctccccagccccacctggtccaggcgctccctccctgttcaccacacatcacctcacactctgtttccttttctaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatggtaagaatggaaggttcaggtggggtggggtgggtgggggcaggagaggttcctgggaagaaaaggagaaaggccttggtctgctgcctgcagaaacgatggctggactctgggacctgactttggggtcgatgggaagagagaggccaggccaggagatatgggcccggggagggtggctggaagtggaagcagaacttggggatttccgaaagaaagagaactgggctggcccagattccaatgggaaggaagtacctgatgaaggagctaagtccctaggggagggagagggaaaggagggactgaaaccaggatgtgggaagtctgtcctgagagtcatgggcccttggtgctgccccctccccacaacaggagcgtgacttatctcccctgtcccttttcagagtttgagtactgctgggacacctttgtgtaccgccagggatgtcccttccagccctgggatggactagaggagcacagccaagccctgagtgggaggctgcgggccattctccaggtgagggcttcctccctctgcctggtgccccatcggcctccccctcctccccgctcccctgtgccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacact

SEQ ID NO: 438 - DNA, 10381 bp, Homo sapiens
  source 1..10381: mol_type = genomic DNA
cacagagcttcaaaaaaagagcgggacagggacaagcgtatctaagaggctgaacatgaatccacagatcaggtaccgctgcccactctgcctgctgggcccctcctgccccttcctgcctggtggtcctgctgggcctcaaccctggcctccccccgcccctgccccagccctgggctccctcccctctggctcccctgccacacgaatcccagtcaggctctttgtcctgctgtgtggtcaccccactgctgcttctgaatgggctgcctcccctacctgcaccagcccaggccccgtgctgagactctcccttaaagtcatgcccggactggtgctccccgccctgggagggtgctccctctgtgtgcttcctgccactcctgagctcagaaactgggagaattgaaccaaagggtaattggagcaatcaggcatttttgttctcagtgttttgatgaaatttctgtaagaattactttgcttaaatacaaagtcttaggagagggtgcgggggtaggaatggtctctgaagcacatgataaatcgtgtcatccaaggatgactccatggtgagcagatgtccccagacaggttccactccaaggtcactcttcatcttttagaacatgaccagtggttgagcgtggtggctcacacttgtaatcccaacactttgggaggccaaggcgggcggatcatgaggtcgggagtttgagaccaacctggcccatatggtgaaaccccgtctctactaaaaaacatacaaaaattagccaggcatggtggcgcatctctagtcccagatactcaggaggtttaggcaggagaattgcttgaacctgggaggtggaggttgcagtgagctgagatcatgccactgcactccagcctgggcgacagagtgagacttcatcaaaaaaaaaaagaaagaacatgatcagtaacatggaatgtgagaatgtgggaaaaaagtgcaatgatgaggagaaatgctctgattttaaaatttagtgaaaagagagcccagtccccaacagctttctcctacaggatccgtgatgcagaggctggacagggctggcctggaaaggggcccctgctccatccgtccccagctctgtggcctcggcaggttaccccgcctctctgtgcctctggcatctcctctgtaagatgggaatggcccctgcaggcctagggtagcctcacgtgagctcacacccgctcagcacttagaagagtggcctgggcctcagaattcagttctaccatgattttaaaataatgttaacacgcagagtgaaacatcaggaaggaattgagctgaaaggttaaaagctattttttaggggtgaagggttttattctcttttgcattctcctaatgggttggggagtgggttggcagaaatactaggagggtggggaatgtacccctggaaaggccagagttggacccgagctgggagagatcaccccagcccgcctgccagcatcccctcctcttcctctcccctcagtcttcctgcctgggaaggcagcagaaattctcagggctgtggaggggtcggggaggcccagggccatcctgggagctgtgttcagtggacatgagccccgaggactcccgggagggctccctgcatgggccggtttctctcttgtgccttcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtaccacccaaacttcaatcgaatcacaggcagtgttgcaggaattagaggactggagagactgatatgggtgagacaggaggatttatttaggtgcactggttcagcagactcacatccaaaaaggctgagcccttaacaaagacagactgaggtatttataagcaaacttacagaagcagaacaaaggcgattaatcaaacagtgacaggtcacataatctatagcataacagatgacttagcataacttggggccttctatagctggtggccttgcagctacatcaaaaggaaaacaggaactggctaaatacagacatttgtaaaatatagttataatggttctggaaaggagagacagtaaaggaatttgtcttttttttaaaaaatttttttaaaattttcttcaaccttgccctggaggggtgtgggggtggtgtctggagcccattcctttggccttgacttttcaggcagtgttataactgtcgttggagtgagctggctaggcagaggaaaacttgttcttcttttctttttaacccttgctacagtaggacctaagcagctggaaatgcagaaaacacaacaataagtaaaatgcccagcactgggctctcaattgtgtatttttcccacatttcttttttctctttttttccttttttttttttttttttttttccgagatggagtctcgctctggcacccaggttggagtgcaattgcacaatcttggctcactacaacctccacctctcaggttcaagtgattcttcggccttagcctcccgaatagctgggattacagaaggctgccaccacgcccagttaattttttctatttttagttgagactgggtttcaccatgttggccaggctggggaattcctgacctcaggtgagtcacctgccttggcctcccaaagtgctggggttacaagcatgagtcaccgcacctggccacttcccacagttctgtttttttgttttgttttgttttggtttttttttaagactgagtttcactctttgttgcctgggctggagtgcaatgactcactctcaacttccacctgccaggttcaagtgattctcctgcctcagcctgtgagctgaacagtcacatgagggtgaaggttgttgccacaagctcaggggatgctccagacagagtggcctgggatgtcgagtcacagctgctccatgccacggggacaagaggaagcaggagtttagtctgacacactgcccttccagatagagggcaagagacagaaagaggggctgaagtcacccttgaataaccacagcagtggcacccacaaaggtgcagtccccacagcctcatagcctcttctaggtgccacctcttaaggccattacaatagccattaacactgaacgtgagctttggagcagacaatcactcaaactaaacaggggggatggaggaaaggagcttcaatggcaagatcccctgggctcctgtcctggcccctcctctccctgccccacccctgcactcctcctgctccccctctcagagcatcccctgccccctgctcctctcccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaaggtgagaggtggaggggtcaggggagcgtgagcgggaggaacagcatgaaagatggatggatctgcaatgccatggctgggggtgtcccagggcagcctgcaggggtgggactggcactgactgcaactgacagccaggagaccaggcctgggaggacaggccagggtcaggggagagcctgactgcttcccgcttcttcatctcagaatttgcatactgctgggaaaactttgtgtacaatgaaggtcagcaattcatgccttggtacaaattcgatgaaaattatgcattcctgcaccgcacgctaaaggagattctcaggtgagggtctccctctggcctcatcatctctctcctctcacctgctcatcctcctgaggcctccgttggcctggccctcccgccctccctcttgacccactgcctgccctcatggtcacaccaccttcccttaactcctggtgctccctccacactgcctcctccctgctttcctgggcccttcctgtgagtaagaggccccttctgcctctaaggcacctgggtcttggactagaggaacaaacagcaagacagggtggcctgggacaccagccgctgcccttctgtgacatggggacaagaggaggcaagagctcagccttccagggaacaactctgggcaggagatgtggaaggaaggagctcagtgtgggggcacccatggcatcctggggggacatctgagggccacccccacccgctattcctccctccaatggtggcctctgagtgtgaaggcatgggggaaggcagacacctgcccctgactctccctcactaccacatagctgctgggtggctggggacggggggggtccctgggatgattcctgagggcaggatccaggggtccctccagatgtcctcccatccaggtgagaaagcagcataaagtgaggcttgcactcagatgggcctgggaggtcactcacagcgcaggtgtctcctggaacaagggccctggaagatagaaatagaatccaaacccaggactaacatcagggccaagacaagcctgccagggaggctgcacatgaagccccagatcagggaccactgcccgctctgcccatggggcctctgctgccctttcctgcctggtggtcctgctgggcctcagccctggcctccccctgtcccagccccagccctgggctctctcccctcctgttcctctgccacccccactcccagccaggctctttgccctgttgtgtggtcgccccactgctgcttctgaatgggccacctcccccacctgccccaggccagaccccctgctgagactcttccctgaaagtcaccgctgggctggtgctccctgccctgggagggtgctccctgtatatgcttcccaccattcctgagctctggaactgggagaattgaaccaaaggatgattggagcaatcaggcattttgttcttagcattttgatggaatttctgtaagatttactttgtttcaacacaaagtcttaggagagggtgtgggggaggaaatggtctctgtaccagaaaataagtcatttcttccaaagacgcctccgctgtgagcagaggaggatgcacacgaccccagacacaggctcctcctccgtgagcaccattcaccttttagaatgacacctgcaacatggagtgtaggaaaacatatgatcaggagaaatgctcttattttaggcagggcacggtggcttatgcctataatcctagctctttgggaggctgaggtgggtggatcacttgaggtcaggagttggagatctgcctggccagcgtggcaaaacctcctctctactgaaaatacaaaaaatgagccaggcatggtagcgggagccggtaatcccagctacttgggaggctgaagcaggagaatcgcttgaacccgggagggacagcagtgctggtcacggaaacacccaggactcaggactgaagcacaagtgtttccagtccccacacactaaaaaggagacaagaactcctcttcgagcttttctgatgagcactcacctctcaccctcaaacccctggggcctctcttttcctcctgaccctctctctggacctggcctcttgctctaggttcccagttttggtcccagtgctggtctctcctccaatggtaccaattccaggtctccttccacctcctggggcagatgcacagggagcctgaaaatcccagtggataatgatgctgtgccccagccagtgaagacagttggagaggggattctcttcacttgtctttaaatgagcatctactatttcttgcaaatgttccatgtctctggacttggcctaagccatttttatgttcagtgtcatctcgttctccctaatatttagaaaagggtgttgcttgtaggaccactttgctatgaagaagccttgtttccttttcttgagaacacaaagcaagtgagtggtagagcccagattcatacccaggtctactagaaattgtggcaaacagagattccttccttccttcctcccttccttccttccttccttccttgcttcctctctctttctctctttctctttctttctttctttctttctttctttctttctttctttctttctttctttctttctttcttcctttcttctctctcgtctttcttcttttgctgctgcctccaaacagagatttttctaattctggttttgtcaggatgtctacagaggggccgggagaggccttcaaggtggggctggtgtttccagcccaggagtcctgagctgccccatctggcctgagaagcacgtttgggagacctcatggcatccaaagggacgtggaaaatgctatgaattatccaaaaagatgtccctggcaggctcctctccccaatgatccccctcaggagtgtccctgccccaatgctgggtgtggtaggagttaaccctgcaggcaggaggaagccccagcaggtccatctccagcaggggctgtgggtgagcagagccaggacaggggtgcatggtgaggccagggaaggagacccagctctaccccagggagaggggcagggtcctccccggagggcctgagcacactgagctgaccctggggagaccctgacaaggcctaaacaggccccggggctgtgttgacttcctgataatccaccagaaggggtcagagagagaggatcagtggcccccacaaagggagtggaagcgcctcctctgacaggtgcctcagtatatggggagcagggaaggagtggggggtgcaggagaggagcgagaggtagtcccaggaggagtcttagggcttttggtttcccctgtctttgtccacagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggtgaccgacccagccacctgcatccaggcagggccctcccaatccagggacactcatagatagaaggttctgggtggtgcctgtggtttcctgcagtgtttgtcacttgtgcttcctgcagctgctgctgcttggccctggagttggggggagactttggcttcagtgactctccatggccaggtggggttgagtctgcccaatggcaaagtgcttcctgaggaccctcccaggatcccctcacagacacagctctcaccaggaatgattcggaactgtgggatttgaggactcagggcctacctgactcacaaggccaggatgtccctgtgccctctcttgggcttcatcctgcggagagacagactggggcaggagaggctgatcaggggttttgtcctgcccagggtggagcccacagcaaggccagaacaggtcccatgtcaggatgcaaagatggccagcagttggggaagaactgggccaggaaaggctgagggggccaggctaggctggccaggagccctgagcccaagggactttcttccctggcccctacccagcacagcctctgtctggagaggccaagttctgcttggctctgttgctggaaactgggggcttctctgggctctatgagctcaatgtgggcctcgctggatccacacacactgcttggaacatcctttcaagggtgccagtctccatcaccgcctaagcagtgggactcccccaggaatgacccacagccccttctcagcacaaaccatgtcatccacttcaccctgcatcccctctgatggaatccctccctgtctttgtccccatcacaatcacagtccttgctgccctgctgtccccaacttgaccgattcctagtcttagtggaaaatccttttctctgaagtttggagtaaataccatatttctataagtcaaaataatgacaattataccatgtcacagggaccttcccacattggagtgagtcctgctggtcttctcttccccactacttttggtggaattcattttggcctaagtctatatcacatttgggctcagcacaggttgtggcacagaatagaagtttctagaattatgggccacagatgggatgggagtaggggagttgatgagtagagcaggtcaatctccccttgaaggaagcacactcactcaggggcatcaggccaatgaccttggggctccgccggcccctcctccctgcccccatctctgtagcccctccctgcagggctgggtctggggtgagggtcctgaaggctctgaccttgggtacaaaattgatgggggctccaaatgctcagtaattagagaaaacacattttaatttaataattaatgcaatattttaaaacgcaaatttaatacaaatagatcatgatgaataaaagcaaagattttaataaagcctggcaggagagtgctgtcctgtgtatattggagctggggcaaaataaaacctcattgctcctgatctgtttgtatttaaatgggcaacattttgcttatcttgggatttttgcataacatctgatatttttaatattgcatagaaaatcatgcatcctaataaccggggttttggcgacccctctaatttcgtgctggaggcccccgcctccccagccccacctggtccaggcgctccctccctgttcaccacacatcacctcacactctgtttccttttctaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatggtaagaatggaaggttcaggtggggtggggtgggtgggggcaggagaggttcctgggaagaaaaggagaaaggccttggtctgctgcctgcagaaacgatggctggactctgggacctgactttggggtcgatgggaagagagaggccaggccaggagatatgggcccggggagggtggctggaagtggaagcagaacttggggatttccgaaagaaagagaactgggctggcccagattccaatgggaaggaagtacctgatgaaggagctaagtccctaggggagggagagggaaaggagggactgaaaccaggatgtgggaagtctgtcctgagagtcatgggcccttggtgctgccccctccccacaacaggagcgtgacttatctcccctgtcccttttcagagtttgagtactgctgggacacctttgtgtaccgccagggatgtcccttccagccctgggatggactagaggagcacagccaagccctgagtgggaggctgcgggccattctccaggtgagggcttcctccctctgcctggtgccccatcggcctccccctcctccccgctcccctgtgccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacacta

SEQ ID NO: 439 - DNA, 10381 bp, Homo sapiens; identical to SEQ ID NO: 438
  source 1..10381: mol_type = genomic DNA

SEQ ID NO: 440 - DNA, 226399 bp, Homo sapiens
  source 1..226399: mol_type = genomic DNA
cctgtgtttttgtgtttattttaaaaagttcacacaccttccccatctttgtcccagcactggttttggtgactccacccctactcccctatgagtcagcccagaatgtgaagccagtggccccagggcaggagatggccacccctcagccccaccgcagggtgaagctgggcccgaagctcctcctgtcctagggccacgctggctgcagtgaggcggcggggacggaatgtgagtgggtggagagctcctggcaggaaggccaggtagcacctctgccctcatggcactgataaggagccaggaagcagggcaggtggggcataggccgtggcagggtacctacatgtcaatcacacgtgatgggtgggcctgggtagctgcatgccagactgggcaccagactgtggcacacagctcaagggtaaccttgcatccaggcccttctgtgagagtaggatgggagggagttgcacccatctcctgtccgcccccccccaaaaatatatatgtatgtcgatatataatatagaggtatatacacctgtacataaaattgttgccaccaaccactaaatggttacactacaccaagacactaaaatggcagggagccctgggatcctggggttggcagacacagggaatagggggtagaggcccaggctaatttctcccttcacagcaaagcagggagagaaaggaaggagattcaccccttaacctgtctcagccctgggtcagaagagaagcctcccgcctggccaggcttcacctaccttagccaaattgtagccagacagacagtgccccctgacctcaaaaaaggaggtcaagctgaaatggccctgaccctgaccgtgtgtccaaaaccccagcgtgagagccagggctgcttcttgacagctgctctcctctgccctgcgtggcactgaaccaggagtaagggcttctctgttctagcctcccagggaagggaaaaagcaggggctgtgattgtcaagactcacaaccatgtggagaggccgaatcacgcaggagagccacgcattggagtaccctggctcccagccccttccccaccccgtcttgagccagagagctacaagcaggaatcccagtgcagctgcaaatcatggccatcgaggaagtctgtggagaagaggctgggggctgtggtgctgaggggggctaggctcagcacgggaccacctgacgacagctccagccagtccatgctgtccaggtggccatcagccaggtccaggcccatggtgctgctgggctcaggaacaaagtgcaattccgaggtgtccatgggtgacggggggtggtccaggatggcagtgctgctcagcatctggctatggaggtcgtcaatgagggaaaggggctctggcccgtcatgcccactggtcagcaggggcagccccgtgctgctctccaggaagtcctccaggcgtccagggagggagggtgagcctggaggaggtggggcagcctgggggagctcagcagaaggtgatggctgtgctgccaggggggacccacagactgtcttcggggatggcttctccttccctggcagggatggcggctccttgaaatctgctgaaatttctgccaatcaatcaagagagtaaatggatatcagaagccaagcctgtatatctacatgcaaaagaatgaaggtggaccccccaacgtcacaccatttacaaaaataaaacggatcaaagacttacttaaatgtaagagctaagactataaaactctttaaaaatatttgcaaatcacatatttgataaagaagtgatatccggaatacacagagaacttctaaaactcaacaacaaaaaaccaaacttgactcaagaataggtaaaagaaagatttgaacagacatttttccaaagatgatatacaaatggccaacagcacatgaaaagagctcaatatcactagtcatgagggagaccacagtgagatacacctcaaacccactggagtggctactgtaaaattaaatttttaagaaagtattggtgaggatacagagaaactggagcccttgtgccctgtggtagaaatgcaaaatggtgcagctgctatgaaaaacagtatggaggttcctccaacacttacttacttaaaaatagaattaccatatgatctagcaattccactgctgggcatatacccaaaagaattggaagcagggtctcaggtatttgtacacaggtgttgataagtgcattcacaacagtagaatgtggaagcaacctatgtccatcaatggatgaaggaagtgatactatgcttagtgcaacagcctgtcacaaaagacaattcatgattgcacttagtcaaaatcatagagacagaaagtagaatggcagttgctacaggctggcggaagggccaaatgggaagttactgtttaatggggatagtttcagttttacgagatcaaaagaaagggagatggatggcagtgatggctgtacacattatgaatgtatttaataccactgaaccatacacttaaaaatggttagttacaatgggctgggtgcagtggctcacgtctgtaatcccagcactttgggaggccaagtggggtggattacttgaggtcaggagttcgagaccagccaggctaacatggtgaaaccccgacctctactaaaaatacaaaaattagccgggcacggtggtgcacgcctgtaatcccagctactcaggaggctgaggtaggagaatggcttgaacccgggaggcggaggttgcagtgagccaagattgcaccactgcactccaacactgggaaacagagtgacaccctgtctcaaaaaaaaaaaaaaaaaaaaaaaaaaaggttatgatgggttgggcacagtggctcacacctgtcatgccagcacttgggaggctgggacaggaggattggcttcaagccaggagtttgagagcagcctgggcaacaaggcaagaccccatctttatcaaaaaacaacaacaaaaaaaggtaaattttaggtgtattttaccacaattttttttttttttttgagacttgagtctcactgttgcccaggctgcagtgcagtggggcaatcttggctcactgcaacctccgcctcccgttttcaagcaattctcctgcctcaccctcctgagattacaggcacgtgccaccatgcctggctaattttttcaccatgttggtcaggctggtctcgaactcctgacctcgtgatccgcctgccttggcctcccaaagtgctgggactacaggtgcccgccaccatgcccggataaattttttgtattttttagtaaagacggggtttcaccatgttagccaggatggtctcgatctcctgacctcgtgatttgcctgcctcagcctcccaaagtgctgggattacaggcgtgagctaccacgcccagccgatttatcacaatttttaaaaaatcaaaaaaaatgtgcaaaggacttggccattctccaatagaagatacacaaatggtcaggcagcacatgaaaagatgttccacgtcactaaatgacagaaatgcaaactaagataccacttcacacccattaggatggcttgtatcaaaaaattgaaaataagaagtgctggtgaggaggtgaagaaactggaacccttgtgcattgctagtgtgaatgtaaaacgttacagctgcagtggacacagtttagtgattcctcaaaaagttaaacacagaagttaccatatgaggcggggtgcgttggctcatgcgtgtaatcctatcactttgggaggccgaggcgggcagactgcctgagctcaggagttcaaaaccagcctgggcaacacagtgaaaccccgtctctactaaaaaacacacaaaaaattggccgggcgtggcggcgggtgcctgtagtcccggctactcgagaagctgaggcaggagaattgcttgaaccccagaggcagaggttgcagtgagccaagatcgtgctactgcactccaatctgggcaacagactccgtctccaaggaaaaaaaaagaagaaattaccatatgatccggcaattccaaccctaggtttatgcccagaactgaaagcagggactcaagacagacacttgtacactgacattcacaacatccaaagggtggaaacagcccaggtgtccagccacagatgaatggatgaagagaatgtggtgaatccacactacagggtatgattcagcctttaaaaagagtgaaattctgacacatgctgcaacacagatggaccctgaggacattatgctgagtgaaataagccagacacagaaggacaaactgagtctacttctgtgaggtccccacgacaggcaaatccatagagaaagtgggatggggactgccaagggctggagttggggagaatggggagttactgtctaatgggtacagtttccttatggggtgatgaagttctggagcggataggggtgacagttgcacaacactgtgaatggacctaatacctctgattgtacatttaaaaaatgattagaatggcaaattttattatctcaccacaactaaaaaaagaattatgcaaaaaccaggcctgctccccaaccctgtgggttctggccccccctgtcctggcagaatgcactctttgccctgcagccgctctcaccaggcaaggaggtcgctgcctgcccagctgccaccacctgcccagacctctctcctcaaacacctgcttctggcatcactgccacctcttgggccacttttcagtgtccctttggcggcaggcagcacccacacccaccatctccctttctctgccatcccttagaagctagagttcaaagcctgttcccttttccttcttgaacaatatctctggggtagcacctccttcccttggaacctcctgaagctcacgccaaggcctcgctcctgagcgcccagcccagccgtcctcacagcgggtcccatacctgccgcctcagtgccacctgcactggtgagagatgcgcctcagaccccagggacccagggattctccctagggcttgagaattacagacctcacaggaacaccagtgactgagctcttgtcttaaattgaaataaaattcacacaacatcacatctactctggtagagctgtggttccaggctgagctcccactttgcctgcacccctcagccgctcctcctcctcctgaagccactgagacactcaaagagaagtccacgctcaccacccagcatcggcaccacaggcccagacttcttgcctgctgccgccagtgagctcctccccaggaccatctcggggtcatctgggatcttctactcccagctgggtcccctcacacagacgcgcgctatttcctgcccagcatctgccctacctccttcttcccctctgcaggggaacctcccagagagctctctacggccacccccaccctgctcccaggcctctcatggacttcctgttgtgcccatgatgcctaccttccgtgtccaggcctcggtcctcagctcccttggtcacggctggattccaggacaccgcaccctgccactacttgtcctcccgacccccaaggctgggcttagccccaacctctgctcccccacctcacaccctcggcagcctcccagctccaactgccaatctagatgtgacaacactccaactcctacctccagcccagacctctctcacaaatgccacttgatgtcaactgtccctgtgaaccctccattcggtctcgtgacacaccccatcagggaccgcgcaatgtggtcccacacgtgccccctccccagctcaccccatcaatggccactccaccctggccctttaggccacagcccttgaagtcatccttggctgttccttccctctccccccacttcatccataaagacaccaacctggctctctccaaatggggctgattccagccgctcctctgcccgccactgctgcctgctgggccaaagcccagctctccagtcgccccccaacctggggctccctgcttctgcccttgcacggctactatcgcctgggtcctgcatcagaccaggccttttctgctcaaggctgtgcgatggcttcccacacaatggagccaaagccaccctgccctggtgcccaggaggccacgcatgatctggccatgaaggccttcttcccctttcctcaactccactccaacccgccaggtactcccgaggccgcacagatgcacacagctgcccctgctcacaggagacatcctggaccttccccaccaggctccccagacctctccctctcctccatttttgtcctaaggctcctctcggatcttccatatgatctgcttatttcttatatttgttgtccacctccccaggctgcactgtgagctccacaagggcaaatgtctcttctgttcgttgggaggcgagggccttggggcagtgcttccagctgaaggacggcaccttccctggtcctctcgcccaggccttggagacgggagggctcacagccaccactgcatccacagtgcttgcccaagactggtcacgcacggaagcattcaataaaaacaaaccaacccagggctagagacacctatgaacagagaaggccgtcagggaggcagcaggggacctggggttacctccgctctgaatgagaatgtcaaacaggtcgtccatctgctggcttgaggaaccattttcctgtgggacaaaggaaaaaaaaaaaagagataaaaatcttgaatgggggctcccagcccgaactacgaatgaggcccctccctctgccccagaataagcagccagatccacaggacccatgggcgtgcccggactcctggagcccgtcccctaacaacccactccccaaggcctctctgaccctgaagctgggcttcgcctgccccctattcctccgggtggggctgtaggagcctcagcccagcagcctagggcagctgccaacactagccaggcctagcccgccttcctcacctgctgtttgggctgctggctcatggcttcctcatagccaggtggttccttcttcagcagagaagtgggggtcccaaagaggggctgcagtgggtgctccaggtccatctgggcagagggggcaggcgctggagagccaggctgggacgagggctggacaggagagcagggagaggaccagtggccagggggctgggggtgcagacctgccttgtagggggcggggggcggggatagggccagggcctctcacactctaggagggaagatgggaggcactggcttttagggagctttcatgaaagccactaggtaggaaggaatacaggatggggggccctcaaccctgcagggggtgcctggccccttgaggtttgggagaggtctctgggctgggctggtcaccccctgagatttctgcagcttctttctctgcttggggctgctcagggacccctgtctcctatcctgaggtacctgttcctgtcactgtcttctctacccccaagttctgcaggaccacgaggctacataaagccttagggcagcctcacctgtggcctgggctgagagagggtctgctgagggagctttccgctgctgacaccttggtggggacagctagcctctctgaggagaggaccctgagctggatcctggccagaggaccccacagcctctccccggggcaggctacctctgaccttcactggccactccccacagagcagcactagggcaggcccagcctgggtacgggctgctcaggagtcctgctgctgaggtgccgaaatgttctagtctcaacagccagagaggtggggagctcaccaatggctccgccctacagctagggggtctgaggcaggtcccttaactttcctaagtctcagtacccccctggtgaaggaagattaaatgaagcaaacacaaaatgtccagcacgaggggtcccctggcccaagagggctgtagcgagacgctcttcccaccctcctctgggccctgcccggttcctcccatacccaggtacctgctgggggctcccactggacaggccagggctgtctgcattcttattggtcacggtgaggacaaggtgggtccctgtggagtcggtgatgagggtgggaggtgcaacccccttgatgaggctggggccctgaggccccagaagcaactggggggcggggaccggctcgggctcaggctgcaaggcttcctgcttcaccaccacggacgggggccccggggccacagcacaagggtctatgtggttggtggctggggccgccaggctggggttgaatgggtgagcggggcccaggggctgctggctcagctggcagctggagaagctgttctcctgcttcacgggggtgccgaggggggcgggggcgggggcgggctgctgggctcgcttctcctgctccagctgcagcttgagccgctccaccagctgctgcttctgccggagcatgcgcgtcagcgcctcgatctgcttgtctttctcctgcagcatctggtccttgtcgcgcccctctagctccgcccgccccccagggctcaggcaacaggacccggcccgggggccctcctccttcacgaggatctgcagtggcgaggcctgcagggtcagctgcgtcagaggtgatgtcaccatctcaccaaaggtgtccccgggggtggagttttcatcgcccgtgctgagcagtgagcgctccgagggggtgggagacacggggggcgtggagcccgtgctgccaaacttcaccaccccactgctggccaccgtggccaccaccacctcagctggagccaggcctgctgccaccagggctggccccgtgctcagccgggccgctgggaaggctaccaccacctcgccagccttgtgcaggatagaggtggcggcaggggccttgggggctcctggcacagggctgatttggtcttgataggctcgaaggcgctcaatcagctcagttttggtgcccgagacaggcagtgatcgcaacttcagctcctgcttcagctctgccacctgcaaggcagtcaagagtcagggaggccaggggcagctggacacagggcactgggtccaggcagaagggcagtctgggccccatgggccactgcagatgcatcaactaccctaatcctccagcagcctggagggtgcaatgccccccaccacctgagccaacagcatcctctctttcattgttctcactctagcaggggtctggttaaaatgctccccacctatgcaggcaacgggggctggtacatggtgcccacagctgtccccagcccccagcccccagcatggtgcatgggctcaataaatattcaatggaacagactgtattttgcaaagagaaaactgagctcatgaaagtagggcccagcctggttcagagaacaagttctcaagggagagcttggtccaatccatcttctgatggggcagagaaaacacgcaaggcactgggcatgacccactcctctccaaggccctaggatggaagccaagtctgtggccctgatcacaggccgctctcttcccaggcagacactgcacctgaacggcagagtgagctctgcattaaccggcaaaggggaaaatgcgggcagggttgctactggacagtcctgtctacactgaccaggtctgcgactgtggacaagctcctcctcctgtcactgcctcagcctgaccatcctcaaaggggcaccaatccccacttctcacactgcatgcaacacgtaagtcgaggaagataagagacatgcgactgcctggacagatgctggctgtgctgccaacaacaggaaccaccacgaggaagctggtgtcattcaccatgaccacctccaggcagcctcagagctgtgtccaaggtgccctgtctgatggggaccagagcctaaagccctgctctgctttccatgacggtgggtcctaggctggctgccttccctgcctaaaaaccagcacccagacagcccctgtgggaagggccaggctggcagtggctcaagttttccagtggccatgtaccttcatgtcgtccaggttggccggcagggctcccggcttgccagtcagtgaggtgctgttctgacgtgccagcccacagggcccaggggcgcccgagctggagctgctattggtagtggagaggctgcgtactgggggggtcccgctgcttcccagggcctcgcctgctgacctgggaagaaaaggcagaaattagccccatccagcttcgcccgtggcctctgcaggtggcagcccaagcctgggcagcaggattgggtacagatgggcatggggcaagggcccagcaaaggctagggtggccctgcctgcagaccactctgtagcatccagaccagcgggtccttaaagatgtgaggttcacccccaccagacctggcacctgcctggctcagggtggctcggggagggcaggggcaggcagtgaggagcgggtgcctactttggcggggcaggcaggatggcctggtagttgtggtgctgctgctgctgctggttgaggatctgcagctggaggaagagctgctgctgctgcaggatcttggcgtaggatgagtccatggggggtgcccccctgtcctgcttctggtccggggggatgtactggtggtacttgagcttcttcacctttggcttcagctccttggccttcttgctgcgctgtgacttctcactggcagacttgggttggctttgctgagggcacaggagacagggtgccattcaggggcagcctcaggcttctcggggtggggctggcaactctccccacacctgtgtggcttctgagaagacatccccatccacactttgcccatttccactcttccctgtgggaccgtacaccccgtgaaaagcagaaatgtgcccagaaatgtgccaggaaaggggctggagtgacaaagagggctatgcctgacccccgacttaaaagcttctagctcaagcaaagacatcaccatgaccccaagcagggtgaacacaaggaggtaaaacccagctgactgatggagctcgggctgcgccagaccaggcaccttccaaagacggggccacacaagcctctccagaatgctgcttgctcttctcttgctctttttggggctggggggaattctgccaggtaggaactgtcgtgtctacttgaaaatggtgaacgggctcaaagaagtcacttgcccaaagtcacaatgtgatcttgttcttgttctaacacaggactccaaaagctcctattcatgcccccaaagacctccagctggcacagccactgggccaggagagtcagaagacccaaactgaccaataagggccagtaggtgatatatgggaggtctgttcttggagcaaggaagggcgcagttggacgaggtgagttagcaagggagtgccagagagagaccacggagagccgagaagttttgagcagagaatggcagacaaaagcgtacaaggctggatgtaggaacaggtggtgtctagaccttgtggcaatgaggactgaaaggaaggtttgggcaggtgacccactagtggaagaacagacaaagtgaacatgtggcaggtgagaagtgatcacagaagaggttctggttttgctgggagcatgggaaggatggagaaagggcagggctgccggggctgtggggccaggattgccccagaagaagggaacagagccacagagagcctgtgagcacaggctggggagcaggaagaagtacaggcagaggcagaggcagaggcagaggcagagaggaggcagagggcagagcctaaggagcacccccaattaaagggaggaggaagggaggcagggaaagcacaaccaaggagagggaaccccaacagctgggccaggagcacagtggtggggatgggacttggattgaggcccctgaagataatgtttcagtacactggtgaggtgactgaagagatgtgtagacaaaatacacagactcttcttccaaacgtggtaggcaaaggaaggcaacaggagtgtgaggagaagcacattggaggaactctgggggaaaagcagggacacctgctgacagtgagaagagaatgcaggtgcaggacaggcactaactgatgaggcagcacccgggcaggcagtgctgaaagcaggggtaggctgggaggagaggccactcactgctcccaaggcctgaaagaggagactgacattcaggaagccacagtgactttctgacatggaggaagcaagaggcagcagagatgacagggtcatgtgcagaggcgggactggggatgtcaccatgggacagagccagggagtgccacaagaagggcgggcagctcccagagctagtggggcctactaaggccagagcacaagcaccagacagcccaggctgcagactgtcagcctctcctgaggctcagatggccaggggttgccaagccaggcacagggtctgtgtgaggagagagcctggggaataagaaaggacagagcacaaagggtgcaggtggagcaagtcagggaggcgtgggccaggcagaggtgtggggctggggtccccgagatcctggtgagatcctggtggccaggcagctctgtggagcagggaggactctgcatgagctcttggtgcagctgaatttaacagcagacacctcagtccatgaggccagcaatgcccagcacaggtcccccacaccgacagtggtaacccccgcctcctgcaggcatttcaggccaggccttgaaggaggggaacaccactcagtggcacctcctgcatgactctggccgcgtcacttcacttctcagctcctctcttgtagcacagggctctatttctgccttgcggagttgttgagtgaacaagacataatgtgtgggaatgacttcatggatgagagcaggagtgaggacctggaatgcccaaggccagcccatagccacgaataattggtggctatgattgcaacagccagtgtcatgatggacagcagacagaacgggaagaaactcccagaccaatgggagaagacacgcaccacaccctctacagctgtccccacagctggaatgaagtcacagcaggactccaaagggcacagggaaggggagggtacaatcactggcagaaatgtaccttaatgagtgtgggggtggacttggcagtggggatagtggttccattggtgaggctgggaggcagcagaggtgggggaggcagaggaggctgctctgccaggaaaagcatttctctggaatcccggcccatcggaagttgagacacaacctgagagggaaaaagggaagtgaggacatggccacctccaggtagggtgtgcccagcctgccctgaccctacacagggtcctcagacgccaccattgtcagagggcaaatggtgggcagagaccggaggaggagaagagcaacccccagggtggcaggagcaaggaggagctaggaaagagagaaggcaatgaaaaggtcacagaactgaatatactcaagaaaaacaggctgctccaaataaatgaatacagactgggccagtgacgtttgcaatcccactgcaaggcagccatggccagcgtcgtcctccacctgacctctggctgctggagaggggccactgcccacatctcccaccaccggggagctcaagcagccagcacctaagcaactagggtagcatccccctggcttccctgtgccagagcaggaggcatcccgtggcccaggagagagaccttactctgcgcagccctagcaccttggagctggggaagcatctggaagcacacactcacctgggtgggggatgcagaggtggcactgagcagtggttcgctgactcgggcctccaggggtgacggcacagaaccctgggactcatggctggcaggctgctcgggggataaggcatcgctgctgtcctcatcgaaggaagagctgtctgctactttgggatagttcacctggcccactgaaacccaaagctggtgtgagattccacttccagcccagggaacagatgagcagggacaggcctggctcgcaggccacaggcagagtgcctggcccacagcccacatgccccgtgaggcaggcaagccgaggagactagcagccaatctgctttcttggtccaaaaaagctctggtcatcataatgaccctgcaagagaggccagaaaggcctcctaggctatcagagtgacctcatgggccgagcaaacgcctcctttagcctcttgcttgtaactctatactgtgtttagtcttcaatgtcaagttgtccctccctcccttgctcctccctgggagacccgggctacctttctacctcaaccgtctccctattgttaaaggtactctgtatcttcatcccacactgcacaaaactctcttattcccccatgatgcttacagatggtgcagtgagggctctgaaccagctaacgagggaccagaagagcctgggtaacagccctgtgagtgtagctgaattccccagaggccaggaacagactaaggagcctggctctgggcttcagatggagggtatcccagaaaggggatgtttgcctgcacaggtgaaatggaggtggtgtggtgacctcctctagaggccagtggctcacagagacccaacacctgggcaggtggggcaccagaagaaaacatcctactggctgtcactgccctggcctgacccactgccaagctctggatgactgtgaatgcaagtccttctgaggccaactggaagcagaggcaggggaggagggcgtagcacagagcttctgttccatggggtcccagtgggaaggaaagatgggaacagaggcaaggaggctatttcaagagtcactgtcagagccaccggctcaacactgtcgtgggaagaggtgggggtggcaggttctgagctgatctgccatccatacagaaggaactgaggcagtggtgaaggcaggggtgagctgccgcccaagcctggggaagtatgctgtgtgggaagaccccagataaggaagaggaacaaagcgcaacagctcaggctgggtttgtccttgcagtggctctcctaggagctcttgccctccagggccagggccaggacctgaggctctctcctccctcaggacctgggaaggatgcatctgagcttcttccttactggcgactgtggtggtggcttgctcctctgtcccctcatctgtcccagcaggggcaagtatgcaacacacagaacagggcttgctgaccatgtgtacttcatgccagacacacggctagatttcccccacaatctcctacttccggcaacggcatctgatttgggacagcagccccatggcagccagtactgacaacggtgagcaagggtggaggaactgtagcttcccccagattagtccaacccaaggaagctgctggccgtactgtggaaaacccagggctggtacaggccagggtcactacagactatttctctctccactcacagtcacatcctgggaacaaagatggggtccctgccctccaggagtttatggtccagttgccttggagcccagtgaatgctctgctagagagaaaacacagaagctaagggcacactgaggagagactcagagaagtcttcctggaggacaggacttaaagtgaaccttgacgataactgaggggcctggaggaagggtgggatggggagcttagatgtgtggggaagaccccaacccccatcagcccttttctcaggcctcagaacggtccgctcccccttctcccactgcccgcttccttcccactcatctgagccaaacttccttcccagctttgcctctcctgagccaaacctccacctcagccagggttccatttcctcgtcctcctccctcctcttcctctgaaggtgcccatcctctcatctccttgactctttcctctcagcccaaaaacctgctccattgcatccagcctgaaaatccctccttaagccagcacctgcctctgctttccttctccacagaactattgagcaaatgagctacatttgccatcaccacctccttctctcctactcaactgtacaatctggtttttgctggcaaatgctctgtgctccttaaagtccccaacaatcaccccattgccaaattcctcaaacaaacaagctgtgttcagccaggcctccaagccactgcccatgctgttccctcttgtacctctgtaccttttccacttggcaaactctgacccagcctccaagctgcccccagacgtgctatagtgtgggtacttccctggccaccaacacctgttcccatccctgagagaagtccctctgctgagctcccacagcactgacacacacatatccattgttacactgtccattacagcagctgccagctggtctagaatgagtgttattgctgacaacagcagcaaccattgtgtgagtctctctaggcgccaaggaccatccatcatcgtgtgtgatcctgcaagcagtcgcacaaggcaggtgactcagagacaatgtcacagggccatggccttcctaccaggcagcactggcatctgactgggaaccagactcagaaatcagttgtttatacattagtcttctcacatcagacctacgtgaattcttttagcgcacaagtcatattttattcatctttgtgacatcaggacttcacatggcctggcacactgctgagtctcagcacacatttatcagactgtggctggctgcagcatccagaactggcttggcccctacactggcctataactaggggctgctgaggaatacacggaggaaaccactgagatgaggcaggatgaacgccagggaaaatctgtgaattataagagctactgtatcaacatggggaaagggctcctccgggcccagtgtgggccagcctccagtagggtggctacaatgcagaggaggccctagaaactgccagtcacctctaatcagggcccaaagcctaattcagcatgcgttgggggtctgctgcagtgtttcccctctgcccaaaactaaaactcatgttagaggaaaccctgagcctctttctctgaaggcacagctgcctcaggaggggcaggcaggtgctgtcttgtcagggatcggatcttgggcccactgcagcgaaggagacatgtctgtaccaattatcaccaaaatctaagagtaggataataaatatatttggtttttgtcccccagttctcatcacagagcagctaaaacccttggaatttccttaaggtcagaagtatcttcagttatgtataacaagcccctttccacaacacctgagcttatgctaatgtgataatctgggagagactaaggattgggccagtcaccagagacaccaagtgattagaggattagaggactggaaatatcagcgccatccaccaacctccaggaaagtgggggtgggtatgtaggacatagagtgggggctctgagatcaagctctataaaaactcttggataacaggatttgatgagtttctctagctactgggagggtgaaggccaggagagggcagggaagttccaataccaccattccccctggcaccccacgacactgtgccatccgtccctccctctgactgttcctctgcatcctttacaataagccaggaaatgttaagtgaagtgtttccccaggttctgtgagccatcctagcaaattatcaagcccaaggagagggtatgggaaccccaatctatagctagttggttaaaagcaaatgtaaaataacctggggcttgggaccagcatgggaagtggggctaagtcttgtgggactgagtcctcaacctgtgggatcagacgctatctgcaggtaaatggcatctgaaaagaaatggaggacacccagctggtgtccactggagaactgcttggtatgtggggtaataccatgccagaataccaacaccagaagtattctgtattgagtgtaaatacagagaaaaacggctttttcccttttacactaaaggaatcaagtccaaactcccaagtgtgccaagaggccctgcacgtcctgaactgtgcttactgctcccacctcgtttttgtttttgagacagggtctcactctatcacccaggctagagtgcagtggcacaatcatagctcactacggccttgaactcttggacgcaagcgatcttcccacctcagcctcctgagcagctgggattacaggtgtgtgttaccacacccagctaattttttgattttttttgtagagatgagtctccctatgttgcatgttgcccaggctggtctcaaactcctgggctcaagtgatcctcccgcctcagactaccaaatcactgaggacctggcctcccacctctcatcttgacaccctcccttccagtgccttctcatcaggtcctagggttgttctccctgcctggagcaccgtcctctcctccctcgtcccaccctctcccacacgctttcatgaattcctactcatccttcagccccaggcttggctgtcacctcctctgacagctgcacccttcctgatgcaaccaggttgggtgaccctcctctgtgtttccaaagtaccctgtgctccctccagcacagcttctctatcctgcctattcacctgcctgttacctgctcctaggcgtgagctccataaggacaaaggaacttggtctgccctgtggggctgtggccttagcacctagcacactgtttgggtccatcagtatttgttaagtgaaatatccgtggaaagggccagtctccaagaagagacttcactaataaagagtatgacacagatttctaattcctggcatctccacatgttcacacacactgatcctgacatctatctactctgtgaaagaggaagcaacccgagtttacaaagatggaaagtgaacagagcaaggcctctgttattatttattgttgtatgtccctgtttcttaaagcaacaggcactatcccaagttcatacaacctgtgcatgaggctctcaaactctgtgccttggttctcccaaggctaagcaggaagtcaaagattaagaagtcaagagcctcagcccaattctgcttcagcctggcactccctcccctcctgcatctcagctgcctctcacacagggtggctgggtcctcctcaccaatgatggcttccttcaggctggactcaacaggaaggatgttcttctccaccagctccatggggccaggcctctgtgcaatcttctcattgaggtcatcggctagtctggctctcttcagcttcagctgcttggcctggagggatggctcagccgaggtctctgcccatgggagagaaaggggtgcaggaagatatatgagtggacgtggttctgccccgggaactccagagcagctctccttcctcctgggcaagaggagtgactgtcagaacggtaagcatattccaagcagagaagagtggcctgtcttgaagtttcacaaagacaagagaaggggttcccactgtgaccaggcagtgcacagtcacacacaattataaccaggcagaggcaaacccagaagactttctgaggtggagctacagaatggaagcagcaacagatgacagaatggtctccactctccctcaaacttgctgtgttactgaggcaattcacatctctgctctggtttttagtgcctttgtctgcaaaatgtgagactcagactagaaaagttctcttccagccccaaaaacagctcaaaactagacaaacggctgggcgtggtggctcacgcttgtaatcccagcactttgggaggccaaggcatgtggatcacctgaggtcaggagttcgagaccagcctgatcaatatggtgaaactctgtctgtactaaaaatacaaaaattagccaggcgtggtggcatgtgcctgtagtcccagcgactcggaaggctgagacaggagaattgcttgagcccaggaggtggaggctgcagtgagccgagactgtgccactgcacactagcctggtgacacagcaagactccatctcaaaaaaaaaagactagacaaacaataagtaaatatatttatgctgcttccaggagccaaaaccttttcttcactaaaaatgtggaaagacagctatgcgcagtggctcacatctgtaaccacagcactttgggaggccgaggtgggtggatcacctgaggtcaggagttcgagaccagcctggccaacatggtgaaaccccatctctactaaaaatataaaatattagctgggtgtggtggcgctcgtctgtaatcccagctattcaagaggctgaggcaggagaatcgcttgaacctggaagataagaggttgcagtgagccatgatcacactactgcactccagcctgagcagcagagcaagactccatcacaaaaaaaaaaaaaaaaaaaaagcgggggaagaaaaaaaaaagggaaagacatgtgcagctggggccaggtgggtacatctagaataatattggatggagcacggtatatcacagacactcaagtgaatgccaagtgaatgactgaccgaatgaatgaatataaaaaactaagtaagtgtattttaaaaacagattttagatcaggcatggtggcttgtgcctacaatcacaatgacagagtcagactgtgtcttaaacaaaacaaaacagattttggcagagagaagcgatctcacaccaagggatggtgagaccctggagaagaggccaagccaaactaacagcatgtgactgtgctttttgagagtccctcagaccagtggcagctaccatggcacagctgtcgtacggtgttaaggctctggcttacccactgccaacagaaatgggagaagaaagaggcaggaaggaaatgggtagtgcagtagtgagtacacacagtgagaactggatctagatggaaaagcaattccaatctccacaccttccaaaatgtgcatcctgaccagctccgatctctccggccgggaacgaatcttccgtttgagatagtcctctgtctacagaaaaaacacaccaagaaactctcaaatccaggtcacaggcttatggcatggacaggatcacaacagcagccttggccatggtagctgctgaccacctctgcagttcccacaaccttaacttggtgactgcagggttcggaggcaagagtaggcctggggagagcacaccaaaatccaactgcacctgccaaggaagggcaccatccttcaagaccatctgtgtctctgaggctggactgacaatatatctattaaaaaactattacttctactaccataaaagtaatatatgtccagcaaaaaacatttagaaaactagaaagaaaaataaaataaaataaactttaatcagccactcttagtattctgggatatctgtttctagttattcttccatgcagaaaataggcttaactttgcagcgctgtaatcacactgaatatgattttatatcctgctttaagaaatgtaacattgggccaggcacggtggctcaagcctgtaatcccagcactttgggaggccaaggtgggtggatcacctgaggtcaggagtttgagaccagcctggccaatgtggtgaaaccctgtctctactaaaaatacaaaaattagccagatgtggtggctggcgcctgtaatcccagctacttgggaggctgaagcaggagaatcacttgaactcgtgaggtggaggctgcagtgagccaagactgcgccactgcactccagcctgggcaacaagagcgaaactccgtctcaaaaaacaaacaaaaaaaaccaaaaaccaaaaaaaaaccccaaaaacctgtaacactgcatgatctcatgggcattttccattcattttgaatggctgccaaatggaatatgaattttgacacatggtagcaaagctctagttcctcaaagtccaatgtcctaatttctgcatttatgagactctgggcaaactaaaccagtccctcaacagtcacagagccatcccaccaaacggggctaattataatatatatatattcccctggacctgactctatagagtctgtgctcttaacctctgcaccaacattttcaaaccacagaacattagtggatcaagaccagcataggataagacaagccaaaggacactaggcaatgaagcctcagaggacattatatatagtaaaggtaaagactggaaaaaaatgaagaaaaagaaaaaaaaaaaaagacttgtcctcacctagccatctgctgccttgttgttctggctgggcagctctgtgccagcccaggggaggctgagcaatccaggagatggtttaaagtgactgtgggctctggctctatcaccccacgtgcagtgggcagaagtactgcctcagctgcagcagagattggtagagcaggtgccgcaagtcttcacagatgacagtggaagacttattctctaagccatctgaagctctgaccagtggccatgactgaggtagaatatagtactgattaagaaaatatatggaggagcttctggtttgttaaaggcatggaggtgctaggagggtgacacacccacctggagagagcacaaaagctcctcatcccttcccacatacctacacatctcttccacctggctgttcctgagttgtatcctttgtgacaaatagtaaacatattaatgatgtcaaatggctgaaacctgactacctagaggctactctggactggtttagagggtataaggtctctgatggaaaaccagagaactttcagggccaaatttaaagatacggattttgcaactgatatcattaaaggcattcatgaccactgaagcacatttgtgtcgaagaaaactgagggaacaaaatcagtttgacaaggtacagtggtagatgcctacacatcccagctattcaggaggtcaaaggcagaaggattgcttaagcccaagagttgggattcagcctgggcaacatagcaaaatcccacctctaaaattacaaaaaaaggaaaacaaagcaatcagttgtgtaaatacaacagcatctcagagcccctcaagtgtgatcctgacatagctgaagccattgtggatgctttcccaccaccatgtatagctgccttatgtagcacgcacagatgtgagcagctggttccaacaccagaaaaagaaatgaaacttctcttgaatacgagctgatattgctgtgtcttattcatctggaagtatgagatgcaaaagtagcagcttttcaaagctttaagcttttagaattaagtaaagcaaattctgctataaccaatccaatatattcatgtttcatatctcaactaagataatttttagtacatgtgtaaatatggaagtagttattgtaatgtggaagtcatttgtgaatagatgtgcatggtaagcaaattgaacgttatggttaccatgtgttaggaaataaaatcattttgctcaaaaaaaatctagaatccacaaaggtttgactcccagctttgccacttattggctggacaagtgagttaacttctcttagctgcatctataaaatgaggataataccacctaattcataagagttgatgtgaggataaaaaagaaacagatacaacctcttacataaaggtgctcaataaaacagtctcttctaatcagctctgctggtccctgcctatttgagaagcagtcaagtaaatggtgcccagtcttctgaccgaataggcgcacaggcaacgccatcctttcccccaacactgtactctccagtgctctcagcaaactaaaccactgctgcttgttactcctttggttcccaggacccatgacctcattctttccacttactctaagaattaatcatgattttctggggagaggggaatgaaagaaagtttaaaaaaaaaaaaaaaaagtcttggaggtaaatatttctgagactctaaaatagctgtgaggctgggtgtggtggctcatgcctgtaatcccaggactttggaagggcaaggcaggcagatcacttgaggccaagagtttgagaccaggctggccaacatggtgaaaccccatctctactaaaaatacaaaaattacccaggcgtggtggcgggagcctgtaggtccagttacttgggaggctgaggcaggagaatcgcttgaatctggtaggcggaggctgcggtgaactgagatcacgccactgcactccagcctgggtgacagagtgagactccgtctcaaaaaataaagtaaaataaaatagccgtgggtcttaaggagatgcagcccatgatctgtctagggggattatcttcccatgattttatgtgaaaggaaaaagtaaagggagtgtgagggggaagcaagttctggtgacttccccatctctacccacactgggcagcagaatattcctcaggggcccctggggaaccgaaacagagttgggatggggacgcaagtaaggtgctgtggcagaaaacttgggcttggagtgtgggccagtttctgctttccacaagagtcaagtggataccacctactctgggcagatggagaccaagaaggtttcctgccccttggaatgcccgtcctgtgaggtgtggccagtgtaaccccggacttgggaagcttttccattggctaatgtttgtgtcccaacatctacaaaacgttaagtggaattaaagatggggaaataccagtggtctccaaagcactccaaaattcaggcaaggaggatcgggtgatcattccatatccttaaatgtacaaaaagagaaacctcattccaatcatgttccatataatcaccatgggaggtaaatgagagaagggatgaagtaggagaagcagagctttccatttaaaaccacaaggccagggctggccctagagtctagcaggctctggcctcagagttctatggaaagctctaaatggaaatataaccagcaatgcaatgagctctgaaaatgctctttgggagttctgagggggaaaaaaggtaccttaccctggcccgctccaagctccttctctgctcatgaaatgcggctggacttttcaaagctgttgagagaagaaccgtaaagattaccttcaagcgaagcatcatgtctagtgctacgatattcagtggagaaggcatcttaaattcatgttactggctgggcgtggtggctcacgcctgtaatcccaacactttgggaggctgaggcaggcagatcacgaggtcaggagatcgagaccatcctggctaacatggtgaaaccctgtctctactaaaaatacaaaaaattagccaggcgtggtggtggtgggcgcctgaagtcccagctacaagggaggctgaggcaggagaatggcgtgaacctgggaggcagagcttgcagtaagccgagattgcgccactgcactctagcctgggcaacagagcgagaaaccgtcccccaaaaaaaaaaaaaaaaaatcacattactgttagtagtactataaatatcagttgaagtgaaggcaatgacacctgagtaagcatgtatctttatggtttagctaccccattcaaacagttttggtagaaaccaaaatatgactcctaatgggaactgtcactgcctaagcttgggctatataaagtgcacccatggaatgtaactttaacaaacaccctggcccatgactggaccgtcagccgcaaatcccccttcagctaggactccaagaacgcctgctaggcctcacattattctcaggacacctgcacacaggaaggggcacagatgcatgccaaattaaccttacttcctcaacctcacgaggaatcataaagtggccaaactgtttcaatgggacagttaaaaccaaaaagatatatgtccactcggcactatttccttcttcactgcacctgttatttatagtgctgctaaaattaacttgaatttcatctctaaggactaaaagaaccccatggcaattgtatgtgaaggaacacacacaaccgacagctgagacgaagggctcagctctattctggggataccacacaaagaccacaagtctcgacttctgcaaacaacactcaggtggcaagaccaaaccaagagcctccagaaaggctgcaccatgaatggaaggtctgactccttttgtcaaaaacttggctgtaaggacaaatagcaacttaagacactctgaggatgagagggaaaggcctgactcacttcaagtagggaacagaggcaataagagagaaatttataagactgtggtcagtttcacttctcctgccctagaatttccaaagagctgtgaaactgcgagcagagataacttttgctaggctgctggctgcggtaggagtgcagggttaaggagctgctaaaagtagcaagagagcatagataggaccctatcctgcctgggccgttgtgcttcttcctccttcctctccacccccagcggggggctgggcctcagcaacagcagtcccagaagaaagcttcaattgtcccagtggtatttatttttaaaaattttttgtgaatcttaagataaaaaagaaactacagtcttaaaagtactactgagatcccatcttctaacagaagggggagctctagatttaacaaataacatcaaagaaaaaccagtacaagttacctccccaacctacctgggcactatccaggattccccacttcttacatgggcaggtcgtgggcatttcagtgggtaaatagacaccccctgcacctgcttctactgtgtaacgctagctcaactccaaacgtcctgctctgcaggaacccgggtgtgatgcatcacacgtaaccttggctcttggaaagcttagcacatgcatgagacagtaagtacaaagaatcaagagaaaacggacactgtccaccccaccccagcttccttttctgcctcatttttctccgcagcactcatcactgtcttgacagtctttatataaatactacgtatctggctgggcatggtggctcacgcctgcaatcccagcactttgggaagccgaggtgggcagatcatgaggtaaggagttcgagacgagcctggccaacatggtgaaaccccgtctctactaaaaatacaaacatttttgtacaggcatggtagagggtgcctgtaatcccagctactcaggagactgaggcaggagaatcacttgaactcaggaggcagaggttgcagtgcgccaagatagtgccactgcactccagcctgggagacagagcaagactccgtctcaaaaaaaaaaaaaaaaggcggaatactacatacttttcttgtttactctcagtctcccacgtttacatttacaacatgtccccatcagagcacagcaagggttttgtctatttttttagtcactcacagcattccccaagtgcctagaataccaggcacacagtataccctcaataattattcactcgatgaattagtgagtattctgtaagaaacggacacaaggtgactagtgacaggaggacaggaggattctgcggcagagctctaaactttcatctaaacagccagaattctggttctcaaccgggttcgaaacctcacagaagttctggatagacagtcaagggatctgtgttctagtactgagtgctaccaattactgctgggtgacatgggttttgactgctttctgggtctaattttcttccagagtgagaatctgcccacctctcagaacccttgtaaggaagaaacaccagtgagagtgccctgaaccaaatggtatatgtgtcgatatattcaggtgttgctgtcaccaaatgctgtaatttggttgaatcactggcttgattcacttacaggccagctagtttctgtaccacagccagagattctctgtctaaaaccctggctgacttgctgcctcaacaacccacactggctatccccaaagggtaaggcacaaacccaaaggcacaaacccaacttctagaagaacaattcaccagaacatcttgaggacatcatcttcatgtacaaagggtggtgcaccactagtggaggacaggtgataggtgaaatggctacagcatacatagtccccctcatctgcagtttcgctttccatggtttcagttattctaggccaaccaaggtccaaaaatgttacagtattttgagtgggcccatattcacataacttttattacagtgtattgttaaaattgctctaatttcttactatgtcagatttacacatcgaattttgtcataggtcacatgtatagaaaaaaaaaacacagtacgtataggatttggtaccatctgcagtttcagatatccactagggggtcttggcacgtgttcctcaggaataaggaaggattactctatatgaattcctatttggtcctattaaggacattttcatgtaatggcaagaaagggattaatatctgttggatgcttgtatggaaagcactgttctagatattttaaacctgttagctaatttaatattcctaatcattctacatggtaggtaatatcccattttatagataaggacagggccaaaaaggaaaggcaagcaaatagcagggataagattataacctaatttttttaagtgtcctgaattggaagatataacctaattctgtaacaccctcaacctagagttctttccactcctctgtgttgatttcttaacttcttcaaaagttagagaagagaggctgggcatggtggctcaagcctgtaatcctagcactttgggaggctgaggcaggtctatcacctgaggtcaggagttcaagaccagcctggccaaaatggcaaaaccatgtctctactaaaattacagaaaaattagtcaggcatggtggcaggcacctgtaatcccagctacttgggaggctgaggcaggagaattacttgaacccaagaggcagaagttgcagtgagccaaaattgctccatggcactccaacctgggtgacagagcaagactctgtctcaaaaaaaaaaaaaaaaaaaaaaaaaagagacagaagaaaagaaactgttgggtagggggacaaggtagcttcaatgttcaatgacacacactgtttagatgcatatctgagtccaggcaacatacaagagtcaacttggccacagcactaggtaaagaccaaggcaaagaaggctcagaagaggggttcagagacctgtctgaggggccccagggctctcaagcattgagaatcatcgttcaaaacctggagctcaccacgtaacagcctttggcactgatactagaagacaagttggagaagctgagacacaatagctggtcagaagaaccagaaacgaagaccaagaaaagaattcaagatagggccaggtgcagtggatcatgcctgtaatcccagcactctgggaggctcaggcaggcagatcacctgaggtcaggagttcaggaccaacctggccaacatgacgaaagcccgtctctactaaaaatacgaaaattagctgggtgtggtggcgggcacctgtaatgccaactactcgggaggctgaggcacaacaatcgcttgaaactgggaggcggaggttgcagtgaaccaagattgcaccactgcactccagcctgggtgacagagtgagactccgtctcaaaaaaaaaaaaaaaaaaaagaattcaagatcataatgaccaatcccaaaagactgtttcattttatagtaataataacattataatctcactggatcctcttcatagcccatgaggcagggaccgttatttcatgtgtgatgaaactgacactggctgagatgcagtaacctgccagatcattcattcatcgagtggtggaccccaacccaggtctagttctgcctttcctttcttcccttgtctaaaccttctgacaaatgtgtcagtttctctcagtccctgagtaggccagcttagtctgtgctcctctttcctcatttttaattcttctctctgatagcagattcagcaatttcaacagctacttctgccaggtgaaaggaggagggagcactggcccctcttccttcaggtttgtgtcaggacttcctgctgggtgtctctcagttcatctggggagaggctggagtagccacagcaagtgctcttggtgcactggggtttgaggtggagagggcaactcctgtgtgtgtcccgccagctttgttaaaagccaccatgtggagggtagcctagtgaagggatgtaagagtgctacaggttaagccctgggctttcttgactgtaggagcaaatgacaatggggagtcagatcacctcaagttccatgccaaggaggtaagacacgaggaagcagaaaataggtttccaagtttaggcctctgccaattgaagaaaaaaaggacttaaagttaccccataaatgtgtgtccaactacgagggctgcattcatcttagactccatctcccctctccctgctaccttaatagctttgctaggaggagccagcatattactcaaaactgcattttcccagacactccaagaaagcagtctctagaaagagaagcccccaaagaccaatgcaaagacaagagtcatgtgtgtttataagaatatatatattcaatatcagagggtagttctcgatcctttcctgctgccccaggagctggttccattggagctcttgtgtggctttgtgtgaacaaaggaagtgtgcagaaaatcctgaaaggaaaaataagcaagctccccagagaaaacaaatgaacagaagtggccaagaggtgtgccattcttaatcacagtttcagttctagatgtggaccccgcccctggctggctacaactaccaattaatattttgttccctctttccagcacccattttctttctctcctaacttgtttgctgcctaaattaaatgaggtcatttgtcaattaaagatataaaaggtgaaaaactgtttccacttaatttttaaatacatactggcatccaggctgggcgcagtggctcacgcccgtaatcccagcactttgggaggccgaggcaggtggatcacctgaggtcaggagttcgagaccagcctggccaacatggtgaaaccaccccccactactaaaaatacaaaaattagctgggcgtggtggtgcgcgcctataatcccagctactctggaggctgaggcaggagaaatgcttaaacctgggaggcgaaggttgcagtgagccgagaccgtgacactgtactccaacctgggtgacagagcaagactccatctcggggggaaaaaatatatacatgtatgtatgtgtatatatatatatacacacacacacacacacacacactttcacacaggcatccaatatatagcaaaggaggagctcagtgctgtgctcagtgtgtcgacacagatgtgtgatgacagcgcaggggccccagggccagaatggtcttgatttaatctggcactgaagagtaagtatgaagactcttaaaaaccaacctaccttggtaatttaggacatcaagccaacacttttcccttgccagctccagatttacttaaacaagtaggtaaatgagtcttctaggattcacaagcagttctagaaatgcctctgagcaaggaatgacaacaattcattatgaaacctcatttcctcatcactatcatgaaggaatatgtattaagtgtctaggtctgaatgttgctttattaggtgttatcgtaataaaaatgatggttcctatctctgataatacgccagaagctcaccaacaattctgtaaccagaggaactcaaaggctatgaacataatacacttaatagaggtcactggagtgccacagtccaagcagcccttctttcaggcaagcctgctgggtttctttttccagtgtggaagcagggagcatatacacagaacatcaatgagggctacatgtgtgtataggaataaacccatttaacaaacgaggtagaaactagaaatatttccatccatccatccctccatctgcccgcccacccacccatccatccatgtatccaataagcagcccttaagtaagcactatgccagtcactgaggataagaatatacagatggggtcccagtcctcaaaaagatgatggtctagtggggaaaagagacaaatataagatggaagtaaaacagtagtggtaatttaaggtgctgtaaaggacaaaagaggcaaaatttaacctgggggaacagtgtgtaaatgaattgaataggaacaccaaagccagacaaggaagagtggggagatagctgaggctaaggaagaactagaacacaaacatgaaggtataaaagaacaaggcaagctcaaagaactacaagtagtttgatatggttgaaccaaggaattcaagtgaggataatgtggctagaagaataagctgggcccactccattaagaactttaatgggctaggcacagtggctcacacctgtaatcccagcactttgggaggccgaggtcgggggggatcacttgaggtcaggagttcgaaaccagcctggccaacatggcaaaaccccgtctctactaaacagacaaaaattagccgggtgtggttacgcacacctgtaatcccaactcctcaggaggctgaggcaggagaattgcttgaatccaggaggcagaggttgcagtcagccaagatcatgccactgcactctagcctgagcgacacagcaagactgtctcaaaaaaaaacaaaaacaaaaacaaacaaaaaaaacttaatgtactactgtagaggcttctgcttcagatggggtagacatttttctgtatttttgtcactaagtactagttaaaactctgaacattctatatgaaacaagcaaaagtagatactgtaaggtggagagaactagctagggaccatgggacccaaaaaaagagacatggtggtaagttccccaccccctccctttttttttctgcttcatatatccaggcttaaagctgaagatgttggcaacccaaaaatgccaatgggtacagacaaaaaaaagccctagcaaaatatgttctctctagccaaaggattaggaaagggcagcccagcacaacagaaaacttttagatacttgttctactccaaataccacagaaaaaaatggtggtctcattcccacctccccctaaaggccaagttaggaatctagacttccatccttgcaagggtgtaatgagatgccccaatacccttggctggggtggtgtcagaaagggccaagtaggaagctgctttcattcccaccagccagtaacaaacacccctccctatctggcattcataaggcacctctcccagtccctgctggatgatgtcagaggagggctggtggagagccatgactttcgccactgcccagtggtaacagcatgcacccccaccatggtgtgcatacagactacattgggagctggaactctcgccccgaatgagaagtccctctcctaccaccaactcagatgtcagtggctgccaaatgaggaacctgaacttctatttccacctggtcataacgagatggcaccatccccaccttccctactgaaccagattcaaagggtcagctaaaacaggaaagaacatacagagactcctaacatattacaaacatattacagcagaataaaggagacaaaggaaagattcggtgaaccagaatacagaatagaaatacctaatctgaacaacagaaagaaaagagactggagaagggaaataaaagaacagagccccaggagcctgtgagactttaataaaaaatctaacattgtgtcacagaagtgatgaaagagaggaaaaagagggtggggctgaaacagttcttacattaattgccgaaaacttcccaaatttggcaagatatgtaagtctacagattcaacaagccaagttaaaccccaaataagataactggaaaaaaatttatagtaacataagccataattaaactttggaaaactaaaagaaaaaatctttacagtcagagaaaaacaatttgaatgacagcgtatttctcatcagaaaccatggagcccaaaggaaatggcacgatatttctcacgtgctattaaggattgcatcctgagatcgacgtgtagccaccacattcatcagagaagggatatgtggcaagggaaggatataatcagaactgcatggaggtgggcaggggagttgcttctgacttgatgttttatgttttaaaaaaaaaaaatgagggcctggtgcagtggctcacacctgtaaccccagcaccctggcaggccaaggccagtggatcacttgaggccaggagtttggcaccagcttgggcaatgtggcggcacccactctacagaaaaatttaaaaactagtcaggcatggtggcaatcacctgtagtcccagctacttgggaggctgagatggaagaatcgcctgagctggggaggtccaggctgcagtgagccgtgatcacaccactacactccagcctgggcaacagaataagagcctgtctcaaataaataaataaaaattatcaagaatacacctggtgactgccatatattaatttcattacccccaacatacacactctcacaactcccttccctccctcaattttgcacttttcaaacctacagaaacactgaaagaacaaataatgaacagctttataactctgacctagattgaccagttatcttttagccatatttattctctttctctcatataccgtaattttcttcacttatggaatcacttgaaagttgcagatatcagttatgacattttacccctaaattcttcagtgtgcatttcctaagaataaggacattttcttacataactaagatacttttatcgcacctgaaaaaattaattcaatataacctacagtccatatctgaatttcctcaattgcctccaaaatgttcttttatagctgtttagatttttcccccaagccaaggggtttttttttgttttgttttgtttttgagacggagtcttgctctgttgcccaggctggagtgcaatggcacaatctcgatggcgcaatctcggctcactgcaacctccacctcctgggatcaagccattctcctgcctcagcctcctgagtagctgggattacaggtacccaccaccatgcccggctaattttctgtatttttagtaaagacggggtttcaccgtgttggtcaggctggtcttgaactcctcacctcgtgatccacctgccttggcctcccaaattgctgggattacaggcgtgagccaccacacctggtcccaagatttaatcaagaatcatgcactgcatttggttgttgtcaatttggtcacaatctagaacagtacccctacctttttcattttcatgacactgacttaagtatctaagctgtttgtcttgcacaatgttctgtattctaaatttgcttcctcatgattagatttaggttaaacatttttggcaagaagaaaacataggtatatgtacttcttaacatcaaggggcatatgttatcaggctgtataaccagtgatggtgctaaaagtttgaaaggtgacaccagatctgtctttgtaattaacacataatctatggggtatcattttgatgccacgtgaaaatcctgttttcccacaactaactgcctaataacagttttagcatctactgatgatccttgtctgaactgatttttacaaaattgattttttcaataaaattgcaaaatagcaaggactgcatttttatgatcactctagtaatgttcaagaggccacttaaaagaacaaattggagtgactgggtgaatggttgtgctattaacactcctggacaggtgatccagggcgagtaaacttagggaagtgggggagaaactgtgttctgtcttggagaatcacagaactcaaggacaggcatgaagagagcccacccagcacaggaatctgaggagggccacagaggcaggaggggaggaggcaaagctattaccccaagtaagcttcaagaaaaagcctgtagacagaaagacagagagacactaacagtggggaagtcaggcaaaataaggcttataaagtttccagagaatcacttatgcttaggacatagccagtggtctcagagctatgccagtggattggtggaagcacaaacttactgcaacagattaaagagtgaataagaagtgagaaagtggagtcagaggtatgtgtcccctaagaggttacttacagatgtgctaacagttcattactcattcattcttccaataaatatctgcgagcctacatgtgtcggaccctgttttagtgttgggttattcatgttttcgtggagcttatacttaattgaagaaagatatacataaaacaaacatgtaacacagtaggaggcagtatatgctatgaagaactataaagcaagttataagtgacagtgatggggtgaggtcattttatatggagtggtcagggaaagactttctgataaggtgacatttggctgggggtggcagctcatgcctgtaatcctagcactttgggaggccaaggcaagcagatcgcttgaggtcagaagttcaagaccagcctgggcaatatagtgaaactccgtctctatgaaaaatacaaaaattaggcatggtggcgcgcacctgtagtccgatctatttgggggagccgaggcaggaggactgtttgaggccaggaggttgaggctgtgatgagctaagactgagccactgctctccagcctaagtaacagagtctttgtttcaaaaaaaaaaaagaaaaaagaaaaaaaaagtgacattggaggagagatgtaaaaaaagggagtgagccctgcagtcctctgggagacagccctccaagcagagaacagcatgtggaaaggctctcagtgggatcctgcctgcatggcatcaaggaggccagggtggcagaaaacaagaagagtgggtggaaacacagggagacaaagccacacaggaccctgtaaaactgtgaactataatgagaagaaataaagtagaatggtgcctgcgaaccttgacactgacaaaaaggcttctgaggtaacataaataaacaggtttgctgaaaatggtctccttgttttccccaataacctccacaatgtgttagaaattacctcacttcagcttctcagtacttactattttccacattttacagttgggaaatgactttcctgagatcacatcctaatcaactacagaatgaacactagactctggttcttttgattccaaatctttttatttacatatatttcatcaagaggtggcagaaggtaaaggagtatagaaaacgaagtgtgtgatatgcccggtgtggttgtaattccaacactttgggaggccaaggagggcatattgcttgagcccaggagttcaagctagcgagaccccatctctacaaaaaaattagctggggctgggcgtggtggctcacgcctgtaatcccaacactttgggagtacgaggtgggcggatcacgaggtcaagagatcaagagcatcctggccaacacggtgaaaccccatctctactaaaaatacaaaaatcagctgggtgtgacggtgcacgcctgtaatcccagctgctcgggaggctgaggcaggagaatcgcttgaacccgggtagcggaggttgcagcgagccaagatcacaccactgcactccagcctgggcaacagagcgagactctgtctcaaaaaaataaataaattagctgggtgtggtggcacacccctgtgatcccagctactcgggaggctgaggtgggaggatcacttgagcccgggaggcaaaggttgctgtgagccaagatcacaccactgcactccagcctaggcaacagaactagacctgtctctaaataaaaaaccccaagatgaaacaaaatgcatgatgggttaccaaataaataacagacaacagtgattttaatctagtctttcacatttggccatcttttcctagctattcctttggaaataaatgctgccttgtcattttctctaatattggcaatgagacagcagggaaggcttcagatctaacctcagaaaatgtcaaaggggcacaaattctcctatttcttttcccttcagcacagcagaaaagagagtcactgtataatcaaactccatccaaagttaactgagtcttttgccacatcctttggccctagcattagtttctcatacagctttaggcagttaactgacttgccaaaaatgaccagcgatatggtacaaagctatgagagaggcaggcaagccaggcttttccgagcattggagatgaacgctcagaatttttctgtacccagtcatcttatatgcaaaagcgtcagctgtcttagaaatctgccattaactctcagccgggcgcagtggctcacgcctgtaatcccaggactttgggaggccgaggcgggtggatcatgaggtcaggacattgagaccatcccggctaaaatagtgaaaccccgtctctactaaaaatacaaaaacaattagccgggcgtggtggcgggtgcctgtagtcccagctactctggaggctgaggcaggagaatggcgtgaacccaggaggcggagcttgtagtgagccgagattgcgccactacactccagcctgggtgacagaacgagactcggtctccaaacgagaaaaaaaaaaaaaaaaagaaaagaaaagaacggaaatttgccattaactcttgaatcatggggacagggcaatcttctacttcagaactcttgggaagaagagaataaaaatattctgtgccacactaaaaatgaaaaggggaaagaggccagcagtccacagcccagggtttctccaagtgtagttcaagaatcatttgcatgaaaatgtctgtggtgtgcaagaatctcttggaatgcagattcctaggccttaagaataatctttagtaagctctttgggtaatgctaaagccactaaattcggaaaacattgcttccctaatctaacaaaggcaaagaagaggtgagaaagtaagaattttatttgcttattctctaataccaggtgctgattaaaactacacttagtaaagaaggacttgctgaattttctcaatagcttgattcaaaatgtcaattctgttggctgtgtgggtaaagagttttaatttcctggactcctttcaggatcattgcaatgcatatttttctgggagtcagagaatctgggctttttgccatcttcctcacaccctggctagggcttaattcagatgggatggattccacaccctgatatttttatcaggggcatggtagtcacccaatggaaagcagctacagaaatgtagtccttggtcttagcacccaaaaggtgaggagcacagaggttcactggtagtgcagggaatggagagggtccctcacacactgagtgacagaagaggttggctgtgtcactggtatgtaagggttgacactagcattagataggatttttcttaggattccatatccgggtagatcagaatctcttaacctagagcacactgtacccactttagagcagctatagatccctggaactatgtgaattttaggtgcttgcttagacaactctgagaggatgtggaagattccctatgaagaatatatggcacaaaagaaatcaagaacctctgatgtaccaaagggttattatgacagaagaagaaagatgcccatggccttcaaatgaacagcaacctgaaagcacttgtactgaagcgcttacaaatgacacttccaccacctgatctcaccaactatggatcctgctttgatgctgttttcaattttctttttttttttaatagtgtatttatttattcatttttgagatggagtctaactctgtcgcccagcctggagtgcagtggtgcaatctgggctcactgcagcctccatctcccagattcaagtgattctcctgcctcagcctcccaagtagctgggattacaggcgcctgccaccacagctggctaatttttttttttttaaagtagaaacagggtttcatcacattggccaggctggtctcaaccacctgacctcaagtgatccacccacctcaatctcccaaagtgctgggattacaggcttgagccaccacacccagcctcctcaattttcaaagattttttaaagttgaaattttggcgaaagcatagcaggctgtcatcacaaaaattccaatgtggacaagaaccagtataaactgtgactttcaggaattagcacagggtttgtagccagaaaacccggattgggtctgcctatctttcagtgcccgtgtaacctacagcaagtcccatgacccctctgaggctcagtagcctcatctgcaaaatggcaattatactaactgctgcactgggtaattattagcattaaaatgaaagtgctttgccatctgctagaagctatgttaagtttaagggctgttactgatgtagcttttttcctttattaccattctggaagaaacagcaggtatatggagtcaaatgctgagagctaattggaccgggcttgacttccattttttgtctttctgtttttagctgacacactaaaaatgcctacaaaaatcctttaacaaagaccatcaaccaaagagttgtcaacagttcgagagactgaccatgataaatgagcaccaaaattaagttcatgtgaatcaatgaaagcatttgggtggcggggtgtggagaagggactgcatattctggggcaagcaacgatccaaactagcagtcataaagggttcttcatacacatcctgttttggtatgcacgcttgccaccacccgttttggcaccggctatcacccccacccaaaccagcaggaagaccaactcccaagaatgaatgtaagaagtggagacgcaggatgctcaatcttttccttcccaagagtgcaaactgttccagcgtctcctgctcttgacccactgatggtcaaagaggctcaagactgagacaggtgagcacacaatctcatttagcacgagtatcgacacagggaattccaaaaggttaacataccagtggtcaaatattttgaatctgaccttctaggcttctctttgacataggccaggcatgtttatatctagctttcataccacagcccagtctaagaccctggatcagtctattttcactccagtatactttttggcaaagtgcaaaccaatttttttaaaaaagctactgcctctttctgaagtccccataatcaatacgtctaagtgatctgtttagaatacaaattccaggtcacctgtgccctcctgcaaataacatcccacctggctgaagttttttttttttggttttttttttttttttttttttttttgagacagagtctcaccctgtagccaaggctggagtgcagtggtgtgatctcggctcactgccacctctgcctcccaggttcaagtgattctcctgcctcagcctcccgagtagctgggacgacaggcgcgtgccatcacacccagctaattttttgtatttttagtagagacagaggtttcaccacgttggccaggatggtcttgatctgttgacctcgtgatccacctgcctcggcctccccaagtgctgggattactggcataagctatcgcgcctggcctgaagacttttaaatcaccaccatcatcagttatctatcaggactccccttgggcatgtgattaagatgtgtattgttcaggtaaaatagttgagtagtacctacaagtgacgttataaccttcttttactcttgataagaagttagccttggatatctcagattcttcaataaccaattattaatgaaacttaacacctgctgtactttttagacatcaaactgtaacaagaactcatatcaaaaagactactttcagccaggcacaatggctcatgactgtaatcccagcactttggggaggtcgaggtggacggatcacctgaggtcaggagttcgagcatggtgaaacctcgtctctactaaaaatacaaaaattagccgggcgtgggtggcaggcgcctgtaatcccagctacctaggaggccgaggcaattgcttgaacccaggaggcagaggattcagtgagccaagattgccccactgcactcctgcctgggcaacagagcaacactccgtctcaaaaaaaaaaaaaaaaaaaaatgatgacgactactttttatggcctattcaacacagctcatggttggattcttcttcggaccgaaccatgaatacactcagaacatgaacacaccactcactgcagagtattatttaaggatttgttggcaactggccaagaaggaggttctatgctagtcactgatcactgaggtagaaacacactctacaacagcagaagcgagacaaggatgttgacacaaatgcaacgtaaaatgcctgggactgatgtgccttctcctgtgataaaagagaagattcctgaagccacatacctaacacaattttctctcagcttcaactctagggatcaggtcagcctcacttctggaaaacatgtttcactgtgatgtttatcaaatgcaacttaaactagggattcaactacaattacacagtcacattcctgtagtgaggacacatcatctcactaggtagggttctctgcctcttaaagaatgaaaagataaggaaacgatcaccaaatgggttacaccaccatatcctgcaactgagctctgacggaagcgggagtccgagggcactgaccggactggggcagagggccaactgcaaggtttggggaaagccttttctgggctcctattggaaaggggcactgggtggatcatagccaaacttctttgacacacaggggcagcagttgagagatgatcacacagagctttcagtaactcccaaatggactagagcgtatgagagatgataaaggcccagagagagaggatttgcccttgccttagtccccacccaaactcactcactgatgaagtatccactgagacttaatgtctttgatagtgtaacactccacttaaaagcaaacaagtgctattttcttgaaacctacaattttagttaaaaaaaaaaattgttaaaaaaaataggagtggggatggaggacagatcactctcaaaccagaccctcatctgccctggaatcactactgcattcccactggtaaacatttctgtctcttggtaagttgcccagaaatttaaaaacatttctaacacagccacttgtttgtttgctttcaagagaaagaggttaaaaagaaacatctactcccaggaagagggcaagctcataaaatgatagtcctgctaatatatgaccaaaaggagaatgatcttaacagagtagtaccatgctgactagtggttctttgatttctaacaatttatagcaattgtcttttaatccactgataggaaagaaagtaaaattaagaactgtatttattggaaaacagttcctattccttttgggtgggggtgtgagggaggcagggtctcactctgttgcccaggctagagtgcagtggcacaatctcagctcccaggctaagcgatcctcttgcctcagcctcctaagctgtgactacaggcacttgctaccacatccagctaatttctgtattttttgtagagattagatttcgccatgttgtccaggctggtctcaaactcctgagctcaagcaatccactcaccttggcctcccaaagtgctgaaattacaggcatgagccactacacccagcccagttgcattcctaaatactagttttgacataacttagaggtaggtgtgtgtgtgtgtgtatattaaagctgctttcatagtcacaacatcaagatggtggatccaagctcctccattcttaaatgagaatattacttcctacatttcaaaagcacgaacaatacatcatctcatttgatctccaaactcactctgtgggtaagttatcactccatgggtaactaattctgtgagtaacctttaagatgggttattatcccaactatatgaaactgggagttcagaaaagttactgagttgcccaaagtcttctaactcctaagtaacagagcaaggtctaagactctctttcttttgttcgtatgcatgtatgtatatatttgtgtatttatcttgagacagggtcttgctctgtcatccaggctggagtgcagtggcatgaacacagctcactgcaaccttgaccttctgggtttaaggctcaagccatcctcctgtctcagcctactaagttgctaaggccacaagcatgtgatatcatgcctggctaatttttaaaaactttttggagagatgggggtctatcttgccccagctggtttcaaactcctgggctcaagagaccttcctgccttggcctcaccatgtgctgggactgcaaatgtgagccactgtgcctggcctaaaactccactttctaatacagtagcaactagccaaatgtgactatttaattagaatagccacatgtgcctatttaaatctaaattaattaaaattaaataaaaattaaaattcagtttttcaactcaagtatgttcaacagcacatgcggctaatggttagtcttatagaaatagttctatcttcacttaacatactattggacagggctggtctagcacctagttcttttgaattcataacttggagaaaagatcccatggcggccgggtgcggtggctcacacctgtaatcccagcactttgggaggctgaggcgggcggatcacgaggtcaggagattgagaccatcctggctaacacggtgaaaccccgtctctactaaaaatacaaaaaacttgccaggcatggtggcgggtgcccgtagtcccagctactcaggaggccgaggcaggagaatggtgtgaacccgggaggcggagcttgcagtgagccgagatcgcgccactgcactccagcctgggtgacagagccagatgcagtctcaaaaaaaaaaaaaaaaaaacatatggagtggagggtgaggagtggggttagtgggagtcagcaggatgacagggtgtcggggtggcagaggatgttggagattacaacaggagttgggggacacaacaacaacaacaaaaagatcccatggtatcccagtatgtatgtatgtatgtatgtatgtatgtatgtatgtatgtatttatgagatgaagtctcactctgtcgcccagactggagtgcagtggtgcaacctccacctcccaggttcaagcaattccccctgcttcagcctcccaagtagctgggactacaggcatgcaccaccacgcctggttaatttttgtgtgtgtgtatttttagtagagactgggtttcgccatggtaaccaggctggcctcggcctcccaaagtgctgggattacaggcataagccaccaggctcagcccatccaagtatttaataaagatagcctgatagtgacaatgtcaaatcataaccccttccggtcttattacgagaaacactgaagatttaggaagttggtttatctttccaggggctataaaaactaaaaaatgaaaaattacttataatttttagcaggggggtatatgaaaaatctccatatcttctgctcaactttgctgtgaaactgaaacttctgtaaaaaaaaaaaatactattttaaaagattcaggggagcctctctgcacctattctggttcggggattgttcaataaataaaattaaacttaggccagttgcagtggctcacgcctgtgatctcagcactttgggaggccgagacaagcagatcattttgagcccagagtttgagaccaacctgggcaacatggcaaaaccgcatttctactaataatacaaaaactagctggacgtgctggcccgcacctgtagtctcagctactcagaaggctgaggtgggaggatggtttgggccaggaggcagaggttgcagtgagctgagattgcgccactgcactccagcctggataacagaaccagatcctgtctcaaaaatatatataaacaaattttaaaaagttttcttttggctcattttatatctttattatcaccattactgttactgtatcggctcagcctatcataaaataagttgaagtctctgtatcctttgatttcttttgtcatctctgcacaaactgggctagcctaaggtcctagattctgtctactggttactaaatcctgaacatctcattagtgagtcacaatctaatccatttttttaaaaaatttagttttaaaagagctttaccaaaatgtatttgattcacatgtactcaggaaaaagaatgttgaaacctaggttgcatatttggtgaagaataatgtaagttaacgattcccaagttacaaataacaaaaacatcattaagaattgcaggaccaggcatagtggctcacgcctgtaatcccagcactttgggaggctgaggtgggcagatcacctgaggtcaggagttcaagaccagcctggccaacatggcgaaaccacgtctctactataaatacaaaaattagctgggcgtggtggccggtccctgtaatctgagctacttgggaggctgaggcaagaaaatcgcttgaacccaggaggcggaggttgcagtgagcttagatggcgccactgcactccaatccagcctgggagagcaagtgagattttgtcaagaaagaaaggaaagaaaagaaaaagaaagaaagaaagagagagagagacagaatgaaagaaagaaagagaaagaaagaaagaaagaaagaaagaaagaaagaaagaaagaaagaaagaaggaaagaaagaaagagaaagaaagaaaaagagagagagatatgcaacttcagacagagagagaccgtagtaatcaatcctggcacttttaagaagaaattttaactctgctatgggtgcacaggaacatcattagaaatgaaaaaaacaagctctgtcaagaagacagagcaaggtcttcgaagatctatacgacaaaaataattatttcctcacgtgttattcaaggtttttctactactggcacatgggaaaatagtaagttgagggttaactgtagcattagaaacatggtactatatgctttatttcaaggattctcaattataaaagactgacaagagacaaacaagcttctctcacatccagaaagaatacaggaggagacccttttctgatttgtctaggtcagaaaaacttccatgttttcctttgaaaggttatcctctgcaacagctctcatgccagaacgtttttcttaaattttcaccttaaccttatgaccttgtacacctttaaacatcaaagagaaaggcttcaggggaagctttgagaacaaagtgtaccaaatatgaccagtttcttctgtgagtcttcatcctggatacagtggcattcctggtcttaatctttggatttcaagaccagctccctatctctgccatctgtcctatccctcaagatatgtgcgagacatcattagtgaaaatttagggcctagaccatacaagcctctgctatctggcactctgtatttggtagagttaagtgacgttaaatttgaaacttatgtttacatgatgagaataaagaatactgcaaaatgattctgtttaatagcacatcagaaaccaacttctgtatctcacagttgagatgctatgatcagagcatatcaagcagtacagagaggtatataggaattaggggattctttaatcccttcaactttatggaaaggtcagaccccaacactgaatgacatatagaaacagaacaaccctgaagggaagggaaccactgaagcacactgtgtcctacagatatgacgatgtcaggactgacagccagtcctacgtggtaactatgtgcaagtgttctggaagatgaggtagatgggtttttttccttcctggaggcagcaaaattcaaaggagaagaatttgataaaagatatcaaccagaaatgatgagacaaaatacagccataactaacgtgcccattccctcggcttgagggctctgcctacctcctaagttgtacaacaaacttaaatctgagagctgttttcagaaacacctcaggctggccgggcgtggaggctcatgcctgtaatctcagcactttggaaggccgaggtgggcagatcacttgaggtcaggagttcgagaccaccctggccaacatggcgaaactccatctctaaaatacaaaaattagctgggtatggtggtgcacacctatagtcccagctactcgggaaggctgaggcgagataattgcttgaacccaggaggcagaggctgcagtgagctgagatcgcgccactgcactccagcctcggcgacagagtgagactttgtctcaaaaaaaaaaaaaaaagacatggagtggagggtgaggagtgggattagtgggagtcagcaggatgacggggtgttggggcggcagaggatgttggagattacaaaaggagtcgggggacacagggtagtggtgagggagggttactcactaggtaggggtctggcaaaaaaaaaaaaaaaaaaaaaaaagagcctcgtttttgggaacaccagaccctatccatgtaccaacagggacgtaaatgaggaggaaattcacacctgaaactattcccagtcctcaacattctctctcataatctaagcatttcttacctacttccttctctagaaaagctgataacaagactatgtccatagctgaaggtggatcttggtatatgggaaaatgcaatattctcatagaagcaggtcatttctattcccacaggaaaggcaattattctcacttcacagacacagagaacaacccaaagtatacaattagatattcaggacaattttagaatccgggctcctgacagaatgggagtgttgtttcaaactccatgcccagaattccaacaggttttcaatagagcggtatctatttcagtttgtcagactctctctctcatatacacatgcacacactgtactttacaactggctgtcttcattcattccttcattcagtgccaggcactggggacgggactgataaaatatacacacacacacacacacacacacacacacacacacacacatatatacatatatatatatatatatatatatatatatatacacacatgaatgatactttctcaaggagatcatagtctagcaggagatacaagcatataagcagataaccgcaataaccaaagcatcatttgtctttttgagacggggtctcgctgttgcctaggctggagtgcggtggtgcaaactcggcttgctgcagcctccgcctcccaggttcaagcaatactcctgcctcagcctctcaggcgcgccaccatgcctggctaatttttgtatttttagtagagacggggtttcaccatgttagccaggctggtctggaattcctgacctcaggtgatccaccctcctcggcctcccaaagtgctgggattataggtgtgagtcaccgcgcctggcccatttgtcttaacaacatagaatattacaagaaatgctaagtaaggagactaatagataaatcctattaaacaatgatctccagtagcccctgctactacaggaaagacaggaaaaagaaagcagggcactcaatctgtgcactgcttttagaccctgaacatactacaggtcctgagaagtagcattatgctctcagaattagtgctgtaattacagttagtagcccatgtgtcagcactgaattgctctttattttgtgtatgggtacgttttggcagcccaaattttggctgttcaatgccttgagggcagataccatgcctcttacttctttaatcttggtagcatctaggactaccctaggcacaaagtagacactaagtatatgatgtccttggtgaaagggacaagtagatgagaaactgggtagctatcttgtttctccacagtatggactgggaggtttggagtgtattgtaaagcacagcattgccctacctgatcacattgctgatacaatgaacaagccacctaacactttaagaactgggggtagagagtccttcactggagggccacagaagacagcataatgtaggtaaatagtctggcagtgaactgcagtaaacaaaaagattaatttgggacttaagctccctgggctgatgtttaggatagaaatagaccccaagccgggcaaggtggctcacacctgtaatcccagcactttgggagggttaggcaggaggaccgcttgagcccaggagttcaagaccagtctgagcaacataggtagactccatctctataaaaagtaaaaataattagccaggcatgatggctcacacctacagtcccagggctattcaggaggctgaggtgggaagatctgcttgaaagccagagaggtggacgctgcagtgagccatgatcatgccattgcactttagcctggatgacagagcaagaacttgtctcaaaaaaaaaaaaaaaaaaaaaaaaaaagttaaaagaaatagaccccaggcttcttacacttgttataaggttctcttagaaatggaccctatcactattgtggtaggtccattctgacttgcttaaaagccttcaatggcttcccattgcacttaaaaccaaatccagctgggcatggtgatgcacaccagtagtccctgccactaaggagcctgaggcagaaggattgcttgagcccaggaggttgagttcagcctgggcaacatagcaagaccccatctcttaaaaattaaaatgaaggccggacacagtggctcaggctgtaatcccagcactttgggaggctgaggcaggaggatcacgaggccaagagatcgagaccaacctggctcatacggtgaaaccccgtctctactaaaaatacaaaaaaaaaaaaaaaaaaaaattagccaggcgctgtggtgggcacctgtagtcccagctatttgggaggctgaggcaggagaatggcgtgaacccgggaggcggagcttgcagtgagcccagattatgccactgcactccagcctgggcaacagagcaagactccgtcttaaaaaaaaaaattaaaattaaaagccaaatccacctcctccatgtgggtgataatgccctggctctagccctgcccaccttacccatcttcacttgccccttctctctctccaccatgccccagccacactggcttacttgatgatctccaaacacaccaacttctggcctgcaccaggcccagacacttgctttttcttctctctgagccctcttcctgctttctgaatggccagcttcatctgatcctttagatctcagctcaaatctttcctcttcagtgaggcctttcttgaacatcttattcgaagtgactccatcttattcctattacttattaacacaccaatcagttaatttacttgatagtacttaccaggctctgaacttaccaactgcatttcaaggtgatccctgctctgaaatttcttgtctactactagtcttgcccttctaaatataaatcacctgagagcaagagctggatttatcttgctgcatcaactatcacatattaggtactcaaagattttgaatgaatgaatgaatgaatgaatgagagctaggaaaatatggtagcagtcagccagcagacaatgagttaaagtgaaaaacatcagttctcccaccatgaagccagaagttgtatgattgttttttgacttacagtgtatccaagtagtgataacatacaaacagaaaagagagcctatgttctctgctgatgatttaaaaaagaaaggtccgaaagatcaaaacctcaccagctccagtttcagctccgtttataatgctgttggtattaaaggcaaatttccttacttctaacagattccaaggtttggtttcatttttcccctaagggatggacttctgcacccactgagcccggtgccgtgatagcgccatcaacgactctactcagccatgctcacgcccaggccagccttagagtatctcaggatctcactctacataaaactgtggttgattcaaaataccagaaaagaggtttctcttcctaagaaccagaacatgaaggcaaagcatatgggagaagtggttcttcctcacaatacaccaggctcaagatctgcccctcctataaagggaagtataacagagtgaaaactcttttaaaggtgcaattccaaagtaaaggaaaattcagtggcaccctttacacctaatttaaaccaggtttgaccctttaaacacagtttgtttcactgaacttgatcaattagttatcttaactatttagtgattgagctctaaacttggaaagtcatgagaaagaagagagtggaaaataaaacgcatcatccttgttttatgttagatgcttcccatggcatactcggtgaacacagccatgtcctaaaagcaatctaccaaatgctgagagagagaggcacttacgcggcatgatcccttggctcaccagttcttcccgggtccggcgctgctggagtttcaactgtagcactgcagggcagcagagagagaggagagatgaggggtcagttgggtattccacctcaaaaaacacattttcaaacgcaaaaaaagtctaaaaacagaaggatgtagtgtgaaagaagggtccccttgaagtgcaactgtctgtaattgcagaagtggcctgatacagcagagtttccgtattctgctgtgggcggtgagaggaagttgcgaagggtcttgcagggcgataacaatccacaaagcatcagagtcttgccttttgctcaaaacctccaaaacactgagtcctcctcctaaaacttttttaaaaacacctcttccaaactcaaaatatcctaacgaggaccaccacccagcaaaaaaagctttccagatgctctacgcttaacaaatgtttaccaccataagtatagtgaatgaaagaactactcacacagatcaggaagtactatttgtaaactctttttcttttgtatctaaaaattatagccatttcaccaagcaatgcctttttctagcctagaaaatattttaccgttaatatgcctctgtttttcttctttctcttcacttagagccttttctgttgaggtgaaacaattcagctagatgactcaaagcacatccgggctaggggagactgatgggtgtttctcttattttcactctggcaatactgcttaatgaaaaaacttaatagggattttttttaagttaaaaatcaactatcagccaggcacagtggctcatgcctacatgtaatcccagcactttggaagaccgaggcgggcggatcacaaggtcaggagttcgagaccagcctggccaagacagtgaaaccccatctatactaaaaatacaaaaattagtcgggtgtggtggtgcgcgcctgtagtcccagctactcaggaggctgaggcaggagaattgcttgaacctgggaggcggaggttgcagtgagccgagatcacactactctctctcactccagcctgggtaacgagagtgagatgctgtctcaggaaaaaaaaaaaaaaaaaaaaaaacaactatctttctttcaaaagccagttaaacctaaacggtgttacaactacaaactacacagaatgacaatggcacagctgtcattcagagactaaatgagaaactgcagaggttgcagtgagctgagatcatgccactgcactccagcctgggcaacagagcaagaccccgtctaaaaaaaaaaaagaaagaaaaaaaagaaaatgttcagaggaggagggttaggaggatcccacgggccaaggaaagcctccttacataattaagtcttcaggtgtaggggccttccaagtcacatctgagaggaaccagaatctactgggaatcatcttaatatctgcctttttctatccacagagtagcttttagggaggcgtccaagaatcgcagaaccataaccatgcgcctgcctacatctcaaattcagtagatccaaagccaaacttgttttcctcccaaaaacctaatccccttcccatccttcttacttctttaatgatatcactatctttcccagtattttttaaatgtctgggccaacttcaactctacctcctcacactcacactcccctcttatcaattttaccctgccatgttttcccatgctgcagtggtagctccctggctgtgtccttgcctgtagtgtctctctcccatttcaagttatcttaatcaagcctggccagttactcttcctcaagtaccgtgaattttttcctacctcttttattcacttcacctggaaatgcctaccctgttcatctgaacttccccactcactccacagcattcagttactctaggcctcctgtgagctaccttttatatgttagggaaaagtataatattttgccttgtgtaatagtagcccttgaacatcttacttctcctaccagtttataagttcctggagagaagagaatatcccttactgatatatgtcccccatagcacttaatacatagtaggcattcaacaatggtttcttgtactgaactggatctcaaaaggatgttacaaacagtctgagaaactgaaccaagaggctattattattttacaaattaccattgttaagaacaaagccttggagaactaaatcgataaaaacagcaggagctacaataatagctgacacttatgacgcacgtactctgtgccagacactgttttacattcttttatattttaacttactcttcctaacagccatatgaagatacattttggtgttttattttttgagacaaggtctcactctgtcacccaggctggagtgcagtggcatgatctcagctcaccaaggccttgacgtccctggctcaacagatcctcccacctcagcctctggagtagctggaactataggtgcatgacaccatgcccggtaattttttaatttttttttttgtagatacagggtttcaccatgttgcccaggttggtcttgaactcctgggctgaagtgatctgtccgtctcagcctcccaaaagtgctgagattacaggtgtgaggcactatgcctggccaagataggtattattaatcctattttaccgagaagcaaagtgaggcccagcaggtttaagtaatacacctaaggctatcccactaataagaggtagaacaggatttggagacaagcattctgattccaaaacctgggctccttactttgcctctctaggatcttctgaaagcctgctctactgtgataacaggagtggagtgtgatcacctgggtttattctctggtgagacagacaaaggggctaaaacagatggttcgaccagagtgaaaggaattcaggtgatcaacttcagtaaaacaaatttactctaggaagttgatttcagaaaaaaattataaccatagatcagcaacaataattgcattaataaaacacaaataataaatgagtgtgctactatgtgtcagaccctgtgttaagtgactgtcatgcttttaacttatttaatcctttaaaaaagccctgtgaggatgctacagttattatctccattttacagatgaggaaactaagaatcagacctttaaaagtttgccttctgtcacacagctcaaaggtactggaactaggattcgtacccacatttctgtgactctaaagtggaggcacctgatcatatgcaatgtgcctctttgtcagaaagaaaaaggagagccaagcaggataaaatctaagagggataaaagggcaaataattgtcatcttttagagtgtttctaaagcccagtgtaagatgaactattagaaaattattaaatgtgacaaattaattttatttcagagaataagggaacaatgcaattcagtaagtctgaacacttcaaagaaacaataacataagcaatggctattaatccaagaataattttgaaatattaaccactagccttcttaagtaaaccatatatgaatagggccatagggatattacataaacttcttgattgaaaaacttcttgcttcatgaacgcaaaaatttaaatttatgaaagctaacacatttaataaatttgattcaagttttctgtggagattacagtaaaggcatattcagcttatatatacatacacatatacacaaccgtgtatatattatgcatgtatatatatatatatatttatacacacacatatacagctccagtacaaagacgaaagcttatctaataaaccttttccatctctaaaactgaatgaaattaaagttcagttatctgaaaattccatcttgtccctcccaggagttaactttgaactctgtgcttatctgacatctgacaaagttccccactcaaataacagaattatcctgtatcagtatcatcttgggtactgcaataacctgatttaggtatgtgttgttttatgcactgcataaccttcaatggttacaaagagggggaaaaaagactgaagcagtaaactcagaattatggcagtcaacctataattcattttgttttataatttatctgctttatgtttatctgtgtagactaaaaatgatccatcgtctaagacttccaactacaaagaaacagctgtttatatggagtttttgtttccttggtctattaattcctcttaattctaagcattctaaacaaaatgactttacatttccagaccttaggattattcattttagaagcaattatttaataacctactttcagtaaataccacagagccatatgttctgtgttcactgccaaagttaccaaaatcaggaataaatttcagaggccataaatttaatacacatccactctcaccgagaaatatctgaaacaaatgatgatttttcacagacagtataagcctatggagatttaggagagtaggaattttgacatctttctatgtcattgtatatcactacttagatttgctcatcattccccaagccaataaagactcaacaaaaatatttatttgtatacaagcataagtctttaatcctttactgttactgatttccacaaatttaatatatcatgtttctaaatgggcctgtgtgaacaacctatacatagatgaacagatgtctttagagctgatgggtggtgaatcaactgagttgcctgccagaaaagaatggaataaaaagaaaagaaacccaaccataaagtgaaaaaccctaggttctccactctccatggaaataatcaagttttttacctgcctcaaacaaaggcatcaattgctatttgaataactagctactttgggggtgagggaaaagccaaggagtgaccttaatatatctctgccctgtaagaccatggaaggatgttgataggattcgaggggtaatacccaagaaatgaacacatcaaacagctgggtcaatcaagactggaacaagaaaggagtaagaagtggagttctcaagcctagctcttccaccggtcatttgtcctggatttcactggaaaggaaacatgcagttgatagctgttcctaccttatacatgtattgattccaccaagacttctacaatcagaagataaagtataaattatgaggaagtagaaaagaataggaaggtggggttagtatgggaagaacaggacagtaaaaaaacaagacccctccctccacataatcttttgcccagctaagtcctctcaaggaagattctcagactgtagggacatttcattaactgagctgtaactcaggaatactgacaagtctttttctcatgaaacttctaatcaaatgacaataaacttggccaccacttttcagaatatttatgttagaaaaggctccaaaacaaacttgttgatgagtaaaggaaatgcccctggactagaaattatatgccagccaaaacagtgctgcatttgaaaattaatgaggtgtatatgcttgaggagaccaaaatgcagacaagccttctcaaaaatcttttctcttcccccactcagatatttggcttccaactctggaggctgtcatacttcaggggggaaactgctatccagaaacaatcaactgaaagactggtctggttggagccaagtttgaatgcatcagttttcatgagaattaacaatgaccttcacactaaaaacattaaaatagccccagtatactagaaagtaaattaatagatgtcatttctggcatttgtaaggtacaactaatactagagcatttctacattttaataaattgcatggtgcttatttaactaactttgaataaggagtatttgagtttatctcctctaaaaatcgcaatctacctcactctcaacaatagacagaacaactaggtagaaattagtaaggatattgaaacagttcaaatgtgtgccccctccaaacctcatgctgagatatgatccccaatgttggaggcggggcctagtgggaagtgtctgggtcatggcggcagatgtcctgggagtggcttggtgccctccccgcaagtaatgagttctcactcttttagctcatgtgcatgctggtttaaaagagcatgggatctctcttgctccctctctcgccatgtgacactcctgctccccatgtgccttctgtcataagtaaaagcttcctgaggcctctctagaagctgagcagacgctggtgcaatgcttgtacagcctgaaaaaccatgagccaaataaacctcttttctttataaattaaccagcctcatgtaccccttttagcaacccaaaacagactaatgcagacatataggatttgaactacaccatcaaccaaatagaattaacaaacatatagaacactccacctaacaatggcagaatatacactcttttcaagcacacatggaacactccccaggtcacaacacataccaagcaataaaacaaatttcagtacatttaaaaggattaaaatcattctgtgatgacaatggaattaaattagaaatcaaaaacaggccaggcatggtggctcacacctacaaccccagcactttgggaggctgaagcagaaaaatcgcttgaggccaggagtcagagaccaacctgggcaaaatagcaagacccccatctctataaatattatgtatataaagaatatatggctgggcacagtggctcacgcctgtaatcccaacactttgggaggccaagacaggtggatcacctcaggtcagcagttcaagaccagcctggccaacatggtgaaaccccgtctccactaaaaatacacaaattaggcaagcatggcggcgggtgcctataatcccagctactcaggaggctgaggtagtagaattgcttgaaccctggaggtggatgttgcagtgagccgagattgtaccactgcattctagcctgggtgacacagcaagaccccatctccaaaattttatatatatatatatatatatatatatatatatatatatatatatatataaagaaacataataaagagcaaaagaaaatttgggaaattcataaatatgcagaaattaaagagcacacccttaaacagccaatgggtcaaaagagaatgagagaaattagaaagtactttgaactaaacaatttatcaaaatttctggaatacagctgaaacagtgcttagagggaaactcataggtttatattagaaaattcacagcctacactggaaaagaagatctgaaatacatgcggtaagcctttaccttaagaaactagatgaatatgaaattcagctaattttaaaaaaggaaactaggaaaagagcaaattaaaccatggtaagtagaaaaaaggaaattaaagtggtaagcaatgatacagaaaacagaaaaacaggccaggtgtggtagctcacgcctgtaatcccagcactttgggacgccgagaaaggcagatcacctgaggtcaggagttcgagaccagcctcaccaatatggtgaaaccctgtctctactaaaaatacaaaaattagccaggtgtggcaacaggcgcctgtagtcccagctactcgggaggctgaggcaggagaatcacttgaacccgggaggcggaggttacagtgagctgagattgtgccactgcactccagcctaggtgaaagagcgagattccgtctcaaaaaacaaaacaaaacaaaaaacaaaaacaacagagaaaatcaatagtcataaaagtttgttgtttgaaaagaacaaaattgataaacctttacctagactgccaagaaaaaaacagaaaatacatacaaaaatcagaaatgcaaaaggaggccgggtgtggtagctcacacctgtgatcccagcactttgggaagccaaggagggtggaccacctgaggtcaggagttcaagaccagcctggccaacatgacaaagccctgtttctattaaaaaaaaaaaaaaaaaaaaaaaaaaaacaagaattagccagatgtggtggcacgcgcctgtaatcccagctacttgggaggctgaggcaagagaatcgcttgaacctgggaggcagaggttgcagtgagccgagatcatgccactgcactccagcctgagcaacagagcaagactccatctcaaaaaaagaaaaagaaaaagaaatgcaatggtcaaattcctaggaaggcataaattattgaaattgaagaaagaaatagaacatcggaatagatgtataacaagtaaggagactgaaatagtaatcttcccacaaagaaaagcccaggtccagaaagcttcgctgatatatttctccaaatacttaagaattaatactggctgggcgcggtagctcatgcttgtaattccagcactttgggaggcccaggtaggcggattgcttgagctcaggagttcgagaccagcctgggcaacatggcaaaactgcctctacaaaaatgagccaggcatggtggcaagtgcctgttgtccaaactactcgggaggctgaggcaggaaaatcacttgaatctgggaggtcgaggctgtagtgagctgagaccacaccactgcactccaacctgggtgccagagcaaaaccatctcaaaaaaataaattaaaaattaaaaagaataccaatcattcacaaactcttccaggaaacagaggagaaaacacttccccaactcatttaatgaagctggtattattctctgattccaaagccagagaaagacatcaaaacaaaactacaggtgaatatgccttattaacatagtcacaaaattcctcaacaaaatactaggaaatgaagccaggactggaaccaaatattctgtatccttatccctgtaatccttctctcattccagtgattctcaacccttacccttcacaatgaaatcatctgggaaggtttttaattggtctggaatggggcctagacctcatctctttaaaaagcttagcaggtaattctaatgcaatgccatgtcaagagctaccctatgtaatgctaatttggcctaatttaagcttactttatatggagaaattaaatatgctccacccatgttcgtgatgccaatgatagatcatggcaagtaaatagtgcgaagcaggtttaatccacctaataagcagtaagtagcctttcctctgatactgttttaaggcacatcatcttttgctgtgttttgaacaatgattcagtttttaagttaaaattttttgacaataaacatgttattatttccatgatcatttttaatattttttcacattgaaaaacttaagaatgaataacaaataatttttttctcaaattcctttttaacaaacgaataatttaataaacaatcatgtgaacacttctaggaggtgtcaactcccatctcatgaagtttagcattaaactcagacatctagagaacaggatacagaccagggatatccactgtcacaaattatcaacacatttcccagcttccatggtgtcttggcatcttagctatggacctcccaggacctggaggacacagggcaacagagaccacaacaaattcacacatagctcctggagcagaggacaaagagcagtgaaaatggacccccaagctctggctaaaaattgttaatttgttcaaaagtttccaacaggagagaaatttcattttccaacatacttcttccataaaatgtatttgtagactaccactaaaggtttgtcaaggggaagaaaatggctaaagaacaacccaataaagagataaaatctgttatctctagatgcacttctgtgaattttctatctaaatttaatgcatacgatatgatgcagtatcttctaagttctcttttatatacagtgtagtacatttactaataaatattaactggtttttattttatttgagacaggttctcactctgttgtccaggctgaagtgcagtggtatgatcacggctcaccgcagccttgacccaccaggctcaaacaatcctcccacctcagccgcctgagtagctgggattatagacttgtaccaccacacccagctaatttttaaatttttttgtagagatgaggtctcactgttgcccagactggtatcgaactcctgggctcagttaatcctcccacttcggcctcccaaagtgctgggattacaggtgtgagccactgtacccagccaatattaactgttaaaagtagtttcggatggtatttccttactctaagttcatagcctcctataaattcctaaagcttgatctgctaataattggtatattttttctctaattttcaggcaccagtcccagaaaaaataagcaaatgcaacttaattcagcaacagacaccaatacttttagcttcaaactagggaatgtgttttaccaggaaggtcagagaaggaacaggttgggtgctagccttaagtgaagctcagcatgcagataattagaatacccatctttgcaacagtgaattatacctattttactggtgtattttacattatatttatcctatatgcctgaaaaatcatttagtggcatccaaattgtaaaaccacatggcctaccaattagaaccaaaggctgttcagaacactcaccagtttcattcttagaatgcatgattaaaagtaggtgaagggtgtccccagaagcaggtgctactcaagttctgctgcctgggttactttccagcatcactaccaatataaggattgggaatcagggtgtggagagagatcttctctattcactcacctaacaagtatttactaaacaactataggttggcacaaaagtaattgaggcttttgtcattgcttttaatggcaaaagctgcaattatttttgcaccaacataatactattgtgttaggtcctgtgctaggtactagatacacctatgatctctgctcacataaagctttcagtccagtgggacaacagagatcaaatcaatgacaacaaacaaataaattcaagttgtgatcaatattttacagaaaaagaaaaaaggatatgagagagccctgaactctccagtatttccttctttaatgttatatgataataaacttttcacattgctctttatattaatatacagtcaattgtttacgatgctaaaactctttgaaaagtagagatttcaggggaagtcataaaaacaagtaagttaaggcacacagtgtcatttactcactttactctcacttgcttggatgctctagagttcatgtactagttggtcagcacatatacttacctcacatccatgccttattcagttcttccttagctccttgtcccaacctctctttccttgcattcattcaagaaatatgagggcctactgtatgccagatactctctgtttgttgctggggatacagtagtgactgaaggccccaccttcagtgagtttacagtttcatgagggaaacatacataaagtaagttctaatttgtgtgaagagtatttccaaagaaaacagacactatatcttaactgatttgattgttcccataattcaattcatgtattcaaatggcttttttttctttctttcctgagatggaatcttgctctgtcacccaggctggagtgcagtggcatgattttggctcaatgcagcctccgcctcccaggttcaagctattctcctgcctcagccatccgagtagctgggactacaggtgtgtgccaccacgcctgactaatttttgtatttttagtagagacgaagtttcaccatgttggccaggctggtctagaactcctgatttcaggtgatccgcctgccttggcctcccaacgtgctgggattacaggtgtgagccactgcgcccagccaacattgtaattattcactttgaatccattagagctaggagttctgtgagaatgagaaccatgtcttacacagatttgtatctctaataactggccctgtctttaagatacaaaagccatctaaggtggtggttcacgtctgtaatctcagcatgctgggaggctgaggtgggcggatcacctgaggtcaggagttcgagaccagcctggccaacatggtgaaatcccatctcaattaaaatagaaaaattagccaggcatggtggtgcatgcttgtaatcccagctaccagggaggctgtggcaggagaatggcttgaatctgggaggcggaggttgcagtgagccgaaattgtgcccctgcactccagcctgggcaacagtgccagactccgtctgaaaaaaaaaagtgaataattacaatgttttaagaaagacactaacatctagacaagtgtaacattagctagcacacatgccaagagtgggcatgccctactactggcaaattcaagtcttatgtggccttttgtgtgagacacatgtgtacattaaaaataaaaagaattgcttgtttctttaaaacaacaattaaaatagttatgtatttttcagttatcataagagcagaaagatggtactgcccaacactggaagtcagagaaaaagagaaacaagatcttttctatgcaagatagcactagggtacataaaaatggcgtctcggccaggcacggtggctcacgcctgtattcccagcacttcgggaggccgaggcgggtggatcacgaggtcaggagattgagaccatcctggctaatatggtgaaaccctgtctctactaaaaatacaaaaaatgagccaggcgtggtggcgggtgcctgtagtcccagctactcgggaggctgaggcagaagaatggcatgaacccgggaggcggagcttgcagtgagctgagatcgcgccactgcactccaacctgggcgacagagcaagactccgtctcaaaaaaaaaaaagggggggggtcttgaaagtattttatcttcatgatcagttggtattaaagtttcaagctatttcctgataacattccccaaaagtaagactcctctgggcccctactaatatgcgcccacgagtctgtcctgatacagcctaaaaagatacgaaagagaagacagatgtctctgtgttccctaacttggtttgattacctctcttgctttctggttcttgagccctaccctgtcctacagcatccaatggaattgtttcctctcctgcttcttacatataatgttatttctaaacatgtttcttttcttttttgttttttgagataggatcttgctctgtcacccaggctggagagcagtggtgcaatcttggctcactgcagcctcaacttcctgggctcaagcaattgatcctcttgcctcagcttcttcagtagctgggaccacaggcacgcaccaccacaaatggctaattttttgtacagacagggtttcgcctgttgcccaggctagtcttgaactcctgggctcaaatgatccacccaccgcggcctcccaaagtgctggagtacagatatgaaccaccgcgcagcctaaacactaagtttctcttgtccttttcatgataattttcttccttcaacttgtgaaaccagcctgaatgggtaagcacagtgtacactgtgccaaaaacatctctctggcttgtttttaatataaacaaaagcattgtaaaggcccaatgtattttataattagccctatccttaaccagaaagggtttactgtcaactcaactgatttctgggtaaagggttaacagcactgaatgtggggttggttttatatattagttccaaataaatgcaatacacctacagaaatgacctctggccaggtgcggtggctcatgcctgtaatcccagcactttgggaggccaaggcaggcagatcacgtgaggtcaggaggtctaggccagcctggccaacatggtgaaaccctgtctctactaaaaatacaaaaaaaaaaaaaaaaaaaaaaaaaatagccgggcatggtggcgggcacttgtaatcccagctactcgggagggtgaggcaggagaatagcttgaacccaggaggcagaggttgcagtgagccgagatcacgccactgccctccagcctgggtgacagagtgagactcggtctcaaaataaaaataataataataaaaaaaagaaatgacctctaaggggagaccaaaagacatcagagaaagaatcagaacacagaggtcccaatcctagctctgttgctacctaatcaagtaactttatctttttttcctcaattttctcactataattcaattttgaaaactaatccatataccctttgaaactcaaaagaccacaatgtacatgaaaagtgatttgtaaaattataatacagattacatatgtttcattagaggcttttacatcagattttccctagggcaaagtaaaaactgtaagtaatctggtaccacacctccaacaagataatttattctgcaaggtaaaatgatcttatatcaagccacgcttatttaaatcacatcccaagttgttcttggtgggggttgggggtgggggatgcggagagatgaaaggaagggtaaaggaaaggggaaggagaggagggaaaggaatgaaaaaggaaaggggaaacaaaaagaaagggaactatttttctttggaaggcagtttaggaacatgtagtcagtgaagcaggctctggtaattataaagagcaagcttcagagagaggcagaagaatcagtacccattcattattaaaatcaaatatacagttgagtgttcaaaaaaagcatgctcctgaaattctaagctatcaataccaaaatagttgttaaaggatccagaaaggtccatttatcttttgccagagaaacgagctgctgaaattcttgagattcagatccaaagttaagataaaaaggaggaagtggaggtgaagaaaggaaagtaaattctccttgggagtctattgaccaaccatctacaaatcttatgattaaatgcaatgtggtatcctagattggatctgggaactgaaaaacgacattagtgggaaaacgaatgaaatccaaatgaagtttggagtttacttaacagtaatgtactaatgttcatctctcagttttgacaaatgtaccatagttatgtaagatgctaacattaggggcaactggatcaaggatacacaggaactctccgtactatctttgtaactttcttctaagtctaaaatcattccaaataaagtttattttcaaaacccacggagggccttttcctcttggaagtcccctctctctcactagagagcaaactgttttcctttctctttccttctctttcttttgcctatgaaacctccactcctaaactcctcgtacgtgtccatgtcctaaattttcttggcgtgagacgacgaatctcaagtatttaccccagacaacacagccacttcatactggggacctcgtctgggataccaaggtacaacattcattgttacaacatgcaacatctggtggaggcaaaccagtgttacaacccatcggaatggctccgacagcaatcaaactccaaatggtgctgtacaccgaaccacacatggacacacctttcatctgaagacccttagattgaccccaggaggagccctagctgctgttccacacacaatgccccttttcagcaggaaggagccagaaagagttgtccaacaccccctaacagcagttagcattaccattccagaggagtgaatgatacaggagttaagaaattacttaggcagatagggagggtatggaagtcctcagtaaggttttcctttttaatgaaaagcagccccaaatcattttctaacaaagagcagcctgtaaagttgagctgctgaaatagataagcaagctgagcgcttgcacaggtgaatgccagcaggaaagaactacctggaactaatcatgttcaaaatgaagcctccaccttcccttctctgccagccacatatacagtaaggagcagacaagatggcgccagctaaggggagaatgcatttgcataataagattagggtggggcaaccagccttccccactcactatgtaaacatcacacctgatcaaatcaatctgtgagccctatgtaaatcagacaccacctcctcacacccaactataaaatctggggcatccgctgctgctggccggcctttcctctcgcaagtcccctctttctcacgagagagagctgttttcctttccctttcttctgcctattaaacctctgctcctaaaaaaataaaataaaataaaaaacatggatttgccctagctttagaaaaattgatgaatcaattatgaaacacaacaaatgtcaggtttttcaaactgaaatgctgccatctcttggagagaaagaaattatcaattcctataaatgattcctgtaaatcaacatggtgctcaaaggaaatgctcaatggagcatgtcagatttcagatatggatgttcaaccagcaaatatataatgcaaatattccaaaatctgaaagaaatccaaaatgcaaaacacctgtagtctcaaacatttctgataaggaatactcttataataccaaaatataatagatatcttctatttaatctgaatactgtcaaggatgaaggctcttgattaatgaagtaggttcctgggctggtaaacctgggcaacttacacatctaaccaggtaactttcaaagaataagcttatgaaaatctaacttaagttattaaaatatgcaagtgaaaggtctctatattgtgtaataacttataaaatggtgtaaacatgcatgcatcatcttatttctcacaacaaagctatgcagacgatacaactgtcataccattttgtagatgaggaaattgaggtttagaccgattaagcaacttgctcaaggtcataaagtaaaaggtagagcagaaattggaacccagctctgtctgaatgtatagcctgaatcttcaatcacctctcttttctcataaaacacaccagttctctgtatgtttatttttttttttttatgttttgtcaagatggggtcctgcattgttgcccaggctggccttgaattcctggcctccagttatcctcctaccttggcctcccaaattcctgggattacagtcatgatgaaacactgcacccccactcctctgttttaaaatgacactatattgatagtgttatcagcatgacatgctgatatggatggaaaaaagtgatctacatacttactaactaggggaaaatccaggtgatttcagtgaatagtatggaacatgtagagtatatgacacagtagaactctggagactgaaaacaatgcttatgttctaattccaaaaggaatcgagattttaacaggataacggtggtcacatctaaaggttattcaggctgggcatgatggttcgcacctgtaatccctgcactttgggaggccaaggtgggaggatcacgcccaggagttcaagacttttttttttttttttttttttttgagacagaatcttgctctgtcaccaggctggagtgcagtggcgcgatctccgctcactgcaacctccgcctcccgggttcaagcgattctccttcctcagcctcccgagtatctgggattacaggcatgagccaacatgcccggccagagttcaagacttttctgagcaacacagggagacccccgtttctacaaaaaataattttttaaaaaaattagccaggtgtagtagtccttgcctgtagtcctagctgctccggaagctgaggggttgaggctgcagtgagccatgattatgccactgcagtctagcctgggcaacagggtgagaccctgtctcaaaaaataacaacaaatactaaataaaggtcaaaggggctcttcccagacagagagacaggaagaagtctaaaaggatgtaagaggacgtcacaggactactgcctatctggctctcagtgtgggaacatccactccacaaaagcagagagcatttgcttcctggtacaacttccttcctgcattcggccacaggttcttttcgggcactaggaagattgtcagttggctcgttcattcatttattgaactaatatgtataggtgatacttacaggtgataaaacaacatgaacagataaggtcaatatttataggcaataaaacaacaacatggacagatgaggtccctgccctcatagaacatatgctctagcagggaaaacataataaataaggtgtacgtattataatttcagggagtacattatgtgaagaaaaatatagtggaacaagagaacagagagtgacaggggtggtgataattttagatagggtacacagagaaggcccttttgaagagaccgatgactcttggacagaaacctaaataatatgacaaaccataaaaatgatctggagagtattccagacataagaaattgcaagtgcaaaggcactgagaaaaggcttgccttgaaaagaaaactaaaatagaagaaatgaggactctgaccaggcgcggtggctcacgcctgtaatcccagcactttgggaggccaagacaggcagatcacaaggtcaggagatcgagaccatcctggctaacacggtgaaaccccgtctctactaaaaatacaaaaagttggctgggcgtggtggtgggcacctgtagtcccagctactcgggaggctgaggcaggagagtcgctggaacccgggaggcagagcgtgcagtgagccgagatcgcaccactgcactccagcctgggtgacacagcaagactcccatctcaaaaaaaaaaaaaaagaaatgaggactctaatgtgtttagctcttacattgtgttgtcactgggtagaagtactactacggtgactcatttcatctcaatggctatttgagatatgtactatctcatagatgaagaagctgcacaagtggtaacaggtagagccagagttcaaacacaggttggcctgatatcaaagcttgtgctttttctactatatcacatttatgccacagtcataataaaaatattaataactataaataaatattattccccacatcctcaaaaatctgaagctcaccacttcattttgggtagctgctcatctccccccttgaggtgacctcctattctaatggtggcaaacagatctcaaagtgccaattacttcaatgtcatcagtctctttcctgaggatctataaagcaatgtgcaaccaactccatcatgtaagatctgggcatagcatgcacttgcaccagatgcctgaacagggtggagataaactaggaatgtgcttcctttagcacttttaggtagggccatctgaacactcccttccaaagttaaaggcaccaagaacagcattttccttattgcattagttctgcccattcactgagaaaatatgggcagccttgaatctcatttgctaatccctgctggtatcactgatgctgacattctgcacccaactttgttgtacagattcaaaacttggaatagggtagtcattctagagcaaaccaaaagtgacaaaaaattgttttccttaaaattaaattaggccagggacagtgggttgtgcctataatcccagcactttgtgggggtcaaggtgggaggattacttgagagctggagttggagaccaacctgggcaacacagggagacaacatctggttgtgtgtgcctgtagtgtatgcctgttgacccagactgcagtgagccaccactgtgccacggcactccagcctgaacaagagtgagcccgtctcaaaaaaacaaaacacagagacaggatctcactctcttgccgaggctggaatgcagtggtgcaggatcacagctcactgtaatctcaaacttctgggctcaagtgattcttccacctcagcctcccaaatagctaggactgcaggcgctctccaccacgtctggctaattttaaaaaaatttttttgtagagatggggtctcactatattgcccaggttggtttcaaactcctggtctcaagcaatcctcctgcttcagtctcccaaagtgctggaatcacaggcgtgagctactatgacagacctaaagtaattttttttttttttttttaagatagggtctcagccaggcgcaatggctcacgcctgtaatcccagcactttgggaggccgaggcgagtggatcacgaggtcaggagatcaagaccaacctggctaacatggtgaaaccccatctctactaaaaatacaaaaaagtagccgggtgtggtggggggcgcctgtagtcccagctactcgggaggctgaggcaggagaatggcatgaacccaggaggcagagctggcagtgagccgagatagtgccactgcactccagcctgggtgacagagtgagactgtctcaataaaaaaaaaaaaattaaaattaaaataaaaagataggtctcattctgtcgccaggatggagtacagtggtgcgatcatggctcactgcagccttgacctcccggactcaatcagtcctcccacctcagcctcctgagtaatcgggactacagacgcacagtagcatgcttgaccaatttttgctttttgggggtttgtttttgtagagatggtgtttcaccatgttgctcaggctggtctcaaactcctggactcaagtgatccgctcacctcaacctcccaaaatgttgggattacaggctttgctgggattgggcatgaggcactacacctggcccttttctatgggaagcagtagggaatagaaaggtgattaaaaattagaccatatgggttgggttatagatagatagataattagatagacaaacaatctgaagcttattcaaatgtttatgtatcaagttttctatggataaagaaaaaaaaaacagtaaattctcactcttcagtcctaaatgatgtaaaattttagctatttgactcaaaaagataaaaatttaaaaataaaatttgataaagtctgcagcaaaatttgtcttctctgtggaagaaagaaatccataaaattaaacttcatgtagtgtctgagcgtaaaagctacaaatcagctaaacttgttggaatgggttaaaattctcaagatcaaacacataaaggagaagccagatcattataatacattaggagcccatttaactactgtaggattttcccactccacatcccccaggtttagtaaagacttttcaaaagcaaaggtaggtgtaactgtagaagagttcatgttataagtaccgcaactttgtatttcctgaagtctgtgtggttgaatttgcaaatggaacatttcactactgcaggttttgcacaaaattttacgaaacaaacctgcattaagttaaagcagaacttaaataaatgccttttctggatacttcagaaacaatttccatatatttcctattacagaattcttttaatttagatactccttcaacatacatgagtagaagggaaattccagctcaaaatctaaaagtagaggcgggtgcggtggctcacacctgtaatcccagcactttaggaggccgacgcaggcggatcacgaggtcaggagatcgagaccatcctggccaacatggtgaaaccccgtctctactaaaaatacaaagattagctgggcatggtggcacgtgcctgtaaatcccagctactcaggaggctgaggcaggagaatcgcttgcatctgggagtaggaggttgcagtgagaggagattgcgccactgcactccagcctggcaacatagtgagactccgtctcaaaaaaaaaaaaaaaatctaaaagaatgcaaagtgatcaaataattcctccataccacatacctcaattttctagcataattctgagtgatgcagagtgccacacctatcagcagaatgcttattttaaaaatgtccctgatactaccatgtacttttcctcctcctgattttcaaatcatcccagtattaacatccatccctaaggaatctcactagtagtttcagaaaaatgaatttgatttgttttacacactgtgggacagacaacaaacaagaccccttttcctctgcctcttcgatgcttctcctgggcatgaaaacagcctgaactgtggcaacagctggggatcattaaactgacagaaatagcttaggagactccaatggtgtgtgaaggcgggaggagagcctgagtatcagattaaaaaaaatcaaaagggcaaaaggaaaggggggcagggcagggaagcctaaggagtgtatcacacctaaatttcctttaccacagccaagaagatgcagtgaagcaaatgacaggatacatgaatgcggcctaaattgcttagcctcctacctattcctagatggaaggtttagtcaaacctaaaaatgtgggtctcaatgaagacatggtggggaagagtagggaggagaactgcggaatctcaaaggctaactatgggtctggaagaatcacttagaggaggttgcaatgatggtaaaaataaactctaagatggaggaggagcaagggctgtgagaatacatcccaagccctaagtggactcagagattaacgtagtcctaaggcatctccctcaactgggaaggaccaaatgctacatgaaatgcatgttcttgttcttgctagagcacagccatgcctccccagtggtagcttttcaacctggcaggccttcgaaggtcggtgcaggaatgagccatctgcctggcccactgcccgagtgtgttcagcacatacctgaatgccctagagtagctttattcagatcaccccaagggagtgggcttgcagatcccgacttacgcctttaaatctggttagtcccaggatcctggtgtaccttcttcatccccacacttgttaggctgtctattcaatattatcatcaaggcttctcccaccaaggcgttttctttataactaatcttataggactgcagtttcagattgttccccacctgcaagcccgaacaggaaatgattcgattacggatattaagactgcaactttctttggcaagagtgttttgtaactatgagattgcaccaagctcggttgaacattttattcaatgaatctaattacttactaaagaaagttccaggctggtgactggtctcaacaaaaagctaccactatactaccttcttcttgaatagcttgcttcttttctttattgtttttttcttccttccactctaggaggaaaatttgcttcttttctaaccacaaatctggcaggaaaatatgctcatgcatatttccatactaagacatttttgtctaaacaactgtatttgaatctggctttttataagaagtccaaaaaccttacaacggttggctcattacgaacactttaagttcgtattaagaagggtacagggagccgggtgcagtgtggctcacgcctctaatcctagcactttgggaggctgaggctggtggatcacttgatctcagacagcctgggcaacacggcaaaaccccatctctacaaaaaaattagctgggcatggtggcacttgcctgtggtcccagctacttgggggactaaggcgggaggatcacttgagcctagggggtcaaggctgcagtgggccaaggttgcatcactgcaatccagcctgggtgacaaagcaagactgtctcaaaaaacaaaaacaaacaaaagagaagggtagcaggtgtacaaaaataaattcactacacaagagactaacaaaagagtgtaaacttcatatatacttgtgtgtgtttgtgtgtgtatcacacagttcactctgaggctaaataacatctaaggacaggatatatgttaaccactattgtgactataatcacctctcagtgtatgcagccttggtgagtacagcctttaccacagtatatcccttacctaaaattttcaaattaatgtcataaatatttataagtaatcacttattttgtgtatgcgttggtactaagtatgacataggaactgagaaggaaaacaccactatacatttatataatactttacaaagctactttcatacgtatctcatttgaccctatgagccagaactggagtcattagtcattatacccactactacacaatgagaagaactagtgtgccaagcttagagcaacttagccaagttcaccattggcaagatcaaaccaagaactttgggttcttgactaccagaccactactgggatattagctgcctaccacaaaaaggcttctgccctcaaggaattaatctctgacacctaatgccttgactggtgtttctcagatgtaccaagtttcttctcagaaagaatctcactatctcctggtccaacatacactgaatctaatcaagatatttatagaaaaaggttatttattaatatcactgacaatgaacagatgtgagttccttctggaggccagaatcgttaatgagactgaataaaactgaattaggacagagtgctcaaaatgtatctgtcactttgggataaatacctcattttgcttatggatatgatactgccctctagtgccaggaagcacagtaacaatcagcaatctcagtagattaactcacctaatgcatatgaaccacctaccatgtataaaaatgctttgctagacaccgtggagaaaaaaagaagaaagaaaaacttaaacctatcacacacatacaaccatcaaaaccacataagccccttgaggaatctataaatataatagagaatatgagaaatgaaaaacaaatcactacaatcagagatagcgttacaagtgctttaagagtttgcagataatacattactagagtacaaaagggattaggtaagcttcacagggcaacagcatataagctatctgaaggccttcataaactagagatgaacaacatgagctaggacttggaggtaggaaatctacaaggttaaggtcacagccaacactccccagtttagctggagcattacgtttgtgaaaaagagtaacagaaggaaggctgactagggtcagactgtgaagggtctagaactgtgctatcagacatggcagccactagccacacatgctatttaaatttaattaaaatcaaataaaattagcagcacatgtcccagctacttggggaggctgacagaattgagcccagagtttgagtccagcctgggcgacacggtgagactccatctctctctttttttttaattaaattaaaaattcagccgggtgcagtggctcatgcctgtaatcctcccagctctttgagaggccaaggcgggcggatcaactgaggtcaggagttcgagaccagcctggctaacgtggtgaaaccctgtctctactaaaaatacgaaaaattagccaggcatggtggcgggcgcctgtaatcccagctactcaggaagctgaggcaggagaatcacttaaaccctggacatggaagttgcagtgagccaagatggcgccactgcactccagcctgggcaacaagagcaaaactccgtctcaaaaaaagtaataataattcagctcctcactgctttagccacatttcaaatctcaatgggtacatttgacttgtggctaacatattgtgttatatcaataccaatactgattgatgttagatctttcatagatctaacatcattcatattgtatcagaggttgtataaaatcataaaacaccaacgtttcatgatggctcagtcctgaaaaaaaattcatgcagatgtgattgatgccaaagtctattaataaggaaaataaagctataaaaaaagaaaatattaagaatttataataataaaacacaagacacaatcattttcactgggtatctttgagtattacaaggaagaatgatctttgtccctcgaacacctgcttcagcccaaaagcagggacatcagatattcttaatacttttaccatttgaggcaaaatctgtttctcttgtgcagtttacaaaatgacagcaattaaaaaaataatgtgtatctgtagaagacataatttcaaattttttttttttttttatggagacggagtctcgttctgtcgcccaggctggagtgcagtgtcgtgaacatggttctagcctcctgtgtagctgggaccacaggtgtacaccaccatgcccagctaattttttcatttttttttttctagagacagggtctcactttgaagcccagcctggtctcgaaatgctgggctaaagtgaccctcccagactcagcctccccaagtgttgggattacaggcatgagccactgcacccagcccataatttgagtcctttcaagactgagtcaatatacagaattctaaatgaaaggttctaagcacactataaaatcagcaaagtagccgggcatggtggctcactcctataatcccagcactctgggaagccaaggcgagtggatcacttgaggtcaggagttcgagaccagcctggctaacatggtgaaatcctgtctctattaaaaattcaaaaattagccaggtgtggtggcgagcacctgtaatccctgctactcgggaggctgaggcaagagaatcgcttgaaggcagaggttgcagtgggcagagatcgcgccactgcactccagtctgggagacaaagcatgactctgtcgcaaaaaaaaaaaaaaaaatcagaaaagtgtagttaattgcttagggtagttatctaacattaccattctgatcctacttatcacaagcctgaatctctattgcctataggttttttttgcatgtaacacagatatttttaatgatcagattgaaaatatggaacattacaatcttttgaattacaaagtcaaaggtagcagcccaagtcctaagccatactatcccccgcctctcaaataatcttccctttaatgttgccatggtgtttctttgacgttagtccagaacagttctagatattcaaagaaaaagcaactgcctctcaaccaattcttaaaactattctcagctgggcgcgatggctcacgcctgtaatcctagcactttgggaggccaaggccggcggatcatgaggtcaggagatcaagaccatcctggctaatacgtgaaaccctgtctctgctaaaaatacaaaaaactacctgggcatggtggtgggtacctgtagtcccagctactcgggaggctgaagcaggagaatggtattaacccaggaggcggagcttgcagtgagcagggattgcgccactgcactccagcctgggcgacagagtgagattccatctcaaaaaaaaaaaaaagaaaagaaaagaagaaaaaaaatattctctctgcaaactgggcactgataatcactccatctcgtcttcgatgtgtccattcattgctgactccacaggctcaaatcatcctgttaaaattattaaaatcccaaagaaatctggaaaactcaaaagaaatgtctaagtgtttagaaaagtagcatttacataattattatacattgtatataaattctgatagtagataattagggtttccaagataggagaagaaaatattgacaattctcttttattcatatttgacaggatttggataaagctcctattgtcgtttttttcataacctagaactcttctaaaagaattttcctcaaatttaaaagtgaacttttctaaataactcaaatgtgtccattctactcccaaaggattttcttttcctgcagtataagactatgaaagaagccgagcacggtggctcacacctgtaatcccagcactttgggaggatgaggcgggaggatcgcttaaggctggggttcaagaccagcatggccaaaatggcaaaaccccatctctacaaaaaatataaaaattagccgggtgcagtggtgcacgcctgtagtcctagctactcaggaggctgaggctggagaatcacttgggcccaggaggtggaggttgcagtgagccatgattgagccactgtactccagcctgggccacaggagtgaaaacctgtcttaaaaaaaaaacaaaaccaagactatgaaggaaggctgttcacataggcaaactcttttaatattgataagaccagtccaaattgttcaccctaagcaaaactaagacgcaatacaagtaaaaagccttccaagtgttattttattttaaattatgatgtcttagtgttataaaccttaaagggttatctatctactttcaagtattcaacagacagaagaaactgaaatgatcatcaatagctcccatttgtatagtacctaaggccaaagtgcattttatggataaaacattgaatctgacccacataaagagtaattccgccttattaaagaaaagttttttcttcccttattccacaatctaggcttggctatatgagctctgcacggtggggaaaaaaggagtaagaaagtgaaacatcctaatcactgttccaccaggtcatgaaatgcaccctacagtactatgttcagttatctatttgttgggtgctcaacaaactttaatacaaatcctgggagaataaaccacccaaagtcaaagcttggatggctacagagaaataggactgggataaaagacagcagttaagtttgaaaggaaacaaaagcatgcaaatcccaaaggcacaaatactcgaaccttcccgcaaactgtgataatgggtcaggcacactgctgagtaatagctgtcctttctcggcttcaggacaatccacgagagtggcagaatcctgcaggtggactgatgaatcttggccttctcctccagcatgctggaggagattcgagtctccacaggccaatgctgcaataaaccactcttccttccctctctccttaaagaggccatttattatttgccgaagatctgattagccctgctctttaagttaaagtgggcacttcattctacagtgcaaagggttgcaagaacagttagatcccaagtttacttagggagtggggcattaaaagcagtgacagcagaaggtcagaatcagtaactctactggcaaaacatttcttcctgtcagcactgggcctagacacagacacctccctcttctatccaaatgccaaaaagcagaactgagatgatttcaatgtgtagagctggaagaggagagggttcccttagagaaaatgctcatagcaaccaaccaacctcattcacccaaaatagtaaacagttggtttctctgctcagaaccaaaaggcttctgccagacaagcagtatcacatgactaggttccctcttctctctcttgccctccctcccttcttgtacaaagcctgcacccaaaatggaacaaggagctataacacaacattattttactggacacattcatctttaaaatgtttgaagataaaagataccaaaaagcagaggggggaggtaccaaaggaaaaactcaggaagaatttactttgaaaaaagtcctatcacagtactgatgtgggaaccataaacgtaatggttaactggcaagtgtactcaatgaatgaaaaaacaaatggacacttctcaccaatttgtaaacactttgctgacaaaatatttaaaagaagatacagttcaatacatatttgacctttcctttagaaagacaatataggctcttaagatgctggctagagtcagagataatatattggcacaatagtgacaacccaccaaaatttgggattcaaacccttatcttgttgacctcagcttacctcaccatttgattttactccttgtatgtcacagtcccatcattcacatcattaggaaggaaatcaggacagctacactaacaggcaactgaaaaatctacccagctgattatgaaaacaaaggccaccatgacactggcatttccacctaaacagaagggggaagatattaaggctgacagcacagctggaaccagatgtgccaccatattcttctccctacaaggttcctcacacttgaaagctaagcgaggcatgcagtatagagacacaaaaatgaaaacctctatgctgatcaatctgttccactaggaaactagataaagtataagaatcaaaagtgtcacaatcatctgccatgacctctactcacagggccaacaggggcactttgagagtaaaatcactgatgctcgtccatcccttgcactgtaaactgctcaataaatatttataaagtggaaagaaaaggaaaaggaaaatgaaagaggaaaaatttacatgagaaatccttaatttaagcaacaatttttccagcaagagcatgtggagattgttacttggctactgtcagaatacaaataccagcaataaatgatttgtcatcaaggatgaggagcaactggaactcccagacattactgaggaggatggaaaacgataatgctatgtagaaaaacagtttgggagtttcttataaatttacacttaccataaaacccagtaatcctattcctgagtatttatctaagagaagtgaaaacatacatccacataaagaactgtacattgtctttggataatagtgtttaggtctcagttctgtgcctgatgtaaattgtctaccttgtttcacctaagaagcgtgtctttggaaatgtgaatttagagttgcctagctaacaactcttcaggggaatgaagcaggtaattgaaattgatagtctaaagtgggagagagaaactatttgaaaactggtaaatgaaagatcttagatttctgtgtgtctctatgcctatatggtttatatgtgtcacgtgtatgtggtatttcactaccaaattatattaaagagctcttatctattggcttagagaaaagtgcttttctattgtctctgaaataaaaataaactcaaatgccttttagttcatctgactttagtaataaagggagatattattattttatattaattgtaattaacatgtcattaaaactactaggttaaaaaaaagagctatatgtgaatattcgtagcagctttatttgtgattgccaaaaagtgttcttcaacttgtgaatggaataaaaaattatatacaggccagatgcggtggctcatgcctgtaatcccaacagtttgggaggccaaggtaggaggatcacttgaacccaaggagttcaagaccaaccagggcaatatagtgagacctcttctctacaaaaaccttaaaaaattagccaggtatactggtgtgcacctgtaatcccagctactcaggaggctaaggtaggagcatcactcgagcccagggggcgaaggctgcagtgagccgagatcatgccactgcactccagcctgggtaacagagccagactctgtctaaaaaaaaaaaaaaaattatggtacacccctttaacagaatactacttcagcaatttttaaaaacccaataaactattgttacaggaaacaacactgatgaacctcaaaagcactattatgctaaaagaagccagaaggcttcaaggcaaaacaacaggcagaaatcagatcagtgattgccaagggctgggaaacagggaaggagactctacaaagaggcataatggaattttgggaggtgatggaaataatctatatgtcttgataaaaggtggtggtttaccttttagcaaaactcactgaactgtacccctaaaaaagtgactattactgcatataaactgatctcaacttttttttttttaaaaaagcagattacaagatattatgcatagttaagagtacaggcttggcaaagcacagtagctcacgcctgtaatcccagcactttgggaggctgaggtgagaggattgcttgagcccaggagttcaagaccagcctgggcaatacagtgagaccccgtctctactaaaaataaaaattaaataaatactttaaaaagtacaccgtctcgagatcacagtgaaaccctgtctctactaaaaaaaaatacaaaaaaaattagccaggtgtggtggcgggcgcctgtagtcccagctactcgggaggctgaggcaggacgatcacttgaacctgggaggtggaggttgcagtgagccgagattgcgccactgcactccagcctgggccacagagcaagactccgtctcaaaaaaaaaaaaagtacactgtctgggctgggtgtgggggctcacacctgatatcccagcactttgggaggccgaggtgaatggaacacttgaggtcaggagtttgagaccagcctggccaacatggtgtaacactatctctactaaaaatataaaaattagccaagtgtggtggcggtcgcctgtaatcccagctacttgaaaggctgaggcaggagagtcgcttgaaccggggaggtggaggttgcagtgagccgagatcaagccactgcactccagcctggcaatagagcgagactccatctcaaaaaaaaaaaaaaaaaaagtacactgtctggctgggtgcagtggctcatgcctgtaatccagcacttgggaggctgaggagggcgaatcacgaagtcaggaattcgagaccagcctgaccaacatggtgaaactcggtctctactaaaaatataaaagttagccgggtgtggtggcacacgcctgtaatcccagctactcgggaggctgaggctggagaagcgcttgaacctgggaggtggaagttgcagtgagccaagattgcaccactgcactccatcccgggccacagaatgagactcagtctcagaaaaaaaaaaataaattaataataataataataataataaggctctacagctagattgcttgggttcaaattttggctctaccacttagcagctgctgtgaccttgagatatttaacatctctatgcctccatttcctcatctgtcaaatgaaagtaacagtttcacctcagatccataataaatgcattttaagtaaaggacttaaaacagtgcccattctataagcactcagtaaatttgagctgttgtcctcacacaattatgtaacacatacatatacatgtttctatatatgcacaggagagagtagaagcacagtcaccaatctgggtggttggaatagaacaatctattttctctttctcccttttgtttatctgtatcttctacattttctacattaaataactactgtctttataataagccaaaaatctttttctcaagaaagggcaccaggctgagtcaggagtcctggtttccagcaagatccataataaatgcattttaagtaaaggacttaaaacagtgcccattctataagcactcagtaaatttgagctgttgtcctcacacaattatgtaacacatacatatacatgtttctatatatgcacaggagagagtagaagcacagtcaccaatctgggtggttggaatagaacaatctattttctctttctcccttttgtttatctgtatcttctacattttctacatcaaataactactgtctttataataagccaaaaatctttttctcaagaaagggcaccaggctgagtcaggagtcctggtttccagcaatattactaatctctacaaaggagtggctggagtagacaaggtgtcctctatctctaaaatggaatggttctctaagatttatggtgggatttggcaaagctacaccctttgttttgtttcatttttctgtcaatacttactgtctgcctatcaagtaccaggtgttgtggacacagaaaggtgaaacacctgcccaaatggagttgacactacaggctgttcaagaaacggagacagccttgtaactatttatacaatccctcagcatggtaagtgctctgatgaggacaaagaagaggggaccttgctggggctggagagttagagaaggcctccaggaggagagaaggcacctgcactgaaatctaaaatcatttttgtttaagtcaaaccaaaaagatgggaagggcattccaaccaaaggcagaggaacgcacaaaagcaaaagttatgaaaataacaattacttgaggaatggagaatagagagaaagagaaatagagaaaggtcatttggacagcagtgtggaaacaaggagggacaaagacagcagcagagaggctggtgaggaagaggaaaataatcttcagaaatcatatgggtcaggctggctcacgcctgtaatcccagcactttgggaggccaaaacaggtggatcacaaggtcaggagttcgagaccagcctgaccaacatggtaaaaccccatctctactaaaaatacaaaaatcagccaggcttgatagtgcacgcctataatcccagctactcaggaggctgagtcaggagaatcgcttgaacttgggaggcggaggttgcagtgagctgagatcgcaccactgcacttcagcctgggcaacagagactgtctcaaaaaaaaaaaggaaatcgcatggggtagtaaatcttttcttcttatgtaaaaggctacatatgccataaacaaacctgataaatattagtttaagatgtaccttggccgggcacagtagctcacacctgtaatcccagcactttgggaggccaaggctggtggactgcttgagctcaggagttggagaccagtctgggcaacatggcaaaactcagtctctacaaaaaaatctttttaaaatattagatgggtgtagtggcgcatgcctgtagtcccagctactcaggaggctgaggtgggaggactgcttgagcctgagaggtggagggtgcagtaagccaagatcacagcactgcactccagcacctgggtgacagagtaagaccctgtgtcaaaaaaaagaatgcactttactatatttacaaatatagcatgcacttacaaaaatttaccaaacaaaatgtcagcatgcttctattttccacagttaacggtacacacttcatatatatatatatatatatatttttttttttttttttttttttttttttgaggcagggtctcactctgtagctcaggatggagtacagtggcatgatcacagctcactgcagccctgatctcctgggctgagatgatcctctcacctcagcctcccaagtagcggggactaaggtacaagctaccatgcccagctgatttttgcatttttttgtagagatgaggtttcaccatgttgcgcaggttggtcttgaattcctgggctcaagagatccacccacctcagcctcccaaagcggtaagattataagcatgagccactgtccccagcctcattcaataaatatttgttgagtatgtgtcatgcatatggtaggtgctgagggagaagacagacacagacagtaaacaaatgaaccatcaaagcacccaagacaaccaaccagatgtctttttgtatggccaagacctatgcagatctctacctctcaggagcaggccacaggcaggatgatacagtggctaggaatttgcacttgaaatcagacagacctttgtttaaattttagctcttatcacctgttgccaactctggttttgagtaagttacttaacctctctaagctttcatttccttacctgaaaataaagataatatgaccaaatttatacggttttagggtgaatttaatcaatcaatcaataatcagtgtgttgggtatacagaatgttcagccaatcgtcccttttattttattattaattttccacttttagaacagacaatgatgtcccacaacacagacaaaaatattcacagggtagaaaaaaagggaaagaaaggtataaaaatgatctgtttaacatttctaaattcacatcttagtgaattcacaaccgtttttctcgtaaagatgtcatgcttggaacttacattcctttaggatttctcaaactgttaacatcttgtctgcattacatgacctagtaaattaaataaaatctatcacccaaaatagggaaccagccacaatctctccctggattccttgttctgattctctgactaatactgagtcatttaaagaacacagacaacacagagcactgataagcagtctgaacacaaaactgaggagcagaggtgccagagcacactatggactgaccacagactacaagcagaactttctgaaacagaaaaatcaagataaaaggagagtttcctaactggctgtaacttgagtaattatgccttccaagagaaaagcagcacagaaattaacatatttctcaagccagaagaaaacttttttaaaattttaatacctccttatctgtgaaaaaaaaatttttaaccaaattttaaaactccttcctccctataattacatcctcaaaaatgttttaactacctcttaaaatgtttatttcttacaaatgactctgtaagcaacactggtcatttaaagattttgaaggcatacataaaacacaaaaagaaaatgtcttctctgtgacctgacaccttaagggtcaaactgattttacttcaactttcaccataaatttccctttgtattaaaaccaggtgtgacacttcagcccaaaaacaagtatttaagaagcagaggaaacctggacaagattttcaagtagacctttttttttttttttttttttttttgagaccgagtctcactctgtccccaaggctggaatgaaatggtacgatctcggctcaccggctcaccgcaacgtccgcctccagggttcaagcaattctcctgcctcagcctccctagtagctgagattacaggcgctcaccactacacccagctaattttttgtatttttagtagagatggggtttcaccatgttggccaggctggtctcgaactcctgatcttgtgatttgcccacctcggcctcccaaagtgctgggattacaggcatgagccaccgcgcccggcccagtctatgatttttttttttttatgcttcattaaagtaaaagtctatgcctacaaagagaaataataacatactttcatattgctttctttttttttgttacagtttttattttttttattttttttttaacatttcattttttattttttttatatttttattttttttaatttatttttttattgataattcttgggtgtttctcacagagggggatttggcagggtcatgggacaatagtggagggaaggtcagcagataaacaagtgaacaaaggtctctggttttcctaggcagaggaccctgcagccttccgcagtgtttgtgtccctgattacttgcgattagggattggtggtgactcttaacgagcatgctgccttcaagcatctgtttaacaaagcacatcttgcaccgcccttaatccatttaaccctgagtggacacagcacatgtttcagagagcaccgggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttccagcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcggggggctgaccccccaacctccctcccggacggggcggctggccgggcagaggggctcctcacttcccagtaggggcggccgggcagaggcgcccctcacctcccggacggggaggccggccgggcagggggctgaccccccccacctccctcccggacggggcggctggccgggcggggggctgacccccccacctccctcccggacggggcggctggccgggcagaggggctcctcacttcccagtaggggcggccgggcagaggcgcccctcacctcccagacggggcggctggcccagcggagggctgacccccccacctccctcccggacagggcggctggccgggcggggggctgacccccccacctccctcccggacggggcggctggccgggcagaggggctcctcacttcccagtaggggcggccgggcagaggcgcccctcacctcccagacggggcggctggcccggcggagggctgacccccccacctccctcccggacagggcggctggccgggcggggggctgacccccccacctccctcccggacggggcggctggccgggcagaagggctcctcacttcccattaggggcggccgggcagaggcgcccctcacctcccagacggggcggctggccgggtggagggctgacccccccacctccctcccggacagggcggctggccgggcagaggggctcctcacttcccagtaggggcggctgggcagaggcgcccctcacctcccagacggggcggctggccgggtggagggctgacccccccacctccctcccggacagggcggctggccgggcggggggctgaccccccaacctccctcccggacggggcggctggccgggcataggggctcctcacttcccagtaggggcggctgggcagaggcgcccctcacctcccagacggggcggctggccgggcggggggctgacccccccacctccctcccggacggggcagctggccaggcggggggctgacccccccacctccctcccggacggggtggctggccgggctgaggggctcctcacttcccagtaggggcggccgggcagaggcgcccctcacctcccggacggggcggctggccgggcggggggctgaccccccccacctccctcccggacggggtggctgccgggcggagacgctcctcacttcccagatggggtggctgccgggtggagaggctcctcacttctcagacggggcggctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggccccgcggggcccgtctgcttctccagccgctgcctcccgggcggcgctcgccggcgcggcggcaaagactgagacagctccgctgcccgctgaactccatcctccccccatattgctttcttttattggtggtttacaatctcctttatgaagatagtcctctgtagattaactgtcacgcttccaggaaacgctaggatcttttttccttcctagtgtcacagaggatacctacttgctccccttctccacttttcccatcccccttccccaatacacccacacaccctcatctacgcacagggaaaccagcagctagtaaagcttctgaacaacctgtgcctccctgctctgctctattctgcttaaaggcctccaagctgtactgtgtatcatcaagaagagtctaaagaaaccacaaaggcaggttcttcactttagatgcagaactgaactaacaaggctagaaatctgttcatttgtgcttcaccacaactgtgtgatcatcccataatgtatcaccatttactctttttaagtggttcagatgtcaccagacaattaatttctccacattatgaactgtcaacaaaatcagaaatgtagtctgggggccaggcatgattacaggcgtgtgccactatgcgcagctaacttttgtacttttagtagagacaaaggttttgccaagttggctgggatggtctcgaacccctggcctcaagtgatctgcccgcctcggcttctcaaagtaccgggattacaagtgtgagccaccgtgcccagcctataatgttatttttagagtggagtgtcctttatcacatatacttagcttgagactccgatattattgatcaacaacaaatagtctttatcaaggctgtactgcaaagaaggcatcagtgtttcccaggatactggctgggcgcagtggctcacgcctgtaatcccaacactttgggaggccaaggcaggtggatcacttgaggtcaggagttggaaaccagcctggccaacaaggcaaaaccctatctctactaaaaatacttagccaggcatggtggcgcatgcctgtaatcccagctactcaggaggctgaggcaggagaatcccttgaacccaggaggcagaggttgcagtgagctgagatcgtgccactgcacttcagcctgggcaacagagcaagactgtctcaagtttaaaaaaaaaaaaattcccaggatacttaaaaaataataaactgcctgaaacttcatagattaattcaaaagattcagttaaatttatataaaattaatttcacagctttaaatgtaaatggtaaataaagttcaaaactgaactgaggatgatgagccttctctgcataagttcattattttaagaaaacaaatattttataattgaaaattagatataaaaattcataactgactacctaattgctttgtggctgaaaaaaaattaacctagacttctcaaatttcttaagactcaagttcttgtagctgggcatagtagctcacatctgtaatcccaggtacttggaaatttaaggcagaaggatcaccagaacccaacagttcaaggctgtactaagctatgatcacatcactatactccagcctgaggaagacctggtctctaaaaaaatacaaagacttaaattatcagataatctcaagataaatgctatatctaatcagaaattaggccatggctggttccaaacaagtcagtacatcacatcagcctttctgttaggaaacagtaccttttctgattaataaaaccagatgagtggtgaaaaacaatttaacattacttctaattctaatatttttatgaaaacaaggaactgaaaattattttctgaaactagatcttaaaacttcacccacacaaatgtaagcaatctaaatgacaaggaaagaaagaggaaagcagttacttatgtaagtgagaaacctgaagaggatttgatcagaatcctcaacttagaatgaacctcaagatgtgtgacaaaggccatgccactcttttttaaattatgaaacattccaaattggaatgaattctctggatatagtatctttgaggaaactcagtcccgccaccccttcatgtccatcatcttacaaacatggcttaaaacttacctattctaagaaaccttctcaaaaagctgatcctctacttgctgtaccttcaggataaagtttcctcttattttgtagcataatgactatatctatccccaaccgaatgctaagctctttgaggaaaaggattagccatgttgtttactttttttggccacaaaataaaacagagctctatgcaatggatactcaataaacattatcagatactcacagcatctagtccactgtctttcaacagatgctcacaaattactgaattcttagtaatttatcatcattgccaactttcaggcaaagggaaatggaaagacctcaaactcaaaattagcccctgctaacgataacatctagactgtagggatcgacatttatgtcaaaatgaagttaaaaaattatctatgagtcttatccatcctctctcatactgtatctaatcaagagactacatggcttaatagtcaggtgttttgaggtcaagggtttaaactctaacttcagcatttatcagctaggttccagtttcttgcaaagtaaaattttacttatcttaaagaattgctattggagttaaatgacataactacttaaagtgcccgatacaagagaagtagtcaatacatggtagctaatcttactgttcaataagtaatgccatggtttgaatatgtcccctccaaaattcaggagttgtcaacgtgatagtattaggaggtgaggcctttaaaagatgattaggctatgagggaacctccctcatgaatgggattaaagcccttattaaagaggcttcacacagctttcgggtggcttgcccttctgccttatgccatatgaggacacagcgttcttcttcccctgcagaggatgcagccctcacaagacaaccaaacctgctggttccttgatcttaggacttctcagcctctagaactatgagagataaatttctgttcttaataaattacccagtgtcaggtattctgttgcagcagcacaaaatgaactaagacaattataaagaaaaagtagatataacatagattatattattaaagtgcattggccaggcgcggtggctcacacctgtaatccaggcactttgggaggccaaggcaggtggatcaacaggtcagaagatcgagaccatcctggctaacacggtgaaaccctgtctctactaaaaatacaaaaaaatcagccgggcatggtagcgggcgcctatagtcccagctacttgggaggctgaggcaggagaatggtgtgaacccgggaggcggagcttgcagtgagccgagattgtgccactgcactccagccactccagcctgggcgacagagcgagactcttatctcaaaaaaaaataaataaagtgcattatgacaccaattctttgataaaatatagtatataaaatataatcccttcttgaatgtgatctgcttcccactgtagtgaacttccccacaaaaatgatctctgcagtaaggtaatttgccaagtagtctagaaaataagattgtgcacagatgcacacttatacttcccagcataactcagttttatgcaatatttacatattaatgggaactgaacacccagctctttactattaagaaactgtggtatttatccccaatatcttacaatctacgtctcactggcatttgaaggagatgtggcttcttcagtgcccaacgaggttggatgttcagggacttattccaacctacttgttaagaatcttaggcaaataataattctctaaatgggggggtgatgaatcatgactttattcaactagctcattctgactgctgcatttatcaactactgtttttctatataccatgtctctaaaactaatgacccccatttatcaccattttcactgtttaaggagagtttaaaaatatagtagcataatactattagcaaacagctaaccgagtgtactagctaccagcaagcacatgtgacacacaaaaagtgctctataaaatatgtcaatgaaatattgctgaatacaccattattttaattcttcaatgaccacatataagaaatgctgattctgcttattatggttggtgaattctgactaggatacattacggtctccaatggcaccttgttaaaagctgctatgccccaagagaagcatactacaatcttagaaacttctcctttggccaggcatggtggttcaaacgtgtaaaaccagcaatttgggagaccaggcaagtggatcacttcagtgcaggaatttgagaccaacctgggcaacaaggcaaaaccccatctctacaaaaaatacaaaaaattagccaggcgtggtggcatgcatctgcagtcccagctacttcagaggctgaggcaggataattacttgagcctgagagttcgaggctgcagtgagcagtgattgcaccactgcactccagcctgggtgacagagtgagaccctatgtcaaaaagaaaaaaaaaagaaacaaacaaacttcccagctgggcgccagggctcacttaagcccaggagttcgagaccagcctgggtaacatggcaaaatcctgtctctaaaaagaatacaaaaaattagaagggtgcctgcagtcctagctattagagaggctgaggtggggggatcacttgagcctgtcaaggctgcagtgagctatgacggtgccactgcactcccacctgtgtgacagagcaaggccctctctgaaagaaaaaaaaaaattgtcctagattaagaaccactgggttatttcaaggactaaagaagttgatttaggccagatgcagttgctcacgcttgtaatcccagcaccttaggccaaggtgggtggatcacgaggtcaggaattagagaccagcctgaccaacatggcgaaaccccgtctctactaaaaatacaaaaattatccaggcatggtgacacacacctgtagtcccagctaccaggaaggctgaggaatgagaattgcttgaacccgggaggcagaggttgcagtgagccgagatcaagccactgcactccagcctgggaaacagagcaagagagagcaagactccacctcaaaaaaaaaaaaaaaaaaaaaaaaaaaggagttgatttatatataaagtacgtagaacagtacctgggcacaggtgctgttactaagattagcacagtggcttctagggaaacataagtttctcctagcagcaattgaagacaattagattcgtccccaatttgattaagtaaacaacaaaaattcaaataaatcacagatgctgataggatgtgaaaaaatgtgtttgtctattcccaataagatttatttacgtgctgggcacagtggctcatgcctgtaattccagcactttgggaggccgaggcgggcagatcatttgaggtcaggagttcaagaccagcctgaccgacatggtgaaaccccacgtctattaaaagtacaaaaaaactagctgggcgtggtggtgcatgcctgtaatttcagctactcaggaggctgaggcaggagaattgtttgaactcgggaagcagaggttgcagtgagctgagatcatgccagtgcactccggcctgggcaacagagacagactccgtctctcaaaaaaaaaaaaaaaaaaaaaaaaaaaggattcatttagactcattaccactttctatggatataatgtattctgttcatactgaaatctttggcctcacagttgaggttgtctctcaattggaagtttctttaaggtggaagaatgttagtaatatgttctttccattgtaactgtggtttgagggtacttttttttttgcaaagtaagagtctggcttctggctgggcatggtggctcacacctgtaatcccaacaattttggaggccaaaacaggagaatcacttgagctcaggaccagcctgggcaacatagcgagactctgcctctaccaaaaaaaaaaaaaaaagaacttggtttctaagattatcatatgctttgtgttcacggtagcttttaacaaggtgctggtatcaacagctcaaccctcaaacatccatgctaacagcagaaaatacattgcacagaaagaaaagatggtagacagtatcttttagagtgggcaggaatgcttgtatttgtatttagtactgagtaattatttccaattttcgaggaagtcacaaagctgccacaaattgtttaactatacaattcttcctttgccagggtccagtgcctgctcagcttatcatttcatactggcaaacaactatacaacttttcctcatctgtgatacaaagattaaaataagcagaggtggtcacattctaaatatttcctggttcacaccttcccctattagggaaatcacttttgggcacaaaagatcatccattctaactcttactgggcaaatatcttgtttgtgtcaactaagtattttgtacacagaatataatgccaatatcattaagtatttgaaagaaagatttgtcaaaaatatccctgttatgacctactcttaggataatccaggattgataaaaagccaaattctccccatagccgaaagaggtttgcctcagcctaaggctattttccctaagtgagagtttctaaactttctggtgagcttctctttctcatccagctggtcaaagttttctgataacaacataccacacaactgaaaagctaagtttctcggcctgaatttttgtttatacctgatagaagctactgctttctcctagtggaaattcaaaatacctaagtttatctccagaaaactcttcaaatactttcagtaatctaatggcaacagctttgctactaaaaatttcccaacatcttcctgtttgggcaggtcttgctgaaatccccctcctcataaggaggaatttgagaaaaaatactgccaacttcaagttcccttaggcaaatttccagccccagtgcaaggccatgaggttaaacatttctcaatgacgcaggctccctcagagggaggaacaagaaaaaaaaaaaaaatcaaaacgtattcttcccactgcagtaaatcaagaaacagcagccaagtactttaaaaaaaaaaaaaaagtgaagttaatactgtttgctctgccaaggcccccagtgggagtacagaacccaaatgagagctgtgggatgagagaaaaagaattgcagaaccagcaatccagtcaaattgacagatatgtctccagattctctagatagtctctggagtaccaatacagtgtaaggtcccagccactgtataatttacaataactaggacaactaaagtaaagtgattgaattagtggctgggggtaaggaatggtgtcacacattaagcaaatcatgattcaggattaaaatgtacattaggtgagaggccgggaaaactaaaggaaagtacatttaagcaacttctcggtgaaggaatatataaggctgatcacaaagaaggcaagctcatgtgaggggctggtagggttcttgaacctctggccacctgcagataaataattgattgaaataaaacccgaaatgttctccagaaacagattaatacaaaacagaattttagagttcaaaaggtcctaaatgcttacaagaaaatgccagtgatgaaaatatcatgtgtacagtgctttacttctcaaagtgctttcactgaatcattaaataaaaattattatgtacctgctatgtgttaggaactggcaatacagaaattggataccacccctgctttaaaggggccatacttctaacaatgagacctgctaggaatgaaaatgcagcaaacaatcagtctttggtggtatgcagtaaacataaggagagcacagcagaaggggcaccgaagtttctgggggaatcaaagacagcacacatctcagaagagacagcccttgaagtgaggccagaaggctggcaagcagaaagactaacggttatatgcaaaggaatatatgtgctttttttaaaaaaagcacgaagtgttctgggaaccaaaagctggtcagtactgctggggactgtgagtttggaagtgatatgagataaccacatagtcagagaccagacaaataaaatagcttaagttttaccccacaagaaatggaagaattctgagcaggagaaagaaaatgattagaattggtagttagcgaaagtatcttggcagctgaatggacagattggaggagagttgaactatagccagggagcccaataacaagtcccctgaaaccacagagaaaaatgctgacaatatgatatagggcagagagacaaaatataagaagtcaaggtagaggtaaaatctagagaactcacaagtcaaatagatatgacaagtacaacaagaaaggaggaattgagactgactcctaattttctggctagggcaactggcactataaattagggaatgcaggttgggagtagtcactgagaatggcgatatcagttttaagtgcacactagtcatttagatgtccaggtgggaagaattagtggattaactgaatctagaactcagtaaacaggtcagggatatagatacatatacacgtatcacatgtgaatacctttcctatttggaggaaattctaagacggggaaaggcagtcaccttttcccactacaggaactgacagtaacagaaattccctctctctgttccctggcatctagttcacaaatatataacccaagtcaatcagatcctcctatgtagatctttgaatattgaaagaataacacaaaggtggaaaatataatcagaaattattcatggcactgtggcaagtgcctactggtggcagtgccagtagtaacagatgttcatgggagaccaggccagcagcagtggcagagaaggtccagcaagcagtgctagagagagtcctcagccaactgatcccattacatggtctttactatgtcttgcctcactcagtttctgctcattttctgaactgtgttatccagccttccttttaaggctgtgcactatccaatacttttccaatatatttattttatgcttaggtgaaccaagattatgtgaaaaatcctgagtagtacagaacgaggagggaacatagaacaggtgagatgaggcctagaatgggcccactatatagggtgactagtaggtcactatgaaattagttcatatgtgtcatctccttccatccttacggtcccttgtgaggaaaataaggccaagtaccatatctttattttaggataaataaactgaggctaaaagagattaagatcatacagttctttttgctatccaagagtgtcctcaaaaaagttgttttacaggtgctcatcaaaaggagatgttaaatgagcaatactaattcttacagcaaatgtcaatggacacagatgataaccacacatgggtcccaatgctggtcttccagcttcttcaattttggtaatataaagaagatcctaacagaagcattaaattccttatagacaatcacctagaaacatacctaatgaggatccttgccatcatccttccactcagggtaccttggttactactgaaagaatacatcataagctaaagggattcctcaagtggaagaaaggatcatctatccctaaccatgagaaccactgtgggaatgagaggttgagagctttcgaaagatgattatttctcaacttcattcctttgggatatgtcacagccagtaagggagaaattggaaaaagcagctttcacaagctgccaaatccatgtcctagtcccaagggataattagccagtgaggttttgtggagctgatgtaatgttggcagaggctaatgttttatggttgaacatgtagcctcttgagttttagctacagggctaaaaggatgacatcctgaaaagctaagaaattcatacccataacaccaccacttcgcaatgtgcatcttaaaagtaatttgtaaactttaactgatccatctttatcatgattagttatgaacatttgttaaactataaattctctaaattttattttatgtaactattttgctatgaaaagaaatttctaggtaacacagacaatttagaaagcttaaagtaacaaaataattagaagaaaggaaagttttacaaggagtgagtctgtttgtggcactttcatcccactaccaccacaccaagtttaaagccatctgatgagcttatgaaaacaatttttgaaactgagtagtctaagccaaaagtgttcaggagtaccaaatctctcacaaaaagtgtcaatcttagaaaccttagaagtattctgagatgcaggaggtaagaattaacggacaagaagcagaaatattaaaacactaacactcttggtttgagtttgagctgttaaacttcttgcaggcctggcacggtggctcacgcctgtaatcccaccactttaggaggccaaggcgggtggatgacctgagatcaggagttcgagaccagcctggccaacatggtgaaaccccatctctactaaaaatacaaaaattagctgggcatggtggtgtgtgcctgtaatcccagctatttgggaggctaaggcaggagaatcacttaaacccaggaggcagaggttgcagtgagccaagatcacaccattgcactgcagcctgggcaacaagagcgaagactccatctcaaaaaaaaaaaaaaaagaaaaagaaaaggaaaagacaaaatgcttgccatttaaaaaaaaaaatgagtcctttgacttaaatatgccacaatgatctccaaatcctgaacaaaactaagtacattaataaaaaaataaaatcactaatcagtaaggcaaaatatgtagtgcttttaaatatgtgctagctccttaataagagacaacttttgggctgggcgtgatggctcacatttgtaatcctagcatttttgggaggctgaggcagaagaatcacttgagccaggagtttgagaccagcctgggcaacatagtgagagcctgtctctagttaaagtaataattttttttttttaagttaaaaagaggccgggcacggtggctcacacctgtaatcccaacactttgggaggccgaggcaggcagatcacctgagtgaggtgaagagatagagaacagactggctaatacggcaaaacccaatctctactaaaaaatacaaaaaaattagccagacatggtggcatgtacctgcagtcccatgtactcgggaggctgaggcaagagaatcgcttgaacccaggttggcagtgagccaagatcacgccactgcactccagcctgggcaacagagcaagatcccatctctacaaataaatacataattaaataaataaataaataataaaagttaaaaagagaaacctctgattcaactctggggagaggtgtatccattcaggaatgtggatatgaaaactgtggtttatatatctttataatttcctaagaattgagaatcatgtttcttaaaatgaatggtggggaggggggagttacagatggccaaaaacaaaaatgtccctcctacattttttttttttttttttgagtcagagtctcactctgtcgcccaggctggagtgcgatggcatgaacttggtgcactgcaagctccacctcccgggttcaagcaattctctgcctcagcctcctgagtggctgggattatagatgcaagccaccatgcccgggtaatttttgtatgtttttttttagtggagacagggtttcaccatgttagccaggctggtctcaaactcctgacctcaagtgatccacccgcttcggcctcccaaagtgctgagattacagatgtgagccaccacgcccagcccttcctacctcttacaaaggaacggtttgtacatgctcttcagggaaacatttctttggagaaatagttgggttgaaggacctggacacagaatgaaatggtttctcctcaatttctccaatatttcttccttttttttttttttttgagacagagtctcactctgtcgcccaggctggagtgcagtggcacgatcttggctcactgcaacctccgccttctgggttcaaacgattctcccgcctcagcctcccaagtagctgggactacaggcaagcagcaccatgcctggctactttttgtatttttagtagagacgaggtttcaccatattggccaggctggtctccaactcctgaccttgtgatccacctgcctcacccacccaaagtgctgggattacaggcctgagccactgtgcccggccttctccaatatttcatattcatttatttcattcattaacatatgtttactcagcatttactatgtatcaagcaccctaataaaatcctggatataaaatgctaaaacaataaaaataagacacctgcctttatagcatttacagtctagtgagaaacatatacatttaaaaacccccaaaaatctcataaaataatcacatactaggccgggtgtggtggctcatgcctgtaatcccagcgctttgggaggccgagtcaggtggatcacttgaggccaggagttggagatcagcctggcaatagagcaaaaccccatctctactaaaaatacaaaaactggctgggcgtggtggcatgcacctgtaatcccagctacctgggtggctggggcacgagaatcgtttgaactcaggtggcggaggaacctagaaaacagagaggcagatggaacctagaaagcaaagagaaaacagcagcaggtaaagttgaagaggtaggcaggaacagagaaaatgcagccatgcatatcaggaaactcgcctaccagtatataaggacaaatattgactgcaggactagatattatttaaccccttattctgaactacctaaaccagaatataatccctgtgcagatggcgaccacattttcagtagattctcaaacaacttccacgcaacatctagcacgtgacaaattctgtacacacacacacataaatatactatttcctcaaattcaaacttttctaaaaacatccaaactacctaccttagttgggattaaacatatatttagtaacattgaatcggttgaccaaaagcctacatgcaagaggatcttcaggataaagcaatggaagattatttgcaaacatctcaaggactgacttagctgatataaaactcagctgttaagaagtttctgggctaggcacggtggctcatgcctgtaatcccaacacttttgggaggtcaaggtgggtggatcacttgaggtcaggagttcgaggccagcctgggcaacatggcgaaatcctgcctctactaaaaatacaaaaattagccggctgtggtggcaggtgccttgtagtcgcagctacttgggaggctgagacaggagaatcacttgaacctggcaggtgggggttgcagtgagccaagattacaccatcacactccagcctgggacacagagcgagggactgcctcaagaaaaaaaaaaaaaaaaaaaaaggaaaaagaaaaaaaaaaaaagtttctgaaagccttctcagaagagaaggaagagaataagcaagggaacttttttcttaccagagccaacaaggaccttcacacagcaaatgttcctactctaaagatatacaggtttaattttaattccaacccacagaaactattagctacaacggaaaaaatgtctaatgtacgtttatggcaagacacgctagaagttttccttagtttcaagcatatgacactggttttggccataggtatagagtcagaaatattactagactgtaattcaaaacagcatcccttctaatccttgtgaacaggtacaacagtcacagttaaaaacaaggaagcttctatgcaaaggttagggctcatcgtacaagagctttttttaaatgtcaaatttattttttaaaaaagaaggccattcctatgcagaaagaaggtctaggacaacataatttttttcttttttttttcctttttttgagacaggctctcactctgtcacccaggctggagtgcagtggtgcaatcacagctcacggcagcctcgactttctgggctcaagcaattctcctgccccagcctcccaagcagctgggactataggtgtgcactgccacgcctggctaatttttcattatttgtagaaatggcagtctcactatgttgcccaggctgttctagagctcctggactcaagcaatcctcctgccttggcatcccaaagtgctgggattacaggtgtgagtcactgtgcctggccccttaaaatacatattctaaaagaagaaaaagttggaggtttttttgttttttacatttacgttgtagtgttctggcagggaaagataaaacaggaagggaagggggactaaaaagtcaggtaggctaagtactgggagaatggagcaaaggaacctcgacaagttagaacagcctatcaacagctaacatacagggtccgaaaaagggcttgaagttcacatgaaaggcaatatagtatagtggtaaagagcacagattcttaacccaggccagctgggtacaatcttagccgtaaaatgggataagagcacccatctcacatagttgttgcaaagaataagagttaatatacgtaaggagcttggtacacggtctgccacactgcaatgttgtgatttataataaatatatatttggtctttgtcttcactcctggcaccgaggtcctaaaattggaccttgaaatttcctaagaataacaaaggtaaaaggagtcgtcttttgttattcataacaggtccctttcaaccaaacctgagtttatgttaatgagctgactttggaaagcccttatggatgagggctggctgccagggaaaacaatcatgtgttagaggattagaacttgcagccccaccatactctgacttctggggatgcaagaggggctggagattgacctactcatcaatggccaatgatgtcattaatcatgcctacatgatgaagactccatagaaaccaaaaaggacagggtttggagagcttccagactgataaacccagatggtgctctgggggtcgtatgcccagagaaggcatgggagcatcacataaccccctcatagctcaccctatgcttctctcccatttggctgttcctgagttttatcctttataataaattgacaaatttaagtaaagggccttcataagttctgtgagtcgttctagcaaatgatccaacctgaggagaggcttgtggaaacctctgatttgtagccaactcagacagaagttgtggataacctgaggacccaccactatcgatcggcatctgaagttcagggaaatcttgtgggcctgagcccttaacctgtgggggtctgcactaactccagggaattaatgtcataattgagttaaattgtagaatatccagttggtgaccagatggttggagaattggttgttggtgagggaaaaaaaaaaacaaaacctacacatctgatgtcatcagaggtggagtgttgaaaggagtagtagagtacagaaaaaaacaaaacaggccaggcacggtggctcacgcctgtaatgccagcactttgggaggccgaggtgggcggatcacaaagtcagaagatcgagatcatcctggctaacaaggtgaaaccccgtctctactaaaaatacaaaaaaaattagctgggtgtggtggcgggcacctgtagtcccggcttctcaggaagctgaggaaggagaatggcgtgaacccaggatgcgtaggttgcagtgagccaagatcatgccactgcactccagcctgggcgacagagtgagactctgtctccaaaaaaaaaaaaaaaaaaaaaaaaaaccagtgtctgtctttcctcttcatgcactgtaaactctaagtgttagctattatcattttaaatatatttatttttgctggaattcttacaaaatccacttagaattcgatattctagacatatgtctcttttatgttttcgtgatttttgttttggaggcttttggtggtggtggtggtggttttgtttttggggttttttttttttgaagcagggtctcactctgttgcccaagccagagtgtagtggcaggatcttggctcaccgcaacctctgcctcccggtctcaagggatgctcctgcatgatctcttttaataaagttagtctaatctgtgcttaagggaaacaataaaaaagatgtgtccacctgtgaggcagaattttaaatggaaaactacccctgagtttaggcttggtgggacccgaaaaatgagtgaggatgggtacatggcgtagaaggaaatttgaggataaaactcagggccacctatagagatggtccttctcacttagagactaccctctagaactcttctcaaaccttggagggttttgtgtaatatttcatttagtcagctcacttcttggaaagagatcagggttgagagatgaaggcgatgttgttttagcgttacctaccagtgctgccctctcttctcatgcttgcttacttccttcaggagtcattttaactccaacctccttgtgtccaaactggctcaaagcactccaaagtggaggtgaaaggcaatcacgctgatttgttatacccaatttgagacatttttctgttgtacataaaagcaaaaaagaaataaaagcaatagaatgttccataaacttaaaaaaaatgttataacaatcacacccactcatgggttctgaaaagcacaataatggagtcaggctagtacaaacgcctaagagcaaagtctgagtgaaagtgatcaatctagtttcactttggaaactggatagaaactagcaacggaagtcagactctatgaggtaatttttgcaatagttgttggccttataattaataagagataagataattttaacctaaaggtcattttaagcttacaacaactagagataattttattataagttttaaaaactaactttattgaacttcaattcagacacaataaacttcacctagtgtacaattcaaagcgttctgacaattgcatatgcctgtataaccacgacaataaagagatatattttcatccctagggttttcttgtgtccctttgtattcaatttctccttccacttccagccccaggcaatcactgatctgctgtcactctagagaaacctgaatttttttcctcacacaatttaaaaaattgagatacaattcacatactataaaattcaaccattcaaagtgcataattccatagtttatcgcaactaattccagaacattttcattgccccaaaaataaaccctgtatccatcagcagtcactctccatttcctgttctggacatttcatttaaatggaatcacacaatatgtggccttttatgtctatgtcctttcatttggaaaatgtttttaaggttcatcatttttttttttaagacgagtctcgttctgtcacccaggctagagtgcaagtggcttgatccccgttcactgcaacctccatctcccaggttcaagcgactgttgtgcctcagcctcccgagtagctgagactataggcacatgccaccagcctggctaatttttctgtatttttagtagacataggtttcgccatgttgcccaggctggtctcaaactcctgggctcaagcgatccacctgccttggcctcccaaagtactgggattataggcataagccaccacacaaggccaaggttcattcattttataacatatatcaacagtgatttctttttatgagtgaataatattccattgtatggatataccatattttgtttattcatcaactgaaagacatgtgggttgtttccactttttagctattttgaaaaagctgctatgaacatttgtctgtgtaaaaatacacagacaaatgttttcagttttctaggatatatatctagaagtagaattgctaggtcacaggatctatgtttaactttttgaaaagctgccaaattgtagtttttaaacttttcattctgagataattatagattcacataataagaaataataaacagctcatgtataaacttttcattctgagataattatagattcacataataaataatacaaagagctcatgtatcctttactcagttccctccaatgataacatcttgcaaaactacagtacaatattacaaccagaatactggcactgttagtcaacatacacatttccatcaccctgaggatccctcatgttgaccttttatagccacatctactttcagccccacaccatccacaggccctgacaatatgaagaaccaatctgtgcttcatatctataattttgtcatttcaagaatgttatataaatagaatcatacaataggtaacattttaggattggcttttttcactcagagtaattctcaagagtcattcagggtgttttatttctaaaacgtttaaagtttgcccctttttaaaagttgctgagcagtatcccacagcctgaattaattaattaattaattaattatgagacagagtctcactctgtcacccaggctggaatgcaggggtgcaatcttggctcactgcaacctctgcctcctgggttcaagcaattctcctgcctcagcttcccaagtagctgggactatgtgtgcccgctaccacgcctggccaatttttgtattttagtatagatagggttttaccatgttggccaggctggtctccaactcctgatcgcaagcgatccacccaccttgacctcacaaagggctgggattacaggcatgagccaccacacccggcctcaaatgaatttttgggatggtacaaggtaagagtcaatgttccctctctctctctcctttttttttttttaagacggagtcttgttctgttggccaggctggagtgcactggcacaatctcggttcactgcaacctccgcctcccaggttcaagcgattctcctgcctcagcctcctgcgtagctgggattacaggcgcacgccaccacgcccagctaatttttgtatttttagtagagacggggtttcaccatgttggttggccaggatggtctcgatctcctgacttcgtgatccacccacctcggcctcccaaagtgttgggattacaggcgtgagacactgcacccagccctctcttaatttttttaacatacagatagccagttctttcctgatttgtaagtttttatttaaaccagagttagaaaaataattaaaataacactacctctaaacactcaaaaccactgctatgacataatcctgccatttcagtagaacagaaaatccccacgccttcccctcagctcggagggcacaggactgggcagcaagctccaccagtttgtagaaggagttcaacttccagacagcagggaaatgcctttctctgaagttattacatgagttcacactgaagggaaagaagaaagtgagccttatcattttcccaagatgctgtgagatgtgttggatttactctcactcataattgtgcaggatggttgttttgttttgttttgaggcagggtctcactctgtcacccaggctggagtgcagtggtgtggtctcaattcactgcaacctctgcctccagggttcaagcaattctcctgcctccgcctcccgagtagctagagtcacaggtgtgcaccaccatgccttgctaatttttgtatttttagcagagatggggtttcatcatgttggccaggctggactccaactcctgacctgaagtgatccgcccccctcaacctcccaaagtgctgggattacagacgtgagccactgtgcctagccacaggtatgttcgggatggtttcaaccaacatcaatagaaccaactaagaatagatggccttcagcaacacagaggggtagcacaggagttccaaagatcagtagtttgaaaatcaggtcacagggagtccacgctatatgatcttgggtaagtcacttaacattcttagccccccgtctgttcacctgtaaaaccaaggtttgttatcaggtcatgtctaagatccttcccagttaaacattctagaatgccaaaaataagcctatttgttctttctttgaaaaatgaagaaaaatggcaaaaaaaaaaaaaagttgtcaaattgtgaacgtttatctaacacagagaactataccaggagcaggttttcttttttgtttcctgttttaccctattcttccatactaattagacatcatataaatcccacatataaatccaacacatctcatagcatcttgggaaataaaaataaaatatcttttggaactgaacttctcaactttaatatgcatgtgacaatcttttttttgagatagggtctcactttgtggcccagctggaataccgtggtgcaaacacggttcactgcagccttgacctcccaaattcaagtgagcctcccacttcagccccctaagtatctgggactacaggtgtgtatcaccatgcctgcctaatttttgcattttttgtagagatgaggtttcaccatgttgcctaggctggtctcaaacttctgacatcaagcaatctgcccaccctggcctcccaaagtgttgggattacagctgtgagccactgcacccggcaaataatctttttaaaacagattgtgattccgcaggtctgaggtggcgtctgagattctgcattcctaataggcttccaggtgatacaaaggctgccagaccttggaacatactttgagtagcaaggtattagaagaatacggacatagtatctgtttgagtaacctaattaatgttgatacctaagttttcagtactttacataaccaaataaattagtcttatggcactgatttgaggaatataatcttatcgattcccaagagaatatactaagaaaacagttcaaaaaatcaagtttaattaatattttagttcctcaagatcctatttgcaaggaaaaacagaaaaacagaaaatcagaaagatacagcatcatgaattgttaaggacaattttcacaccctatagtcaatgagcaaaatatattgcagaaatgcactttcaaaaaattaaaacaggctgggcaacatagtgaaaacctgtctctcattaaaaaaaatttttttagctgggcctagtgatgtgcacttgcagtcccagctactcaggaatctgtggtgggaggaccacctgagcctggggaggtccagcctgcaatgagctgtgattatgccactgcactccaccctgggcagcagagtgagaccctggctcaaaaataaaagctacacaaaaaaataattaaaacattgtatactaacaccaccattttatgcctacaacaaatcagattattcttacccaacaaaagcaaacaaaaaatttaacgtgttgttttttgacagaaaacttctgagaggttcagcaaattgagagtaaatgagtgtacacaggaaggagccacagctctgccaagaacatggcctaacacaaacactgcaaagataaatttcaataagtcttacaaaatagaaacaaaggcaaaaatgtaaaagagatttatacaaactcaactggtcagagggaacagtttaatgagatggagtgcctccttatcatgcagtatttggtcagtggagggagcactttgactgcagaggttccaaattaacagctctatctcctaatcattatgcttccatccatcttcttcctcttttaactgtacctacctgtgtatgtgcatacacacaatttaacataagctttatttatttttgtgcgtgtgcgtgtgtatgtttttgagacagagttttgctcttgtcacccatgctggagtgcaatgtcgcaatctcggctcactgcaacctccacctcccaggttcaagcaattctcctgcctcggcctcccaagtagctgggattacaagcatgggccaccacacccagctaatttttttgtatttttagtagagatggggtttcgccatactggccaggctggtcttaaactcctggcctcaagtgatccgcccgccccagcctcccaaaatgctgggattacaggggtgagtcactgtgcccagccaacataagctttattggaatacaaaagaaatgtatgctcatcatagaaaatcagaaagatacaggaaaacccaaaagatggaaaaaatataatgtcccctatgaaatctcactactcagagaaagttattcatattctggtgtatagcctcaaagccacttttctagaattatagagataagtggtaaacattattccacattttaaaaattattttaaaaaattttttgtaaagatggaatcttgctatgttgcccaggctggtcttgaactcctgggttagacaggaagctgtcggggaggtttgcttgagcccgggagacagaggttacagtgagccgagatcccaccactgcactccagcagggggcgacagagcaagaccctgtctcacaaaaaaattataaaaatataaaaaaccaaaactacaatgtacacttatgaaagaacaacagtaagaaagggaaattacattttagtataaatacataaaattttgattcatacccactgaaaatgtttcaaggacacctaggggtcctcagaccacactttgaaaacaatgctctatactgtagtgcctcttcagttagggcacgctatacaaatatttacaaggcatggtctcaggaacatacttaacctaaaaaatatcctaatgattttgctaaatcacccattcaacaattattaagtgcttacaatacacgaagtattcttatacacaaggcagagaatcaaagaggaaaaaaaaaatcctccttgtggcacttacattctacgaagagacagccacaaccaataaacaaatgaactatctattctgcaaataagtggtatgaaggaaaataaaagcaaggttttacaaaataggatggtcagggagtgcgcctaactaaaaaagtaacttttttttttttttaagagacatggtcttgctctgtcacccaggctggagtgcagtggcacagtcatagctcactgccacctcaaattcttgggctcaactgatcctccccactcagcctcctgtgtagctggtactacaagcacatgccatcatgcctggctaatttgttgttgttgttgttgttgttgctgtttcacagagacagcatctcaccatgatgcccgactagccttgaactcctggcttcaagtgatcctccccattcggcctcccaaagcgctgggattataggtgtgagccaccataacaggcccaaaagtaacatctgatcaaaaatctcaaggtgatgcgggaacaagccatgaggctactcagggaaacgtgctctaaatagaaggaataacaagtacaaaagccctgatatgcgagctaaggtgctcagggacaacaaacaaagccaatatggttggggtaaaacaagcaagggagagaagagaagcagataaaataagagttacaaagcagttcatgtgggactttgtagacgagtataaggactgtggctttttcagtgaatgagaataactggcaggttctgagcaaggagggatatgacctgattaattttaaatggataatgtaatcgtgtttaaactcaaaaagctgaattaaacacctgttccatctcttactgtgtgtccttaagcttttgaacctcagtttcctctgtaaattgtgaagatacagacactgcaaaaagttgttgtgaaaatcaaacaatatacctaaggctaaggggattatgagcagtggctcacacctgtaatcctaataccttgggaggcagaggtgggaggactgcttgagctcaggagtttgagaccagcttgggcaacacaccaagatctcattcccacaaaaaataaaaaacttattggggcaggggaggagaaaaaaaatactggggtgcagcggtacacgcctgtggtccagctactcgggaggctgagatgggaggattgcttgagccaggaaggttgagtctgcagtgaaccatgatcacactactgcactctagcctagatgacagagcaagacctcgcctcaaagatacacacacacacacacacacacacacaaatacttttaaattatgacagactataaaaatttcactactgagtttgtttgcactatgtagttgtcacatagtcctcttttctaggccctctatactcaccatactgccaccatcagccatttatgcgactttgccatgagattaatgccccagacctctgataccatgagctcagcctgatactgccctttagcttgacgagtgcaaggcaaagaaagtggagttttttttttttgtcattgatggcagagtggttttttagcattattttccttgtcgttataaagaaaatctttttaaaaaataatgcatgtgggccaggcgcagtggctcacgtctgtaatcccagcactttgggaggctgaggtgggcagatcacgaagttaggagatcgagactatcctggctaacacagtgaaaccctgtctctactaaaaatacaaaaaaaattagccgggcatggtggtgggcgcctgtagtcccagctacttgggaggctgaggcaggagaatggagtgaacccaggaggtggagcttgcagtgagccgagatcgcatcactgcactccagcctgggtgacagagcaagactccatcttaaaaaaaaaaaaaaaaaagcatgtggtaatcataaaagtgaagttccaaaaaaacaagactttatgagtctcgtctttatttaatttggcactgttttaataaagctaaaactgtagttcttggtcttgacagcttgcctcatccaaaaagaaacaaaaaggaggaaaaaaaaagatgcagactgacaaatgaattcaaatttctttgatccgcgtcctaactctaaggggacttcagataaatcaatgagtcacagaaggggcaggaagatgtaagccagaatactgatgacaacagctgtctgtctacctacctgtcttctgagatcatcattaaagtatgagatcaccaagaccagggaatacagagtaagataagatggaggcccactggagaattatgaggcctgtcgcattctgactccacttcccagcgggtggaaggtgaatacccaggcactggtttttatctccacctcctaagatgtgagtcattctgagtagtgacagaatcctgcaatggaaaagcccaaagaaaaccaagatctttgggaaaaattataaacaatctcatttattagaggcctctgatggtttctttgaaatgggtaaatttcctcatcttaaagtggagggcaagaattttctacctaaggtttctctcaaactctaaaatcccttaaatataaaactaagtggccaggcgtggtggctcacacctgtaatcccagcacttttggaggcagaggcgggcggatcacctgaggtcaggaattcgagaccagcctgaccaacatggagaaaccccgtctctactaaaaatacaaaatcagcagggcatggtggtacatgcctgtaatcccagctactcaggaggctgaggcaggagaatcgcttgaactcgggaggtggaggctgcggtgagccgagatcgtgctattgcactccagactgggcaataagagtgaaactctgcttcaaaaaaaaaaaaaaaaaaagtatgtttttttaaaggctacattaatatttagagcaagcttgcccatcctgcagcctaggatggcttgaatgtggcccaacacaaatttgtaaactttcttaaaacattatgagattctttttttttgcaattttttaaaagctcatcagctatcgttagtgttaatgtattccaagacaattcttcttcttccattgtagcccttgccaaaagatttagagcattaagagatccaaaaagtaggtattgctagtgcaatctggagtttttcgtcagttctacagacgtgtgagtgatgtgaacccaaatggggcaccttccttaaagaattaacatactatcaaaaagggaaaaacttatatgtccacaatctgccctatgatacttccttttaacctcatttttattaattgccactcccctcttgacccatactattctaaaacatacagtgcagaaacaaactgtaatgattagggaaatagaagttaaaaaaatgcaggaattttaagtacacaggtatcaaggaaaagagagactaaatggactgaagaaatattttatttttatttttttgagatggaatcttgctgtgtcgccctggctggagtgcagtggtgcgatctcggctcaccgcaacctccacctcctgggttcaagagattcccctgcctcagcttcccaagtagctggaattacaggcacccaccaccatgcccggctaacttttgtatttttagtagagatggggtttcaccatgttggcaaggctggtctcgaactcctgacctcaagtgatttgcccacttcagcttcccaaagtgctgaagaaatatttttaataataaaacaaatattttcaaatagataacatgtatgtggtataaaaccaaaaagattttaaagtacacagtttaaaagcattttctgaaggataaatcaaacagaacacttagaaaacttgagtgtataggttgtgctgtatttcttaggctggttagtaggtgtgcattaatcaaatcttataatactttatatattctttggcatttatggagtactctaataatcataacaacaaaaagtctcttccaccccagtcccccagttctctattcccctttattgaggcagccagggttaccagcttctgtggtccttccagagacatcctgtgcatggacaaatgtgtgggtgtgcatacatacatgcacaagacagagagagaaaaaacaaagtgactccctaactatgcctcattaagatcagatttatgtcgtgggaccaaagcatacctaaggaactgtctcaactgttttctctacaagtgaattctgtcctgctgttgttataactaagaggactgcactagatggatacaccttagggcctgtctagtcaaagccttacacattagctgtcaagagccaagtcctagcatttctccattctaaaacacaccagagtcagtaccatgccccaatattccctaagacttagcttctgaaattccataatgtccatcttatttgttttgttgtttttgtttttgttttgaggcagggtctcgctctgtcgcccaggctggagtgcagtggcacaatctcagctcactgcagcctctgcctcccaggttcaagcaattctcctgcctcagccccccaagtagctgggactacagacatgcaccaccacacctggctaatttctgtatttttagtagagatggggtttcaccatgttggccaggcttgtcttgaactcctgacctcaaatgatccacctgcctcggcttcctaaagtgctgggattacaggcgtgcgccaccgcgcccggccccataatgtccatcttagatcattaattatctaaacaaaatgattcagatatgtttccatagtagtgagaaaagctctaactgtggtttgattagaacacttagattcagcaataaacatcacaggcagacatgacatactgcacattctgagatgcagaagaattccaactttgaaagctatttttcaacaacatctgctttggacaaggattggctaaaatacaggatggtgggtagaagattcatttcttaatataagaacagatctcaaaatacttcgataaaatcttgatttaaaagcttatacttatcagggaaagtatgacaatccaaatttcatcactctcattcattcaaaaatactaagtaccatgtgccagtatcagaagccaatatatagattaatatattgcccttgagaagctaataatctaattaggaagacatatacatctggctggttccaaaggaccagtaagagaccaccagcagtgaggaggatgaaagttttattttttgagacagaatcttgctctgtcgccccagttggagtagaatggcatgatcatagcttgttgcagcctcgacctcctgggctcaatcgatcctcccacctcagcttcccaagtagctctgactacaggtgggcaccatcatacctggctttttttttttttttttttttttaattttttgtagagatgggtcttgaactcttgggcttaagcgatcctcctgcctcagcctcctgaagtgttgggattacaggtgtgagccaccatgccaggcctgaaagtttgtatataacatacatgaacatgtctcaccaaaacccccaagctccaaatattcaaatgaaaattgttcataaatataaaacataccctggaactttgctatcatattcaatatcctgaagttttatttagggtaaaactttccatcctgaattctgtcaacaaggtttagttactttaaaactctcattaaatagcagtctcacctataaagcatatattcatataggttaaaatattctattgctagaaaacctatggctcatgtttatctactgataaagcccaaaagtcttgacttttcagagaatggcttttagttcactgaggcttcataacagatgctttttcatttcctatcataaagagagacagtattttactatacagctgtcatattactgttacaatccagctaatggctacagcacttcagaacaaaacagtagcaattttacaaaaccaacacattgttaatgtttttgatcatataggagacaggtactggagatatcagtttgctattaccctttctatatccagagtctctccacttttacgaacataaacaaaagaaagaagtccacatacacgctacagcagacccttcattctacctgcatccaacactcttgtcaatttcatttcacctactatcatcctttgaaagttttatgaagtagctggtccaacagatgggtggctagccctgcccaacacatgacgaaggaaaaacagctcttagcaagcaagacaagaaaatattaagtatgtccctttccctctcaaggctgagaacactgagactacctgagaagaaagcaaacaatcttttaacctttataaagaaaagttactggactgagatgatctgtaagtaacaaggtgattttaaaaagggagagagttcaaatgctaaaatctacccctcaagataaaacaggcacttgcccacacatagcagagaactggaatagacaggaaaaataaataaatccaaattagtttaactgggagctttttcatcaaagacagatgggaaacattcagataagcacactatcttgtttagaacacaaagctcaatagatctgtaggaggaaaaggaaaggcaacctgaaacacatagcctatatgcataaaaaatgactcattatggtcatattagtaaaaccagaaagaacaaaatggtagtggtatctgtcttctttgccccttccctgatcataagctttattaaccagatagcatctgatcctgtcttcaactgatgtatatctgtctttcaacatactacctaaaatgctccccaaggaaaacagtgagaccaattctgccagagacagtatctgccagaaccaagaagtcttattttcctttgagtgaaagccagtggatggggaagaggtccccaaatgccacttgtctgaatcttttaagatatgctctgaaacaagaaaacactacagattacattttagtagagatctaaaaatagcaaaagaacattccctatttttagatatctgacttccaagtgtaaaaacactaaaagtaaaagaaaccactgaaaactaactatatttttaaaagggttttaaaaactctgaattggaaaactgtttttagagataaaatttcaaaaatcctcccctgtgttgactgactctttgctcaaacttacccatctccaaaatttagtcctaatcctatgtgttattaagggcatttccacagaaccaaaagatggtacagaaaggttataccacaaacaagaaagaacagctaagaaaaaaaatttaaagatgctttcataaaaacatagagtctagactagtgattaaagacaacaatgtataaaacagcaaagcaatttaattgtctttcatttaaaacagtgccacagacaatacaacacttgattaaagaagacaaagagttttttttctcaaacaggtctccgcaactgaataatcttaaaaccagtaaccatctaattcaaagctgtcagaataactagaatttgcaatgagagaaaaattaataaaaaactgaaaatgcagtacatttcttcctccccatttctgtccactcctagtacaaatatgacccattttttttaaagaagcctgtggcaaataagatttgtaggaaattattagcaagttaggaaattaggatttatgtgaattacctgactgtactgccatcattaacatctcaggttccagtagagtcatgacggattcttccagaaacaaaaatccacaaatataatgaagaaagtcaaagtcacaggagaaaagctgtcttgaaagctttcacaaattcaatctgatgccttatgctcaaatcagactgtgagaatatccccttctcagtgcagttaccaatttatccacccttcaggcgagtcaagatgacacagatttgaattactgccgacaggaaaccaaaaagctctccagttaagacatactaagtgtggttagaacagtgagcaagctcctccccttgctattcgtctctgggggaggggagagacatatataaagagactttcagaaaacagatcaactgcttttttcctctcaagaagagaagatgaggttttgttcaaaatcccactataagagactgctgttaatgcagtttagtggaacagattaaacacaatccaaacaactcaagctcatgaaagaagcagtccaattactgacccattgatgagaggtggggaagaagattaaacacatataaacacatatatacaaaatgtaagctccataaattttctgaaaaagaattccaacggcttttttatatgtggtatttatagataacaggctaaggaagttgaacatttaactacagaagctcaactatttctccacccccactccaattaaaatatctgtttcaaaaagtcatctgaatacattccagagctgtaatctgtctttcagatctgtcagtcccctaaaagagcctcttacttgtgcctatattagacatacggtctgtgaatagacagtatactgatgttatttgatttcatttactttttttgtatgtttgagacagggtctcactccgttgcccagactggaatgcagtggtgcaaatgtggcttactgcaacctcgaccttccaggctcaagtgctcctcccacctcagcctcctgagtagctggtctcaaactcctaggctcaagcgatctgcccaccttagcctcacaaagtgctgggattacaggcatgagccactgctccccacagcacctttcattaactgatattcataacaatgatattaagattactttcagtctatctgactgaattttttaaagttggaaactaagaatccatgtttggtgtgtttatctagaattcttcaatctttctcgttaactatcagcctgtatgtgaaagctggctgctgccaatagcccagcgaataccttaatgcttacatagtaaacaaatggtaaataaaagcagtaggagaccttaagagagaaaatagtctcagaatgactgaaggcaatattttgttattagtaaagagaagcaatgcaaatttggggtgagggagactcagtacaagagagaaaaacttccttcctttctcactccaagaacatcatgtttaaaagaaaagccagaaaagctctatatagaactgtgggaatgactcaacaggcaatgagtagcagccagtgtgggctaaatgctgctctgggaaagcagaagcatctcactggccccttctggcaaccaaattttcaaactgacttaggaaaaacgggtaaatttcaactttgagtctacatgacagtctggtcaaaggttagcaactaagggaaaagcatccctaaaaggttgagaagattgagtcattccttggtccttatgtgggctgtataatttgctgtgtgagaggttttttctttttttttttttttttctttttgagactaggtctcactctgtcccccagactgagtacaatggcatgatctcaggtcactgcagcctcaacctcccaagttcaagcgatcctcctacctcagcctcccaagtagctgggactacaggcatatgccaccacacccagctaacttttgtatttttagtaaagatggggtttcaccatgttgcccaggctggtctcgaactcctaagctcaagtgatccccctgcctcagctacccaaagtgttgggattacaggcctgaaccaccacacctggtctttgttaaatttactttgtctctctagtaatgagggttttcaaatgaaacaagttttcacagttcggtatttacaggaaaataaatataaactttaagattcctgcacagaagatggtaggaagggcagagggctggctgtctccctcctgccaaaactgttcgccatagaagagagcatgtaatgccacagtgtcaatactccagcaccacaggagatattgagagtcatgtgataggaataacaaataaacataacatctcagttgatttgactttttcttagcaattccacacccactatctcactggcactttgaggtaaaaagacctaaataaaagaaaaacaattttttaaacagtaatctttaaaaaattaaacaagaagcacttactttcgtaggccaaacgggagggtgggttgaaactagaagttagagaccaggttgggcaacatggcaagaccccatctctaccaaaaaaaaaaaaaagaaaaagaaaaaaagccaggtatggtgatgcctgtctgtagtcccagctacttgggaggttgaggcaggaggatcacttgggcccaggagttccaggctacagtgagctgtgatcaccccactaaactccagcctgggcaacagagcaagaccctgtctcaataaataaataaatgggccgaagccgccgccgcccgaccgccgggaggatggagttcagcgggcagcggagctgtctcagtctttgccgcggcgccggcgagcgccgcccgggaggcagcggctggaggagcggacgggccccgcggggcccgagggcaaggagcagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagccgccccgtctgagaagtgaggagcctctccacccggcagccaccccatctgggaagtgaggagcgtctccgcccggcagccaccccgtccgggagggaggtgggggggggtcagcccccccgcccggccagccgccccgtccgggaggaggtggggggtcagtcccccgcctggccagccgtgccgtccgggagggaggtgggggggtcagccccccgcccggccagccgccacgtccgggaggtgaggggcgcctctgcccggccgcccctactgggaagtgaggagcccctcagcccggccagccaccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcccggccagccgccctgtccgggagggaggtgggggggtcagccctccgctgggccagccgccccgtctgggaggtgaggggcgcctctgcccggccgcccctactgggaagtgaggagcccctctgcccggccagccgccccgtccgggagggaggtgggggggtcagccccccgcccggccagccgccctgtccgggagggaggtgggggggtcagccctccgctgggccagccgccccgtctgggaggtgaggggcgcctctgcccggccgcccctactgggaagtgaggagcccctcagcccggccagccaccccgtccgggagggagatgggggggtcagcccccccacccggccagtcaccccgtccgggagggaggtgggggggtcagccccccgcctggccagccgccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgctgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagcaatcagggacacaaacactgcagaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaattaaacaagaagcaatgtaatctttcccaattgctaagattttgcatttactctcaagagtattagcacagcaacattcattgtgaaaacagactttaaaataaatttcacaattctaaaagtctgaacccctgtgaaagcttcagttccattattttttgtgcaaattagtaacacttcatagaaaaagaactaaagtaaactttaacaagggctctgcacaaatgaagatgacttcaagttaatagcactaaggaaatgagagataatgatcttaatttccaatagaacaaaaggtttgcttctaatcctaactagctaatcaacacaaatttgatatgatctacagtctctattaattcactctaaagggacattatactgcaggatacacagccttttgttttttttttttttttttttttgagacaaagtctcactctgccactcaggctaaaatgcagtggcacaatctcggctcactgcaacctccgcctcccaggttcaagtgattctcatacctcagcctcccaagtagctgggattacagtcgcccaccaccacacctggctaatttttatatatatttttagttgagatggggtttcaccatgttggcccaggctggtcttgaactcctggcctcaagtgatccaccagccttggcctcccaacgtgttgggaatccaggcataagccaccgcacccagcctagttttaagttgtttaacagttttggcagttattaacaattttttttttttttttttgagacagaatcttgctctgtcgcccaggctggagtgcagtggcacaatctcagctcactgcaacctccacctcctgggttcaagcgattctcctgccttagcctcccaagtagctggactacgggcgcccaccaccatgcccggctaatttttgtgttttttgtttgagacagtctttctctgtagccaggctggagtgcagtggcacgatctcggctcactgcaacctccgcctcccgggttcaagcgattctcctgcctcagcctcccgagtagctgggattacaggcacacaccaccacgcctggctaatttttgtatttttaataaagacagggttttcaccatgttggccaggatggtctcgatctcttgacctcgtgatccgcctgcctcggcctcccaaagtgctgggattacaggcacgagccaccgcgcccagccgacgacaactattttcttaacgtaactataatattttcacacttaaattttataaattccttaatatcagttaaacaatcggtgttcaaattttcacggttatcttttttttttttttttttttcccagacagggtctcactctgttgcccagacaagagtacagtggagtgatctcagctcactgcagcctcgacctcccaggctcaaacgatccccccatctcagcctcccaagtagctgggactgcaggtacatgccaccatactcagctaatatttaaaatttctgtagagatgggggttgtcatcatgttgcccaggctgctcttgaaatcctgggctcaggcaatcctcccgcctcagcctcccaaagtggtaggattacagatgtaagccaccacacccagcccaggttaaagtttttgaaaggagtatttcacaggtggtagtgtgtacttgagcactgtgctcctcctcttcggccttgtttctactaaaaaccatccttgttaccaactgattgttatttctctttgaaaattcagtttaaggtgctgccttctccataaagccttctctgatccctggcactctccccacctttctcacagcctccatggatatgctaactacccctcctttaggctcccccagcacctgtgcctgcctccattattgttctttaccacgtggcttaattctagccaggcagcgcggtggctcaaacctgtaattccagcactttgagaggctgaggtgggtggatcaggggttcgagaccaacctgaccaacatggtgaaaccccatccctactataaatacaaaaattagccaggcatggtggcatatgcctgtaatcccagctacttgggaggctgaggcagaattgcttgaatgcgtgaggttaaggttgcagtgagctgagatggtgccactacactccagcctgggtgacagagtgagactctgtctcaaaaaaaaaaaaaaaaaaaaccaaaaacatacaaacaaaaaattcctctgcattctcaaatcttgctcagtgtctgacatacatgacagcattcataaatgtgtgccaagtggaatgaaaagcccttatttatcacagaaattcaaatggcataggaaaagttcataacaaaaaaaaataattacctacccagaaagggcaggtgctctgctaaaattttcattagaacacatactgaaggtgttattagaaaactacataaagtattgaagtatggagttaacataaacaaagacattcacaataataccctcaggaatattaagtcaatgagaacgaaaatgctgaaattatagggaatgaataagagaaatcagaaaaacagagaaccttggctcacctacaggataatctttaaccatagaaagctgtcaatttcactaatatcaatttccataataaaatgtaacttacacatgtatacacaaaagcaacaaatgtatttttatgaactctgtgggatttcagagcacagaaatgtaatccagtttctgtgcccatttctgatttgagttctcacaagtgtacgcatgagtttattgaggctcagctgtacaaaaaatctagtcatcatacccaaatgtcatgggctccaaccacttaagactttcccctagacacctcgtattgggcaccactcaaaagataacataacccagcatgcaggcaagttgctacaggtcctgaggcagcttccatttcctgtgaccacaacctattgctgatgaagtactgagtcaagacctgtaaacctgggaggatcacacattaccacaggtatattattccttagacccaggatagctgatggctgtgtgtgtgtgtgtgtattttctgtttgtttgtttttgagacagtcttgctctgttgcccaggctggagtgcagtggcgcggtctcggctcactgtaatctccgcctcccgggttcaagcgattctcttgcctcaacctcccaagtagctgggattacaggtgcctgccaccacgcccagctaaatttttgtatttttagtagagacagggtttcaccatgttggccaggatggtcttgaactcctgacctcataatcagcctgcctcggcctcccaaagcgctgggattacaggcgtgagccactgcatccagcctaggtgatggctatattttaagctcactttttaaagatttttatttatttattttaagacagggtctcactctgttgcccaggctgcagtgcagtggcacgatcatggctcattcatactttatgtctgaaataaagtactcatttcacatcacttcctcccaaactccctccactgatatactggtactcttccagttcctttgtgacaattttccccaataacctctgcctcctcctcccaccccctacccctgtcttcacacacgctattacttctttcatttgtcaaaccactacttatgctttggatctctgcttaaatgtctcttcctcaaagaagccttccctacatgaaaaccctcactattagatctgttattctgttataatatcttgtgtttttgtttttttaaaaagcaattaccaaagtttgtaaccatgaattagctcatctaactctttgttgagtctttttctttcatggaattatagaagttccatgacaataagaactttatctgtcttgttcattactctctctccaatacttagcacacagtgctaagtgctaagatcttaataatcacagaataatttttccaacattaaaatggtcaaattatttaagccaatatttccacttctaaggaaataatctgaaatgcaaaaaaattttaaaagatatttatccaaatattaatgtaagtgtgaaaaacagaaaatgattcaattgtccaactaaggagaaagtaaataaatgatggcacagaacagaatgttatgtaccccattaaaaaaggctacttataaaaatatttcagtaatatgaaaaaagcaggacacagaattgggtctgtagtattagctcagttattttaaaaacacacatttgcaagaacactagagggatataaaccatatactaacagtgattttctctgggagatgagatccattagaatttgggcttttgcttttgttttgttttgtgttagagcaggaactctatctggtatctattctccaggggcctagcataacatgtgatgaataagtaagaatgagaaattgattatctctaagtactggaatgaagtaggtcatgaaattctctaagtcacattataaacagaatcatttaatcaattgacatgcctaagattggaggattttcaactgggcgacctaatctagaaaatccttgaaaaccatgctttctgaggaatataattaacaaaactctttcctttccccaagaaatactgtaatttggatcagaaactgcccactcaaaatttttacttctcccagcaattaattagaacctcttgtgcaacattgtggcatgaaaggatacagttcgtacccttacagaaaaaaatacatgatctgtcctttattccacaggctgcacatgtgaaaacaaactggtacttcttaaatcttacataaaggaggagaaaaaccactgtgaaagaggaaaggcccttttcactcccattttcctgcttacttttctttacatagctcttccaatcctatccagcacctcagattacagacacacatagaactgcacctttacatctctcagaacaatatctgagatcaacaacaacatttagaaaataaaatttttgtaaaaggcaacatttacaatctcattaaaacacacaaagtgtctaaaaacaaatctaactaaagatgtgtaagatcatcacagagaaaaattttaaaaacccattgggaggccttacaaaagatctaaataaatgtggaaaatatgtatttacagtataatattataaaaatatcagttcttcctaagttggttcatagatgcaatgcaattccaatcaaaatcctgagtaattttatatggaaatgcaaatgaccaagaacagacaagaatgaaactcttgaacaagaacaaggtgggaggacttacttctcccatacaacagggcttattacagttatcgtaattaaaactgtgagggcaggaatacacaaatagcccaatggaaccaaatagcaagctcagaaacatacccacatagctaagtccttgatatatgaaagacgtagctctgttgattagtggggaaagaagagtattttcaataaacggaatccacttgaaaaaaaattaacttgtgtcttaccttattcccatatgaaaaattatttccagaaacacaagacacaaaactcataaactataaaagactcatataaattacattaaatttagaaattctttttgtgttttgtttgtttgttttgagatggggtcttgctctgtcacccaggctagagtacagtggcatgattatagttcattgtaaccttgaactcctgggctcaagtgatccttctgcctcagcctcctgagtaggtgggactacaggcatgagccaccatgcccagctcatttttttgagagagggggtcttgctatgttgcctaggttggtcttgaactcctggcctcaagccatcctcccgccttggcctccccaagcactgggattataggcatgagacactacacccagctaaatttagagattcttaatcaaaagacaggataaagagaaagaaaaagacaaaccccaaagtgggagaagatgtctgcaatacacttaagcaacaacaaactagtattccggatatttaaagaactcttattaaagaaaaaaaccaatacaatagaaagagtaggcaaaagacttaacttgccacttcacaaaagaggaaatacaggccagggccagcatgggctacatagcaagactctgtctatacaaaatataaaaactgagccaggcatggtggcacactcctgtagtcccaactactcaggagggtgaggcaggaggaatatttgagcccaggagattgaggccgcagtgagcactatcctccagcctaggcaacagagcatgacactgtcttgaaaaataaataaataaataaataaataaaataaatatatatatatacacataaaataacggaaagtgatttcttttaccaattttatatatatacataaaatcattggtatatatataaaataactggtatatataattagtaaaagaaatcactttccattatgatatactgattcaatggatgccagaactccttgagctgaagcctaagggcttagttcattagacagatgtttccaggcttctccaagccctggctagataggatccacaagcagatcaactttatcttttagacctaagttctcagcctagaagacagaggagtaatattttaaaatataccttgaaagtttttatcaacgttttacaattaggccagtaaagattgggttagccaaaggcacctcctctctttaaggctccaagttctgtttaggaaatgaaggtgtcgggaccttgactgcctactgccccacaggtacctctgctaacccactgaattccttttttttttttttgagatgaagtcttgctcttgttccccaggctggagtgcagtggcgctatctcccggctcactgcaacctccgcctcctgggttcaagcaattctcccgcctcagcctcccaaggagctgggattacaggcgcctgccaccacgcccggctaatctttgtatttttattagagacggggtttcaccatgttggccaggctggtctcaaactcctgacctcaggcgatccacccacctcggcctcccaaagtgctgggattacaggcgtgagccaccacgcccggccatttttttctttttttttgacatggagtcttgctcttgtcacccaggctggagtgtagtggtgtgatctcagctcactgcaacctccctctccccagttcaagcgattctcctgcctcagcctcccaagtagctgggattacaggcacccgccatcacgcccagctaattttttagtagaggaggggtttcaccatgttggccaggctggtcttgagctcctgacctcaagtgttccacccacctcggcctcccaaagtgctgggattacaggcgtgagccgccgtacccggccaccactgaatttctatatgatacatgcttctatgtgaaacagatcaaagaagtacatttctcactccactctctcaacacacggtacacccattcatgaaaaagcacctcctctaactctagaatttattctgttctagaactccacactttccaatttcacaatcttctcaaagatttttcatttctgctcctatcattacctcccaaacaaatgaccatgcaaaaacctactgtaaaatacaacaatcttcttaccagcctctttcctccagagctgaatgctggagagtaacaaaatttaagaggtaggcagagaaagatagcaaaagctctgaatggcaaagggagtcgctggaaaggtagagtttaaaaagccggaaaaaggtaagtcgtagatatccgtggaggaaaagtttcaagtctgagggagaagccaaccatgtcaaatgatgcaaagaggtcaagtagcataaagactaaagagggcttatttgatctgcaacaaaaagaacacaaattactgtggcaatggcagtttctgaagacaggtagtgacagaagccataaagcagttgagtctctgggatatgagaaagtagagaaagcaatgactgtaaactattctttcaggagcttaaacactaagggaaagttagagttgctgggaaagatttcagttaatttatatgctaagtggaaacacttcagagaaaaaggccgaagatacacaaacaccttgggtccaacagcaacagctgccttctactccactgagaaaacagagttcttacctgtagtggaacaaacatgtaaaccattcattgattcattcaataaatatttattgccaggcgcggtggatcacgcctgtaatcccagcactttgggaggccgaggcgggaggatcacaaggtcaggagatcgagaccatcctggctaacacggtgaaaccctgtttttactaaaaatacaaaaaattagcctggcgtggtggtaggcacctgtagtcccagctactcgggaggctgaggcaggagaatggtgtgaacccaggaggcggagcttgcagtgagccgagactgtgccactgcactccagcctgggcgacagagtgagactccatctcaaaaaatatatataaaataaaataaaataaataaatatttattgagtgcctattatgatccaggagttgggtatatgccagtgaacaaaataaagtttctgccctcaggaaataactattaaagaggagaaaatagacaataaacacaaacacacacatatacacacacacacaatgacagataataataagggctttgaagaaaaagcaggatcaagagtaacaggaggtgctattttagagaagacaagcagggaaggcctccctgaggaaatgacatttgtgcaggaacttcaatgaaagcacagcaagtacaaggccctgggataggaataggtttgatgtgttcaagaaatagcaagaagtcagtgtgcctgggagctaagggataagggtaagaaatgatgtgagagagaggctgggcatggtggctcacgtctgtaatctcagcattttggaggacaaggtggacgaataacttgaggttaggagttcaagaccagcctggccaatatggtgaaaccccatctctaataaaaataatttaaaaatcagtctggcgtggtggcgtacgcctgtaatcccagctactcggtagctcaggaatgagaatcacttgaaccctggaggcagaggttgccgtgagctgagatcataccactgcattccagcctgggtgacagggcgagactgtctcccaaaaaaaaaaaaaaaaaagaaaaagaaatgatgtcagagagaataccaaggccacatcataagtactatgatttcatcataagcctcacaggaaagcattgaagagttttgagagtagcgtagcagtgtctgatttcagttttcaaaggctcactcattgctgagtaaagaattccaattacaatatagggtgatgaagtaggttgataaagggcaacagggcacagtggctcatgcctgtaatctcagcactgtgggaggctgaggccaggggcagaggggatcacttgaagtcaggagttcgagacctgcctggccaacatggtgaaatcccgtctctactaaaaatacaaaaattatccgggcatggtggcgcatgtctgtaatcccagctactcaggaggctgaggcacaagaatcacttgaaccagggaggcagagcttgccgtgagccgagatcacgccacagaactccagcctgggtgacagagcaagactccgtctcaaaaaaaaaaaaaaaaaaaaaattgggaactgggaaaaccaaaagaggggcatctaacactaaatatgagttaggaaaggcttcaagaagagtgagagagagaaagcgtatcccaaatggaggacacagacgtagaaaagaaataggggttttgaaaagccttgacatttatttacaccagcatgggacagaaaatattgtataaaaatataccatttaaggccgggcctggtggctcacatctgtaatcccagcactttgggaggccaaggcgggcggatcacaaggtcaagagatcatcaagacaccatcctggccaacatggtgaaaccccatctctactaaaaatacaaaaattacctgggcgtggtgttgcgcacctgtagtcccagctactcaggaggctgaggcaggagaattacttgaacctgggaggcggaggttgcagtgagtcaagatcgcgccactgcactccagcctggcaacagagtgagactctgtctcaaaaatatatatataccacttacatctacaaaaaaaaaaaaaattatatccaggaacaaaactaatatttgtatgacttttctggacacattcacaaaactctgtaagacattaaagaaaacctatttaattgaagagataaaacaaagtaatggataggaagactcaatatttaaaaatgtgtattttcccacccactgtttctgtttgttttttttaagagacagggtctcgctatgtctcccaggctggagtgtagtggtgcaatcatagctcactataatctcaaactcctgggctcaggcaatcctcaaatgtcagtctcccaacatgctgggattacattctccccacttacctataaacaacatatttcaaataaaaatcccagcgagtataccaaaagacacatacaagaattccatagcagcataattcataatagccccaaagtgaaacaacctaaacatccaggaacagtaaaatggaaaaataaattgcattttattcatacaatgaactgattatacagcaatgaaaataaactctagcacacacaattcaacataaacaaatttcaaaaacaaaaagaaaccaccaacagaatacacactgtatgactccatttttataaggtttaaaaactaaccacagtgttgaaaatcaggatggtagtttcctttgagcaaggggaagggagtattgattgggaagaagcacaaggtggggaaagttctggactactagtatttcctcactaagcagtagttactaacaggtgtactcactttgtgataataacaacacttataagttgtgggttattttgtatttatgttatacttccataacaggagtactagtgtctgcaatttacttcaagatacatcaaaaaaattagattgagggctaggtgtggtggctcacgcctataatcccagcactttggggggccaaggagggcagatcacctgaggccaggagtttgagatcagcctggtcaacatggtgaaaccctgtcactaaaaatacaaaaattagccattcatggtggcacatgcctgtaatcccagctactcgggtggctgaggcaagagaattgcttgaacccgggagacggaggctgcagtgagccaaggtcgcatcactgcactccagcctgggcaacagagtgagactctgttgcaaaaaaaaaaaaaaaaaaaattaaatttaaagatgagattgatagatatctgtgttataaagcaagttttataaaatgttacaggtagaatctaagagatgggcacgcaggtattcactgtaaagttcttcctacttctttttttttttctttctactttacgtttaaattttttcataataaaatgttggaggtaaaaatcccaaagggtttttttgttggcagaacttggtaaggcaattctaaaatcatggaaaattaaaagggtaatagccaagacaactttgaaaaagaaaaaggtaaggagatacgtgtcctaacagacagaaagactaattattaggcaataactaaaataaggtagtactgacacagagatggacagagagaccagtcaaagaaaagagagcctaaaaactaactcatgcacagacagaatacagcaggcattaaagatcagtaggaaaaagtagaactattcactaagtggggattaacagcttgaattagaagaaaatacagaatatctttaacttacaaggaaaatgaatactgaacaacaaattactgaagaacacataattttctctcatatataggtttaaaacatgagaaacaacattatatattgcttaagaatatattcacatgggtaaataatacagacatatttggcaatgaaataccaaattcaagttagtagtttcctccaggggtaatgaagatttacgcaaagtacataagttgggtggtatttgaacacacaattttctatattgttctttatccattttttcttttttcttttttttttttttttgagacggaattttgctcttgttgcccaggctggagtgcagtggcgcgatctcggctcaccgcaacctctgcctcccaggttcaagcagttctcctgcctcagcctccctagtagctgggattacaagcatgtgccaccatgcctggctaattttgtatctttagtaaagacggggtttctccatgctggtcaggctggtctcgaactcccgacctcagggatccgcccgcctcggcctcccaaaggcatgagtcaccgtgcccagcctctttatacattttctcaaatcttaaatattccataacaaattatagatttttttaattaaaaaaaggttgaggtatgagtacatggtttttaaacagtacttaacacagtttaatgggctggaacaaatactaggaataggggaataagagaagatgttaaaagaaagagaccagattctgcaaagccttataaaacatgccaagaaatttattcacttatttattatttgtttgtttgtttgtttatttgagatagagtctcattctgtcgtccaggctggagagctgtggcacaatctcggttcactgcaacctccgcctcctagttcaatcgatcctcccacctcagactccccagtagctgggtctacaagtgtgtgccaccaagcccagctaatttttgtagttttagcacagacagggtttcaccatgttggccaggctggtctcttaactcctgacctgaggtgatctgtgcacctcggcctaccaaagtgctggaattacaggcctaagtcactacacccggcaagacatttatttggtttttgtttcatcccacaaggcaatcactgaaaacttttaagctaggaagtcctaaaagattactctgacaaggctatacgatagagtatgtttcctaatgacagaggcttgtttaccatttaatccctaattttagcatagtttataatacattgatattaatgaatatatatgctgaattaatgaatttatggaaggaatagggtgagggaagcagagaaattagaaagaaattataataatccaggcaggaaatgttggacttacaatgatcactttaacttacagctatctattttacaagaaatgttaagattattaggaactttcacggaacatcaaataaagtaagaatctgtaacattataaacatgaagatcctggttcaaatcagggaatgcaataattctgtatctactcaccattcttccgctcactaagtggaggcaaattgggattcctgccagggtggaggcctagggtcagctcgggctgcaaggagagctcctgcagttcattggcaacagcttcactctggggactgggtgccgcagataaggacacgagcactggttcatcatcattttcgccggcccctcctccgtccagcccattcacagcaatgacggaagggggcaggcacaccacactggagaaatccactttggctttcgtgatggcaatctggaaatggaagaaaaaatggaaagtttagatggtaccatgataatatggtttggtggtgtcctcacccaaatctcatcttgaattgtagttcccataactcacacatatcatgggagggacttggtggcaggtaactgaatcacaggggtggttacctccgtgctattctcatgagttctcacaagatctgatggttttataaggggcttttcctcttttgctctgcacttctccttcctgccaccatgtgaagaaggacatgtttgcaactccttccaccatgattgtaagttcctgaggcctccccagccctgtggaactgtgaatcaattaaatctctttcctttataaactacccagtctcaggcagttctttatagcaacgtgagaacagactaatatagtaaattggtactgatagagtgggatgctgctataaggatacccaaaaatgtggaagcaactttgaaaatgggtaacaggcagaggttggaacagtttagagggctaagaagaagacaggaaactgtggtaaagtttggaacttcctagagacctgttgaatgcctttgaccaaaatgctgatagtggtatggacaatgaagtacaggctgaaatggtctcagatggagatgaggaacttgttggaaacttatataaaggtgattcttgccatgctttagcaaagagactggtggcattttgcccctactctagagagatctgtggaactttgaacttgagagagatgatttagggtatctggcagaggacatttctaagcggcaaagcattcaagaggaagcagagcataaaagtttagaaaatctgcagcatgatgatgcaatagaaaacaaaaactcattttctggggagaaattcaagccacctgcagaaatttgcataagtaacaaagagcctaacattaatcaccaagacaatggggaaaacgtctccagggcatgtcacagaccttcacagcagcgcctcgaaggcataggagggaaaaatggtttcatgggcccagggccttcctgctctgtgcagcctcaggacatggtgccctgagtcccagctgcttcagctccagtcatgaataaaaggagccaaggtatacagctcaggctgaggcttcgaagcgtgcaagcccaaaacctcagcagccgccatgtggtgctgagcctgcaggtgcacagaagtctggaattgaggtttgggaacctccacctagatttcagaggatgtatggcaacacctggatgtccacgcagaagtttgctacaggggtacagctctcatggagaacctctactagggcagtatggaaggcaaatgtggggtcggagcgcccacacagagtcctcactggagcactgcctagtagagctgtgagaaggccaccatcctccagaccccagaatggtagatccacctatagcttgcaccatacacctggaaaagctgtagacactcaacatcagcccatgaaagcagccaggggtgaagccgtaccctccaaagccacagaggcagagctgctcaaggccgtgggagcccacctcctgcatcaacatgacctggatgtgagacatggaatcaaaggagatcatttcagagccttaagatctgactgccccactggattctggacttgcatggggcctgtagcccctttgttttggccaatttctcccctttggaatgggtgtatttacccaatgcctgtaccccccattgtatctaggaagtaactaacttgctttcgattttacaggctcataggtggaagggacttgccttatctcagatgagactctggacttggacttctgggttaatactggaatgatctaagactttgggggactattggacacacatacttgtgttttgaaatgtgaagacctgtgatttgggaggggccaggggcagaatgatatggtttggctgtgtccccacccaaatctcaccttgaactgtagttcccataatccccatgtgttgtgggagggacccagtgggaggtaattgaataatgggagtggttacctccatgctgttctcatgatagtgagtgagctctcacaagatctgatggttttataaggggcttttcctcttttgcttggcacttcttcctgccaccttgtgaagaaggatgtgtttgctttccctgccatcatgactgtaagtttcctgaggcctcccgagccctgtggaactgtgagtcaattaaacctctttcctttataaactacccaatcttgggcagttctttatagcagcagtttgagaacagactaatagacacggacaaactatgccactggagtatatgccgatgctaatattataaattacatcactggcaaactaccattattcttaaagctttttgtaaagtaaactagcacccactgctctccagacccccgaatggtagagccaccagcagcatgcaacctcagcgtggaaaagccacaggggcagagctgcccaaggctttgggaacccctccctttatatcagtgtacccagaatgtgggacatggagtcaaggattgttttggagctttaagatttaatgactgccctgctgggtttcagacttgcatggggcctgtagcccctttcttttggcaaatttctcccttttggaatgtgaatgttaactcaatgcctgtatccccattgtatcttggaagtaaataacttgtctttgattttacaggctcataggtggaaggaacttatctccagatgagactttggacctttgaattaatgctgcaatgagttaagactttgggggactactgagaagaaataattgtattttgaaatgtaagaaggacatgagacttgagggactagcggcagaatgatatgactctgatatttgtcccacccaaatctcatgttgaaatgcaatccccagtgttggaggcagggcctgatgggagatatttgagtcatgggggcagatccctcatggattggtgctgtccacatggtagtgagtgagttcttccaatatctagttgtttaaaagtgtgtggcactgccccccttctttctcttgctcctgctctcaccctgtgacatgcctgcacctgcttcaccttctatcatgtataaaagctccttgatggcaccatccttgtacaggcttgcaaaaccatgaaccaattaaacctcataaattaaaaaaaattttatatatatatatatatctccactcactgaatcctatgtagttagtaagaataattttttttttttttgaggcagagtctcgctctgttgcccagcctggagtgcagtggcgtgatctcagctcactgcaagctccacctcctgcattcacgccattctcctgtctcagcctcccgagtagctgggactacaggcgcccaccaccatgcctggctaaatttttttgtatttttagtagagacggggtttcaccaatgttagccaggatggtctcgatctcctgacctcaagatccacccacctcagcctcccaaagtgctgggattacaggcgtgagccaccatgcccagccctaagaataatttttataaagcatttctaatgtgggaaatgcttattctaaagccacacttaagaaaaagtaagacataaaactacatactcatatattaaaatattatacaaagaaaaaagattttaagaagtataccaagacacaaaagaggggttctgtttgattggacaatgaaaaaattttaaggttccaaattttctctaaaatacttacatggcttttataataaaaagactatagtttctgatctatgaagtgagattccctgggcattccttgcaaacttttatgaggactttaatctaacttgctttagttgaagaaaccaacaaaatattgaacagccatgaagtgaagaaaggcactagaaactaaaaagacaattatgatctaacttcaagtaaagcaatagtgtgcccaaacctgactgtagttctggctgatacatttcacagaaaataaactggactggaaaagatccagataacagtaattaacatgagggagataatattatgaagaaaaaagatactaaggactctctactccaaagagactggaagaagatataagggagacaagttcaaaaaaaaatttgaactcagtattaggaactcaatattctcaagggtaattgagcatgggcaaacaatgggaaaaggatttcttttagggtttgaataattttataaattacaaaacaacaaatgtctaccaacaaaattcagaatctaaacttcaaagaattcttttccatcttgtctatgatttattatggtttgaaccatgtctctgtgtgtactgggaaaaaaacaactgttacacaggattaatccatccggctgagtattctttgtcattgactctgaaagagcatgtctgcttcttttaacagcagcagcctttcagactaaaaaaaagacttcaactttatgacattcaaggaccccttgagaactaacctccttattcaaaaggaaaatagaatggtatcaaaacttcagccctaggacttaggaaaagtggtttcacatagagtaacaggttttcaataaacagctgttaaatcattatggattgtaagagttcagacctctcataagaaaattaagaaatttaactgcaacaataactctgtatgcagtagatgggccttgcaaaagtattaacacaaaacaagcattctaatagttgttaactgaacaaagagagaagcaaatgaaagatacataaagataatctagggaaccacgacagacatgtcttggggaaaatttggatgacacaaggaagactgcatgaaacatacagaaacactaaaaataatgttaggcagtcaaggacaggaaacatcaagcctcataccactaaaatactatagctaaacagatgcgctagaatcatggtttcatataaaaagttcttaacttagcaaaaccccattatttcagacttaactgatatttctgatactataacttggtgtgagattaagtaaaatcttctgctatttggcaggggcagggtaatataaaagagtgccaggtggccaggcacagtggctcactcctctaatcctagcactctgggaagctgaggtgggaggatcgctagagcccaggagttccagatcagtctcggcaacatagtaagaccctgtctcttttttaaaaaaaattttaaatagtttttaaaaattttaaaaagaaggaaaaaaagtggttaaaaggtaagtttattatctaagagctcccaaggcaggaggaaaggtgaatttaatgttacatatgttttttatcacaattatttttagatgtcttggcaaaaaaaaaatttcactaagtaaacttatattactgagcttgaaagaatcccaggctggagtgcagtggcaagttctcggctcagtgcaacctccacctcccggcctcaagcaatcctcctgcctcagcctcccgagtaactgggaatataggcatgcgccaccaggcccggctaatttttgtatttttagtagagatggggttttgccatgttgcccaggctggtcttaaactcctggactcaagtgagccacctgccttggcctcccaaagtgctggaattacaggcatgagagctcaccgagtccagcctttttctttctttctttttttttttaagggacagggtctctctctgttgcccaggctagggtgcagtggcacgatcatagctcactgcaaccttgaattcctggactcaagtgatcctcccccatcagtcccacaagtagctaggactacaggcacaccatcatgcctggctttttttttttttttttttttttttttgcaaggggttggggagatatgaggtttttgctatgttgcccaggctggtctcaaactcctggcctaaagtgatcctcctacctaaaccttccaaagtgctaggattacaggaatgagccactgtgcctcgccaaaaccatatattctttaaaatgaagtaaattatttaatttacttatcactaattcagaacaaacttcttcctactactttgaattattattattgctggaattcagagatttagcatttacatgtgttaatattcccaagagacaataaaaatccatcacatggtatcaatatttttctaatgaagcatgaagttaacttcatgagtttgtgatgctcttatgcatttagtgaacataaccagtatttctagaaaatgatttaaagaaactttgtaaaaaacggccccccaaaagaaagccaacccaagtccaagtccaatgctaagcataaagagaaaataaagttcttggttttttggtttttgttttttttgggggggttttttgggtttttttttttttgagacagtctcgctccaccacccaggctgcagtggcacgatcttggctcactgcaacctctgcctcctaggttcaagtgattctcatgtctcagcctcccgagtagctgggattacaggcacgcaacactacatctgatttttgtgtttttagtagagatgggttttcaccatgttggccaggctggtctcgaactcctgacctcaggtgatccacctgccccagcctcccaaagtgctaggattacaagtgtgagccactgtgcccagccaaggaagttttaaaaataatgtttcacccaggcgcgatggctcacacctgtaatccccagcagttggggaggccaaggtgggcagattgttagagcccaggagctcaagacaatcctgggcaacatggcaaaaccccgtctctacaaaacacacaaaagttaggcatggtggtgtgcgtctgcagtctcagctactcctgaggctgaggtaagaggatcacctcgaccccagggaggctgaggctgcagtgagctgtgatcatgccactgcactccagcctgggcaacgaagtgatacccatcccagggaggaaaaaatggtgtttcttagaacacatactttttttttcttttttcagacagcatgttactctgccatccaagctagagtgcaatggaatgatcatagctcactgcagccttaaactcctgggctcaagtgatcctcccaagtagctaggactataggtgtgtgccaacacacctgactattttttcacttttttgtagagacgagatctcactatgttgcccaagctggtctcgaactcctggcctcaagcgatcgccctacactggcctctcaaaatgctgggattacaagcgtgagccaccttgcctgacagaacacatacatttttaatagtttaaagaaaggactgtttgatactatattacaatgcaaaaagaaaagaaagaaaataagaatatcaaattctacagacctgaaccccatggttgtgcctactactaaccagaataaaagaaataagcaatctgaaaaactgctttagcaactgttcgattcagaatagttctgtaattaagttccatatttacagaattattaagggcttaaagagatcacttaaaatttacacatatatctatacacatacacacacacacactttaccaaatatttttattgggtaaattatatagtgctatttgttaatttaggggatttcaaaagtttcaggatacatcctttaaaacaccaatattaaactatactatagaataaaatccttccatcaaggccatgaggcagggagtgaggaagaacacacaaaacaagaggggcagaatgttgataatgttgaagctggttattaggtatttagaaattcattatgctattatctctacatttgtatatgtttgataacattctcctagtattttttaaaaaataagattcttccacagaatgatgggaagactcagtgagacacagcaaggtttccttaaccttgagattagaaaatagaccagaagtcatatacaagcactgacaaaagactaatttggcataaaatatacacattggatttatttctctaacaaacacactactctctattcattttgaaagagcccacaggataaaatctcgtaaactatgataatctagagacaagacccaaaaatgttgaggtatagccatcataattaagtcccctttaccaattcctgaatactcctgtaattgtatttactgtaaaacctgaatcactttttagagttgtaatttataactctactgagtctaagttcatactttctttttttatcaaaggatcagtaactccagtttctgggctgctgattcacatatgatcaacagcagccagaacaaaaacagcatgggggcagggtcatctcccacaacccatctgtttccctcttttgctggcctgattatgcatcttttctccaccctacccgctttagggctgcatgccttctgcctgtacagaacaacatacgtacctagaaacaacagcatgaaatgtgttagaagaatggaagaacgtagacagctactgacaactctaaaacatgagcactagcacaattctttatcatgacccatgacaaaaaggtggttctatgcgaccaaatggtatggttcttctgaaaattttttttaaacaattggtaaaaaaactgttttcaatcaattaatgaactttcttttagctggacatatttttactttaattctcattgatttattttcaatgcagtaaacctaatcttgaaaactcttactgtctcagcaggtatgtaggggtggtgggggtggatgtgggtgggtatgggtatctctgtgtgtgtgtgtgtctgtgtgtgtgtgtgtgtgtgtgtaaaatctggtatgaaggaattcaaatcaactgaacaagtgtttcctgatagcttactatatatgtactaggtactgccctacgtcctactgtagaagatgaggaaaacagccaggcatggtgatgcatgcctgtagtcccagctactcgggaggctgaggtaggaggactgcttgaatctgggagatagaggttgcagtgagtcaagactgtgccactgtactacagcctggatgatggagtgaaactatgtctaaaaaaaaaaaaaaaaaagttactgtatagaagatgaggaaaacatcaagtcttggctaattaactgcccttgcctctgtctctaccacacccattatcttcagacaccttaaaaactaccaggctttagagatggcaaataatagggcttcctattccttcttcatcttggaaatcatctaaaaacgaggagtacaagcaacagaaaaatataacaaaacaatggaaagcacatggaagagtaatgtggcagattaaagatggttgcaaattacctgacacttccttcccattaatggtggggtttatttcctttgaccttgaatctgagctggcctctgccttgaccaatcgagaacagtgaaagtgatggtatgccagttcagggtctagactttaagaggactggcagcttctactttggtctcttggagccctgtgcccccatgtaagaagtccaactaccctgatggacagatcctaaaaagaggtctcatcaggtggatcacgaggtcaggagctcgagaccatcctagctaacaaggtaaaacctcaactctacaaaaaatacaaaaaaattagccggacgtggtggtgggcacctgtagtcccagctactcaggaggctgaggccggagaacggcgtgaacccgggaggcggagcttccagtgagccgagatcgtgccactgcactccagcctgggcgatagagcgagactccatctcaaaaaaaaaaaaaaaaagaggtctcatgactacacagaagggcagaggaatccagctgagtccagctttccagacatccccacaccaaggtgccaggcatatgaacaaagccatcctggacaccccagacaagcctagtcacctgctgaataacactaagagatgacacttaacactgtatggatccaggttaataccatatggagcaggcagaataatccctaagctaagccctgtccaaaatcctcacccacaaaattgtgatatgtaataaatggcatcagacttctcaacagcagaaaagaaagaaagaaaagaaaagaaggggaaagaaaaacggaagggaaggggaagggaaggggaaagggaagggaaagggaaggaggggaaggggtaaggggggagggagaggaagggggaaagggggggaggagggaaggcagaaaggagggaaagggggaagagggaagggggaaagaggggaagagggaaggaggggaagggggaagggggaaggggggaagggggaacggacggaggggggaatggagggagggagggaaacatgggggtgaataacagaaaaaacttaagaatcttaagtggtcatctcaaagtagtaagatgcagggtagacttctaggtatctatagagttctcaacgaattgggtagccaaggtgataaataccctttggtaacagccaatggtgacaaatagccaatggcaaaaaataatttatgaccagtccataaattacttggcctttgctcacttcacctcctcttgatggttctacagggaatcagtcatccaaatatttcctcttcccccaacaaaaaggataacagtaacaatataacactgcctcttcaattacaacagtaccggccccttcactactggcttcatttctcaccattcccctttattcacactctaatcactggtaccagttatgcggctctttactgtgactgcctagaattgcctcttcttccccatcctacttccttctctttattatccatccccttcgaatgggctaggcttccacaacatcccaagattgcttttatcactgcttacttttactattatcatggattgatctcccagtagatggtaaattcactgaaaggaactccattctactggtttttttgtctcaagtacccagatacaatacttgaaatttaaaaagaacttaataaatatttgttaatttactacgtatattaaccttacagcaaacacatcatatatacaaagtcagcacagatacagaaaaaaaaaaaaaaaaaggaaagagggttctgtcccaggtataaatacacagaagatcagaaaaagcttctagagagggccaggtgtagtagctcacacccataatcccagcactttgggaagccaagcggggaggatcccttgagcccaggagttcaagaccaatctggtcaacaaatattgactacccactacatgccaggtgctgtctgggtattgaggattacagtaaataaaacaaagttcttgccctcaggaagctggagacataacttaaatgaacaaagtcatagatgtgagaaaatgtgaactatgttctaaaagggcaatacagtttagccaatcacatggttcaagtacaagcaaattaatatggcagtggagttagactggattggaaaaaagaaatatgcggttgtggggggaggttacaaagctacttcattaggcaaagtataatgtgttgatatcctgaattggggtagttaaatgcaaagaagggaacgaccatacaatgtacctggcacagaacaggaactcaaatctttgtcgcgttaataatgaatgaagacaggatttatataagatagaatgtgtttctgtttgattgttggggatggaggagagacagatgtcaaaaattactaaaggttttaagccagggcagtcattacaacagtattctgctaatagaaatagggaaaagaggaggaattttatctgtggagataataaatttgattttgcatgttgggtcgagggaccaaagaaaaataatggaaatgtcatttgggtttccattaggtacacgagaaggaaaacatgggaatgaagacaatgagaaacaacaaagattacaagaataggaagagaataacagaagaaaagtaggaagagtttgagaaagaggaaagaggctgagttacagatataaggaaataataatattgctttcaaacctgactcagttgataattcataaattcctagtctcagatcacctactctggatcttggaccatccctcaccatccttctgattcctaaaattgtcaaataccgctgagtatctaattgcatatcagcactttctgcttacactattttagaagaagctcaataatgctgtaactttattttattattatttttattattattattttggagacggagccttgcaccgtcgcccaggctggagtgcagtggcgtgatcttggctcactgcaacctccgtctcccgggttcaagctttctcctgcctcagcctcccgaataggtgagactacaggcacacgccgccattcccggctcattttttgtattttagtagacacgggatttcaccatgttgccaggctggtctcaaactcccgagctcaggcaatccgcccacctcggcttcccaaagtgctaggattacaggcatgagccaccctgcctggccaaagttctaactttataatgctgaggggcaatcagctgtcctcagatttaaagacacaagtaagctcatgagcttatgtatagggacgtgaactcaccagctagaagaaacagaaattttaaaaaagaaaacagaaaaaaagtaaaatatgtattttataccatggctcaacccctttttattgactacttctctataccattcccaacaagcccctaccatgtgtgttaggtatacatgtgaacatcttcccttaactaaacaacataaattgcctttcagtcttatggaactcatgaagacctcctggggtaggctgggtgcagtggtgcatgcctgcaatcccaggactttgggaggccaaggcgggaggaccacttgagatcaggagttcaagaccagcctggccaatacagtgaaactccgtctctactaaaaatacaaaaattagctgggcacggttgtgcacacctgtactctcagttactccgggggctgaggtgagaagatcacttgggcccaggaggtagagactgcagtgagccaagatcgcaccactgcattccagcctgggcaacagagcgagactcgatccccacttcaaaaaaaaacaaaagaccttctggggtagacctgactttcattaattcactcaacaaatgcatagtgatgaggcactgttttaggcactgggagtacaacagacagaaaatatcttcgctttcttgggcctacattatagtgggagagacataaaaatgaaaataaatatacaataaaaagtttttggataactataagcattatgtgcctgggggccaggtggctaatttagattaaatgaccaaaagaggtctcattgaggaagtgatatccgaaagagacttgtatagccaacccttattataaatgaggcactgtatgtgtatgcattcaatcttcacaacactaagacgtatatttacctaaattatccataattttttacagttgaggaaactgagacactgagaggttaaatacttgatcctgggcagtgaagcttcagacctcatgcctctatggctctgtctgaacttgacaagaaacagccagccatgcagagggaacagcatatgcaagttaaaaagccatgaggcaggaatgagcttggtatcttgaaggaactaaatgaatggcatggcccgagaggaatggacataagtatattacataaacaactggatgccactgggaggttttacacaatggagtgatatgatctgatttatcatttttttttttttttgagacagagtctcactctgtcgcccaggctggagtgcagtggcgtgatctcggcttactgcagcctccacctcttgggttcaagcaattctctgcctcggcctcctgaatagctgggattgcaggtgcccaccgccacacctggctaatttttttgcatttttagtagagacgggctttcaccatcttggccagactggtactgaactcctgacctcgtgatccacccgcctcagcctcccaaagtgctgggattacaggcgtgagccaccacgcctggctgatttatctttttaaataatcattttgagggctgggcatggtggctcatgcctgtaatccaagcactttgggaggcccaaggctgatggatcacttgaggccaggagtttgagaccagcctggccaacatgttgaaacctcatctctagtaaaaatacaaacaattagcggagcatggtggcgagtgcctgcaatcccagctactagggatgctgaagcaggagaatcacttgaacccgcgaggcggaggttgcagtgagccgacatcacaccactgcaccctcgcttgggcaacagagcaagactccgtctcaaaaaataaataaaaataaataaataatcattttggcaggtgtgtagagaaagaatgacaagggagctgttcaccttagcgtgccacctgactctgagtttggtataatttactattctgcctggcccctaatgaaaatgtaataatgttgttttgacctgtgtcttaatatatcactgagtttggtgatgtgaccttgagtaagtcgctctgaataaacatttgttattattatctgtcctatcatgaagggtcttataagaaggtactctgaaaagtagagacattaactacaaggtaatattttcttgcaaacatttaacagaaatttgacaatttgccttaaactcctcccccacctccaaaaaggctgcttgaaaattaaagcactattttgacaagatgacttcattacattccttgaactttattcatgcccacaaacactacaggtatgctttccttatgattctcaatcctttttctatggtgttcaaatgtgttccaatttttaaaggtggaattctatttgtcttctagagttcttctctaagagactgagtgacggatatttagaagtccacacgctacgtataagagacctgaataaatttaaatatgatcatctgcacatattttgtgtattcacctacaaaattatgtaatctgttatgagacaattttcaagttaggaattcttcagtcgattctactcttacatcaaaactccatgcagcaatcagcctagacaacctgaaatgttgccaggccacggaaaacctgccacagtaagaaaatctaccacacagaaaatctacaataataattctgttcaggtatgaataatataaaaaaaactatttttgaaaatattaactttggaatgaaaaacttgttgagacaaacctcacctagcataaagacaggcagtagtttggggggaaaggaagacatttatagtattgtgctttgttttcacatgacaatggggcatttgaagaacagccctattttccagtgccagaagcctcatatccttaggtttctcaatgacatcctctccggatagatcaagaatatgctcctactttataaaatgaaccatgaatattttcctaaattcttgagcaaatatttttaaaatactggaaataaaatatcttgccataaaaaaagaacctgtcataattttgtaagagtatccaaacacagcaacacacactcagaggaaagtgtatattcaaggttgaaatgtgtctatgggtcaagaggtcaagcctaaagcttctaagcacctaccagagccacaatgaggaactctcaggacaatgcacacactgatgacagcactgtagcaccagtgaaaacactcaggccatcaacagcatgttcatgaattattcttccaattacactttaattataaaaactagcttattaattaaactaatctactctggtaagatcagttaccacacaaaagcaatggctcttcaagttaccttcatggaatacagtacagagtttgtgttaaaaatgcattttcacttagttgtggttattaaagactttgatcaaggcagaacctctggaaatacaacgaatcttgacaatttaaataaaaacagctccttagtcatggctcattattcttcctttcaaagcctcttgcttcaaacagtattactcttagccaattaatattctgtaaaaggtgctgagaatttttgatcaaataaaatgcaacagatattttaataccattttaagcccagcacaattatatatttaaagctttaaaacaatgagggaacacatagtacaggcaaacacatccattttccaaacaaagtaaataatacaactaaagtgttctctacatcactacaggagttcacacattacaactacatctaagtgcaattactgtaaattataaagtgctaagacacacagcagcactagtcagcagtcagtgctgtacattttgaaagcatctaatgtaggcagcaagcatgatgtggatagcaaaaaaagaaaaggtaaatgcacaccagcatgaaaatcttcaaataccttatgggtagcctatttaaaatagaaaggttctaaattaatcaaggagaaaggaagaatactagtgatccatattaaaagagaagaaccacctgaatgtaataactcagatgtcgcatataacatgaaaaaaataatacaataggaagagaattatgagcctttttatataccagactatcaataagaagcagaaaataaggtgggtgcaatggtacacaccagtagtcccaccagggacactgaggcagaaggatcatgtgagctcaggagtttgaggctgcagtgagctatgatcatgccactactctccagcctgagaccctgtctctgaaaaaagaagacagcagagagtagccattgagctgagaactgcaccatggcaaaagacatcaagaccaaaatcaagaactacaggactgccccttttgacaggcgcttccccaaccagaaccagaccaggaatggctggcagaaatacctggacctccaccacttcaagaaggcaatgactgctaaaggaggtaatgtatggccgggtgcagtggctcacgcctgtaatcccagtactttgggaggccaaagctggtggattacttaaggtcaggagttcgagaccaacctggccaacatgatgaaaccctgtctctactaaaaatacaaaaattagttgggcacgatggcagctgcctgtaatctcagctactcaggaggctgaagcacttgaaactgagagatggagtttgccgtaagccgagattgcaccactgcagtccagcctgggtgacagggcaagactccataattaatacatacatacatacatacatacatacatacatacatacatacatacatacatacatacatcaagggggtgatgtctctgtttgtgaatggtaccagcatgtgtacaagtctctctgccctataccctgggcctcagcctgggatgaccatgggcagaaggcacatttcttgggaagatctgaactggctccaccccacctctgtccttctcccaggatggtaaagaagaacctgggtatatggtgatccctaccctgggaccctgaatcatgtcttaataataaaaattcactggaaaagtgagagaggcggggaagaaaactgcagcagcagggagtaaaagaacctcacttagatcattgtgacaggcctgggaggttgttgcccaatatcctctctcactccttcttcccagtaaaagaatacataagttttagctaaatacatatcagaaggaagactatgttttccagcctcccttgcagctaagtggggtcatgtgactagttcaagccaaaggacatgaataaaagtattaggtgtgatttctaggaaatgtccttttaagaactgggggccaggcacggtggctcatgcctgtaatcccagcactttgggaggccgaggcgggtggatcacgaggtcaggagatcgagaccatccttgccaacacagtgaaaccctgtctctacttaaaaaaatacaaaaaattagcctggcatggtggcaagcacctgtagtcccagctactcgggaggctgaggcaggagaacggcatgaacccaggaggtggagcttgcagtgagctgggatcgtgccactgcactccagcctaggcgacagagcgagactctgtctcaaaaaaaaaaaaaaaaaaaaaaaaaaaagaattgggtacattattctttaggcacttctccctcctcctggctggaaatgtatatgagatggttggagtacaagcagcaaacttaagactacgaggaagaggccacatgttgagaatagcaaggcaacaaatacagaaaaaaactagttctctgatattgcagagcaccaaagcagtcctaggctatttctagacttctttatacaagacaaaaaatagacttatatcatttttaaagccagtgttattttactttctttggtcataaataatggaacataatcctaataaagaacatggagccaggagtggtggctcacacctgtaatcctagcattttgggaggccgatgtgagtggattgcttaagcccaggagtttgaaaccagcctgggcaacatagtgaatccctgtctctacaaaaaaaaaaaaaaaaaaaaaaaaaaaaaaaaattagctgggcatggtggtgtgcgcctgtagtcccagctactcaggaggttgaggcaggaggatcacctgagcccaggaaggtcaaggttgcagtaagccttgattgtgccactgcatagtatgggcgacaggagtgagaccctctctcaaaaaaaataaaataaaagaatgaagttagactgcctacctcacaccatacacaaacattatctcagaatggatcaacgatctaaatgtaagagatgaaaatgtaaaactcttacaagaaaatacaggtataatcttcatgaccttcaattaggcaacggcttcctaaataaaacaaagtacatggaaccaaaggaaaaaactagataaacaggaggtccagatatttctgtcaaaattttaaagttttgtgcatcaaaggataatatcaagaggtgaaaaagaaaactcacagatgagaaaaagtatttacaaatcatacaactgataagtgattaatatccagaatatataaagaactcttacaattcaaccacaataaggcaaccaaattttaaaatgggcaatggatttgaacatacacttctccaaagaaaatataaaaacagacaatataatcccggcactttgagaggccgaggtaagtcgatcacgagaccaggagattgagaccatcctgactaacatgatgaaaccccgtctctactaacaagaccaaaaaaaaaaagcagccgggcatggtggcaggtgcctgtagtcccagctactcaggaggctgaggcagaagaatggtgtgaacctgggaggcggagcttgcagtgagccgagatcacgccactgcactccagccagggcgacagagcaagactctgtcaaaaaaaaaaaaaaaaaaaaaaaaagaagagggacaataagcacttcaaaaaatgctcaacatcactagtcattaggaaataatgaaaaaaaaaacaaaacacagtgacatagcacttcacacccagtaggattggtaaaaccaaaaagtcagattataacaagtgatggtgaagatgcggacaaactggagttcacgtattatcccattcatataaagtctagaattgggacacatatagagaaataaagtagattagtagttctttggtttggggggaacagggagatagcagggtaaaagttaaatggtacaggttctctttgaggtgataaaaatgttctaaaataaactgtggcaatggttgtatatgtgaatatactaaaaaccatcaaattgtacactttgccaggtgcagaggtgcacatctatagtcccaggtacttgaaaggttgaggtctgagaatcaagagagctcaggagttcaaggctacagtttgctataatcatgcctatgaagagccactgtaatccagcctgggcaacacaatgaaaccctatctcttaaaaaaaaaaaaaatccatacacctgaaatggattaactgtgtagtctgtgaattttatctcagtaaagctgtttttttaaaaaaggaaatgaagtagttacacttgcgtattactccattttcgtgctgctgataaagacatacctgagactgggaagaaaagaggtttaacggacttacagttccacattgctagggaaacctcacaatcacagcagaaggcaacgagaagcaagtcgcgtcttacatggatggcagcaggcaaagagagagcttgtgcagggaaactcccgtttctaaaaccatcagctctcatgagactcattcattatcatgagaatagcacaggaaagacccgccacccctgtaattcaatcacttcccaccgggttcctcccacaacatgtgagaattgtaggagttacaattcaagatgagacttgggtggcgacacagccaaaccataacaatttgctataacatggatgagccctgaaagcactatgctaactgaaagaagccagacacaaaagaccacatattgtattatccaatttatatgaaacgtccagaatgggtaaatccacagagatagaaagtagattagtggttacctggtgttagggagagagagaaaagggagagggaaggagtatgaagtttctttttgggatgatgaaaatgttctggaattggacagtggtggcagttgcacaatcttgcgaaaatactggaaaccactgaattgtatttttggtcttttttttgttttgctttgctttttgagactgaatcttgctctgtcacccaggctggagtgcagtggcactatctcagctcactgcaacctctgcctcccaggttcaagcaattctcctgcctcagcctcccaagtagctgggactacaggtatatgccaccacacctggctaatttttgtatttttagtagagacagggttttaccatgttggccaggctggtctcaaactcctgaccttgagtgatctgcctgccttagcctcccaaagtgatgggattacaggcatgaaccaccgtgcctggctgaattatgtacttctgaaaggtgaattttataatatgtgatttatatctcaacttttaagaacgagagccaggcacagaatcccatacctgtaattccagaactttgggaggccaaggcaggagaatcatttgagcccaggaattcaagaccagactgggtaacatagagaggccctgtgtctttaaaaaaaaaaaagatattcagtagaagattcagatttaataaatattttcgctgggtgtgatggctcatgcctgtaatcccagaactttgggaggctgaggcaggtggatcacttgaagccaggagtttgagacctatttaaaaataataatatttttactactgcatcaaggatatttttattttttttatagagatgtgaatctcactatgttgcccaggctggtctcgaattcatgggctcaaacaatcctcctgccttggcctcccaaaatcctgggattacagggataagccactatgacaggtctctgcatcagggacatttgtaagttaaactattctttttcttttcctgtgagtgcatggtggtaaaaacaaacaatgaccatgatacagtctggtgccactctctcaacttgtgctaaggtgccagcagtcttatcagtcattgcttttgccatcatcagtgaaaaaagcagtaacattttaacattatcataaaaacacagttagccctctgtatccattggttctgcttctgtgtattcaaccaaccacggattgaaaatattcatggaaaaaagtgaatggctgcatctatactgaacatttacagactttctgttcttaccattattccccaaacaatacagtataacaactacagcattacactgcattagttattattattattattttttttttttgagatggagccttgctctgtcacccaggctggagtgcagtggcgtgatctcggctcactgcaacctctgcctcctgggttcaagctattctcgtgcctcagcctcctgagtagctgggagtacaggcatgcaccaccacgccggctgatttttgtactttttggtagagacggggtttcacatgttgtccaggctggtctccaacacctggcctcaagagattcacccgcctcagcctcccaaagtgctgggattatagatgttagccaccatgcctggcttgtattagttattataaataatctagagatgatgtgaagtatatgggaggatgtaaattatatgcaaatactacacctttttatataagggacttcagctccatggattttggtacccacagcaggggtactggaaccaatcctccatgaatactgatgaacgactacagttgtgaacttgtgataaccaaaagtgaaatcagggaccaccagcagtccatctgcagactccactttgtgaactcctggactagactataagctagaaataggaatccaatttatatttacacacgaggcagtattgtgtgttagaaaagtagcatgggcttaggttcaaattccagaactgccatttaggtgatgagagcttaactcctccatgcctaagtttcctgtggtataaaatgaggatcgtacctactaacaaatttactatacagattaaatgagatgaagatctaaaatttaacaggtgttcaatagatgttaactcctttccctgttttgttctcaaccagctcgttcagccccttgcatagagaagatactcaaacgctcagtaaatatttgtagaatttaattagtacctcacagagatctacaaaagtcaaagttctaagataaaatataaatgctagatttagatataaaatattgagatatgctcaggcatttctcagaaaaatattatactcagattaaattttaaattaaaaaaatcttttataaaatgagtcaaatatttaaaaaattatttgctttccaggtgagtagcagtaaaaagtgaaatggtatatgttaaaagacacactgttccacatctttgaatcaaaaggctttcacaacctgtatatctccatagctcaactatttgaaatttaggtgatataaacaatccatggtgacttttcttcagccaatatggtgatgaacagcaccattattttagtcaaagcatctgattttacaagccaacaccaccacttactaccagggtatatgaccataggttattaggttggtgcaaaagtaattgtggttttttactttcaatagcaaaactgcaattatttttttgccaacctaatatttatcccgatgagtataacaacaactctcacaagttaactgtgaggactgagtgacatactacatgagaagcactaacaatgctaagacagtaagagctcaacaaacactaagcatttttttctgatttaaatatattcaactgatatttttgtagtattcttacatagcatcttggcaccatatgtatagatgtaaatttcttttttttttttttttttgagacggagtcttgttctgtctcccaggctggagtacagtggcatgatctcggctcactgcaacctccaccccgtgggttcaagcaattctcctgcctcagcctcccaagtagctgggattacaggtgcgcgccaccacgctcagctaatttttttttatttttagtacagacggggttttgccatgttggccaggctggtctcaaactcctgacctcaggtgatccacctgccttggcctcccaaagtgctgggattacaggcatgagctaccgcacccagcctaaagatgtaattatttttaagttattcatctcagtatatgaatgaaattattttaagttattcatctcagtaacgtttaggtgaatgctgataataactcagtaacttttaagtgaatgctgataatcctagcatctccctaaattgttcaatttacaccataaatttacttttcccaccttttaaagggataatgcaagggattctaaatcgtggcataagtctggaattccttagattacccctttaggaagcgaaattatgtttccaagttcagactctggcttaaacttcaaattgtcccaaaaatggactagggaaaatacaaaaactttctacaccaacagatatctatcttcaatatgtgaagtgtatctttaaaaatacaaaacagctagtaggaaaaacctccaatataatgtatacctaaagtagtttgttttctgtcatcattaagatcataatgaggccgggcatggtggctcacacctgtaatcccaacactttgaaaggccaaggcagaatgatggcctgagcccaggacttcataaccagcctgaacaacatagtgagacactcatctctataaaattttcaaaattaactggaggcagtggctcacgcctgtaatcccagccctttgcactttgggaggctgaggtgggaggatagcttgagcccaggagtttgagaccagcctgggcaacatggggagacctcatctccacaaaaaatttaaaaattagccaggcattgtggtgagcacctgtggtcccagttacttgggttgctgaggtggaaagatcacttgagcctgggaggtcgaggctgcagtgagccatgatagtgacactgcactgcactcatgcactcctgcctgagtaacagagtaagacccttgtctaaaaaaaaaaaaaaaaaaaaaattaaaaaaaaaagactataatgagattgaacagaaaactacagctcagaatcccaaatattcctgatatgagtgtatttccaacttgaaagactccattttggaatgagagaaagcacaactttaaaggatgttatgtacataatagacattaaccattttacttgataataatcaaatgtaacaagataaatacataaaataaaccaccattttcacttcaaacatggcatgtttatgtgaccacttctaaacgtctctggggcactacccatctctgacatgccttcacaaggtaggtacaaggaaagggcagacacagagaaaaacacccctattcaatctacatctgattttttttttttttttttttgagacagagtttccctcttattgcccaggctggagtgcaatggtgcgatcaccgcaacctctgcctcccaaggttcaagcgactctcctgcctcagcctcccgagtagctgggattacaggcatacaccaccatgcccggctaattttgtatttttagtagagatggggtttctccatgttggtcaggctggtctcaaactcctgacctcaggtgattcgccagcctcagcctcccaaagtgctgggattataggtgtgagccaccacgcccggcctacatctgatctttttaaaccactgtctggtaagactcctgagaattcatgatctttttttcccccgagacagagtcttgcttcgtcacccaggctgcagtgcagtggtgcaatcttgactcactgcaacctccacctcctgggttcaagcaattctcctgcctcagcctcccaagtagctgagattacagacacgtgccaccatgcctggctaatttttgtatttttagtagagacggagtttcaccatgtgggccaggctggtctcgaactcctgacctcaagtgatccacccaccttggcctcccagagtgctgggattacaggtgtgagccaccaggcttggccagaattcatgatcttttcaataacactactcactcccacccacataccgcagttcaaaaaacactgctctggaggaaagtcaaacttgaaaactcaatctaaaatataaaaaaactcagtactcagtaacttcttggaggaaaaaagaaaatgaaaccaagaagagaacattaatctatactaaacagaagagatggtatgtaacatcctttcctctaagaatgacagaagggccaggcgcagtggctcagacctataatctcatcgactcaggaggccaaggcagaaggatcacttgaggccaggagttcaagaccagcatgggcaatgtagtgagaccccactccattctctcaaaatttttttttagaaaagtagcgagttgaggccaggcactgtgggtcacacctgtaatcctaacactttgggaggctgaggcaaacggattgcttgggcctaggagttcgagaaacatgggcaacatggtgaaacaccagctctaccaaaaaaaatgcaaaaattagctaggtgtggtggcacacacctgtggtcccagctactagagaggctgagatgggacgatcacttgagcccaggaagtcaaggctgcagtgagccaagattgtgccactgaacttcagtctgggtgagagtgagaccctgtctcaaaaaaactaaaataataaaaaacaaaataaataaaaagcagccaagtgtggtggtgcatgcccataatctcagctacttgggaggctggggtggaaggacagtttgagcccaggagctcaagactgtggtgagctgtgatcatgccactgcattccagcatgggtaacagagtgagactccaactctaaaaagaagaagaatggcagaaaggaaactaatgttaacagggaaaatacccatagccaagtctgctaatttaaagatgaatgctaaggaatttccacgtcttgtgaaggcatgcatatcttgtgctaattctcttaagatttaagatgaatagccataataattgtcataatctatccctcactccattcttcagttccaaaaaccctgtctccaagaagcttgtcaaaagcatacttccatctagtaatttacactttcttattatacacagtaaacatttattaaaaataataatattcataacaataaacttttaaggcatccaacaatgtggtaagtgcctgccagtatcatactagtttacagccttcctcagaatcaaagtatgtataaagaacatctgaaagagggcagtataatgcttagcaagcagtattctcacacaaccaataaagacacaaatgctggccaggcgtggtggctcacccctgtaatcccaacactttaggaggccaaggtgggtggatcacctgaggtcaggagttcaagaccatcctggccaacatggtgaaaccccgtctctactaaaaatacaaaaattagccgggcatggtggcaggcgcctataatcccagctacttgggaggctgagacaggagaatctcttgaacctgggaggtggaggttgcagtgagccaagacggcgccattgcactccagcctgggcaacaagagcgaaactccatctcaaaaaaaaaaaaaagacacaaatgctgttatagaaggaaaccaaagtcctaactataaaacataaaaacccatgcacttttagtaagaattcattcatgtgttactgtgtaacattactgtgttaatcaagcacttttcgagcaaggaaaaaataaaatatggacaagtggtgattttataataaaaacacaacatatgaaccacattcattgtacttcttcaaaaaccaacattaatgactattaggatgaatcatttttaggacagcaaatatagaaacatgtaaaaaaaatatgtaagcccaataattttttttaaactcacccatgtgattttttttcacttttccttttttgagacagggtctcattctggcacccagactgtaaagcactggcatcatcatggctcactacagcctcaaactcctgggctcaagcattcctcccaccttagcctcctgagtagctgggactacaggcgtgcaccaccacacccagctagtttttgtattttttgtagagatgaggtcttgctacattgcccaagctggtctcaaactcctagcctcaatcgatcctcccaccttgatctctcaaagtgttgggattacaggtgtcagccactatgcctggtgacttttcctaatttttaattatgaaagtttatttaaaatacagaaaaatgaaatgataaacccaaatataacaatttatgacatactgccatatttgcgtcagattttaagaaagagaatattggaagtaagttgaaagtttccctcttcattccactgtcctgtcttctccttcagaagtaaatatcctgctgaaggtaatatagcttcttttaatccacatcttaaaacaattttgtagcatacatatgttttccttagacaacacagtattggattgactgatgtgtttgtttaaaagatggggtctcactatgctgtccaggctacactggaactcctgggcttaagcaattgtcccgtctcatcctttcatctcagcctcccaagtagctgggactgtaggcatgtttttattttgtcttaactgatcataacaggtatcacatttaacttcttgtaacttgcttttaatttttattctttttttttttaaataatagaaacaggctttcacaacattgctcaggctggtcttgaactcctggcctcaagcaatcttcccacctcagcctcagtgctggattacaggcatgagccaccatgccaagccacttgctttcttttttttcaacataatgcttccaggatgtatctatattgacacatgtagacctgatttgtccattctgactgtactagagcaataggttgcattaaaatgccactgctcgcttatccatttctctgtagcttccaaattttttcctatcacaaatataaatgaaattaaaacacgtgtacatgtttccttttgcataaatggaaggttcaccatttatgcaaaatacatacaagatgtatattttgtactgctggttcataggacattcatcaccttcacaaaatcttgccaaaaactttctacagagctcaatttacacacccatcagcagtgtattagggtttctctttccccatatccttgttaacaattggtagtatgagattttataatatttgcaaaatttaagtgtgtaaaatagtatcccattgtttgagaaagagccaactttatagttttattaggtatatgggctttcccttctgtaatatttttagttctagattataatatgtataatatatatacaacttattcctttcttctgtgcatccacagagtcagacactatggaattttacatctaacatttaatcctacaataggaaaaaaaagttttctttgcaattatgatttccaagttgacataagcctttagataaatgatgatacggagtatctttaatcaaggcatcccatgtatcagaatttcatatagctctactcagcaaaaaagacaggtatcttacctatacagataatttggtcttacttgttagataatagctttactggtatataattcacatactataaaattcgccctttcgaagtattcaactcagtggattttagtgtaatttgcaaagctgtggaaccattactactagctaatacatcttctttaccttaaaaagaaaccccattcctattaagtggtcactctccattcccctctcttccagcccccagcaactactaatctactttctgtctctacggatttgcctattctggacatttcacataaatgggatcatacagtatgtggtcctttatgacaggcttctttcacttagcataatgttttcaaggtttatccatgttgaagcatgtattggtacaccattccttttcattgccaaataatattcaactgtatagatataccacattttatttatccactcatcagctgatgggcatttggactattccatgttttccctattatgaataatgctattatgaatattcatgtaaaagtttctgtgttggtatattttttcaattctcttgagtatataacgatgagaagaattgctagtcaaatggtaattctacgttatgctatctgactttaacactaagcaaattttagcactatgacatacatcagggtgctgaattcctatgagttgctttaatcctcttcccaaaaaaattcatcaatttgctcttattcatagtctaaaaaaaaacttcccaaggttacttccttccatacagccacagacgaaggttttaactttatacacacatacacacacacacacacacacacacacacacccttctctacaatgtaaagcagtctaactttgattccctgggaaactgcactgtttgttcaaaaatcaaggtaaacctacctaacatatgaataccattagctcctttaaggttacaattaaagttgcccagaactcagttcattatgttatagaaacagagtatgcacattatggttctttctgtatgaaaaaaaggctgatggcaatctggccaggagtacacaggggtgagctgaacagtgccctcaggtactgcaatgctaagagtctcactggagtgaagcagctaatagatttagagcacatccatgtcttttgccaaatgaggcaaaataaagtaaaaagtctttaacaaatggagctatgaaagagcctgaaaagcctgagagctacacaagagctctattactaatattcttccctgattaaaaaaaacagagctttgttttgcctgtaacagacactatcaatcctcccagtaacttgaaggcaaatatagccacatgacagctcattagcatttcagagaaaaaaactatgatatttagtgaaaaacaaaatgtgtaataatgaaaccatagctccctatgatgacactaggggcccagctcacaaactaggcagtcagaactttggtaaccttatcttttctaaagctaaattttcctgcagaagtgcctcaagaccaaagaagaggacaattccccagctttacctctggctggattaggcacactcaagccacaaaacataatacaaagagaatgttgcaagtaatcagacttgcaattcaaggaaagcacagtaaagcagaatcaaaagactctctaggtcaggggttcccaacccccagtccatggcctgttaggaaccaggccacacagcaggactgagtagtggggagcaactattacggcctgagctctgcctcctgtcagatcagcagtggcattagattctcataggcagcattagattctcacaggagcacaagccctactgtaaaatacacatacaagggatctaggttgcacctttcttatgagaatctaatgcctgatgatctgaggtggaagagcttcatcccaaaaccttgcccccctgcctcagtccatggaaaaactttcttccacgaaactggtccctggtgccaaaaatgttggagaccactactctaggtggatcataagatcataagcacagagcagttcacagaaagtgcacaggacgaggtgctcatctccagttttcatccccatgtggtatatatagtatttgtcatctgcatagtactttgtatgtccagactattttataatcacaattctgggattatttcatcacaataatcgagtgtgacagattaaaatttactgtccttcttctaagcattcagattacagtagatgggaaaaaaatcaggatggcagaacagaaaaacagactcttgtaaggtctcaaaaccttgtcaaaaacatgatagaatttctgaattttaggatttgaagaaatctaaagtgtccaatggtttccgatgctaagaaactaaagctcagaagggttgtaagcaatttgcccaaggtctccaaataagtaagtggcaaagccaggaaaacccagacatcatgactcccaagtcagcctttccatacatacaaccatagtgccttttccaaaagccaataataaaatagatgcggaggattctgagctgtctggctcagcacgttatcttgtctttcaaaatgctaagtctcaggcaggcgtggtggcttgcgcctataatcccagcactttgggaggctgaggcaggaggatcacctgaggttgggagtttgagaccagcttgaccaacatggagaaaacctgtctctactaaaaatgcaaaattagccgggtgtggtggcacatgcctgtaatcccagctactcgggagaccgtagcaggagaatcacccaggaggcagaggttgtggtgagccaaaatcgcaccattgcactccaacctgggcaacaagagtgagactctgtctcaaaaaaaaaaaaaaaaaaagccaagtctcttgagctgggcacagtggctcaagccttaatcccagcactttgggaggctgaggggggtggatcacttgaggtcaggagtttaggaccggcctagccaacatagtgaaaccccatctctactaaaaatacaaaaaattagctgggcgtggtggcgcacgcctgtagtcccagctacctgagagtctgcggtggtaggatcgcttgaacctgggaggtggaggttgcagtgagccaagatcgcaccactgcacttccagcctaggcaaaagaacaagactcggtctcaaaaagaaaacaaaaaagtcaagtctctcctcatattcacttaccaaagaacaaaaatattacaagtccagagaagtcatcacttctgccgatctgaagggaagaggaaacaaggcagtccaggcctcaatgctgctgagcaggaaggctccatggtgtaacttgttctagatgtctgaggtcgatgattactactttaatttttaacttgtatgtaaaacattatataaacttttttaaaaatcacataggctaaatttataacaaaaagttatatatgctgtatgattccacttatatgaggtacctagagaggtcaaaatcatagacacaaagtagaagggtagtttccagggggaaggaggaggagggaatagggacttatttgtttaatgggtgtagagtttccgtttcacaagctgaaaagagttctggagatggatggtgatgacagttgcataacattatgaatgtatataataccactgaactatatacttaaaatgattaagatggtaaatttcatgtgtattttaacacaataaatgaaagtgggggaaagaaagtaatagtgaagacaacatgaccagaataacattttaaaagcatcaattagacagctaaaagaacagagctaggtgatggcaggggatgagagttagcagagaatgcaattaggaggctactggagaagtctaggagagagatgaaggtggcttagccaagggcaatagttgagcagagagatatagtaagacttgggatatattttaaagcctgagttaaaatttcatgaacatatatcctaacacagtatttttaactgcaattcataatacacaggtcacagaatcaatttcctaggccaacatcaacatcttgcaattaaataaaatggaataaaatagaaacgagcagattgcactgcacctaataagggtaagtattatttcatgaaacttttgttttagatatcgatatacttacgtgtgtattgggtctgaatgtaaaatacatcttgaacgatgaaccacagccaaaaatgttgagaaacattgccctagagactgataaaatggtaggtggaagttgagagtaattatttttttttatctccatcaaagtccttactaggctcaagtgaaacaagctacaacaagttgaattacatacctaataaaatcttattgatctgccaaacaaatacatcatttgctcttcaaaaaaaaaaaaaagaaggaaagaaagaacagtacaaacaataaccaggcatcactggaatgcgaagcacaaattgtattatttccatcaaccatgaagatacaaagattactaaaggaataatgccaatcttctttaaccactaaaccactctagccattcaactactcttaattttagaagttaaaccctaccaaaacacattcataatggcaaacgccctcagaatcttcaggaaaataccttactctcccaactgagaaaatatggcctaattcccctggaataattcagagattacatactaaagctctgaaggatttgttcaaaaagcttcctgccatgagcaatcactgtttttttcactgatcaggtctttattaaaaataagctgtccaaaattatttgacctttatggaataaaccaacaagctcatgcagcaggcttcgtttcctctgtggtaggtttttttttcagctactgatgtcttggttggtagctgctgccctttttcccaccagaggtttctcctgcttaaaaacaacaaccttctttcctttcttccctaccacaggcttcttgactgcaaccccctttctcatctgatttggcctctagtgctgctggtgctgctggtgctgctggtgctggtgctggtgctgctgctgctgctgccaccgccgccgctgccttatccacctggagtttgtggttgctggcctggcaaagcctggtgttgcagagcatggtctttgcatatgggtttagcttcaacatgattttcaggttttccaggaggtttgtccccaggactctacgatgaatcttcctgcaacgtgcttgaagggctttggatgtctgggcttttcaagattctgctaaggtctgtattgatcatcttgtgcatgcaaagattgcagttactcttgaggaaacagctttacaccaagtgccacacaattgtctaacttctagaaagcactttcagtccaaatgcagaaatgtcccacatgcccatcaggagcaagtttcaaaatgttcagtttgcttacattaagcagaataattctaggaatgtttcggaaggctttgacaatacaatcatcttcattagagacgatgcagggtcccttgcgctggatacgatggtttctcattttgcccttgccagctctcatttgctgagaggcatagcccttttttgtatcactccaggcttaagtggcaaaacagcctccttgattgtcttgtagccttcaactttatctctgaccaccaaaaaaagttcaggaacttccttaatatgatgacctgtagacatgaccagcactggtaaggcagaggcagccaggggagaacagatagcatattgttttttggattgtgttcactctacagtgccaacagtgccaggttttggttggtgcaaacatgtggcctccatgacagatatttccaaaagcaccctggccaaaagagtgagtcccaccacctcaaactctgggaatttgagacccaactctgccagtaccccaagattcagcactggtctgacgacctgctaattcactaacaagatagggctgtctgttgtttttgtgcaagttggtgtgaacaaagttcacaatatctggtggaatgggagccttgaatacaggagacaaagtgacatttttgccagatgactcccctttttcagagtacactgataacagtggatcagcacatccatgggaaggtgagaaggccacactccaacattttttttttttttttttggagacagagtctcgctctgtcgcccaggctggagtgcagtggcgcagtctcggctcactgcaacctccgcctcccaggttcaagcgattctcccgcctcagcctcctgagtagctaggattacaggcacgcgccaccacgcccagataatttttgtatttttagtatagatgaggtttcaccatgttggtcaggctgatctctaactcctgaccttgtgatccacctgcctcggccttccaaagtgctgggattacaggtgtgagccaccgcgcccagcctcaacttttttttgtaactaagataaaacattatctactgatttaccaaagtatttagcttaatttcacaacagtgacgctattggcattttgggtgaacaattctgagttttctccaccaaatgccagtgatgcatctcccacccacagtcacttaacaaccaaaaatgcctccatacttttccaaataccctttggatatatggtaccttccccattgagaaccactgaaaaatttagttggtaactgtacttagatcaatagattgccagttaatgaactgtggcctccaattcaggtcagagatgtaacatagtaacagtgccttgaatttaaccatttccaacgtacacattaagatcatatagtctgggccagatgtattggctcacacctataatcccaatgctttgggaagccaaaggcagaggactgctcgagcccaggagttcgagaccaccctgggaaacatggcgagactccatctctacaaaaaatttaaaaattagccaggcatagtggcacatgcctgcaatcctagctaccgaggaggctgaggcaggatgactgcttgagtccaggagtgcaaagctgctatgagctatgattgcgccactgcattccagcctggggcaatagagtaagaccttgtctcaggggaaaaaaaaagatcatatagtctgaggtagaaataatatttaccatttttttcatagcactacgcagtgccgaaatcttatattcaaagtaatatgcagcaaatgtagacatggttggggggtgtatggttaacatatggatcctacaagtatcctaaaaaagtgaatctaaatctccccccaagattgtgacagagacaattacagcaggaatgtctatgattatttccttgagcaacatctatgagctacatttatatgtttatgtatacatgtacagcttataaaggaaaaaatcactgcctactatgtgacaagtgttatcagactgagaataatatacaggcttactgaacatctgtgaccaacaaaagtgccaaatgcctatttaatcctcataaaaacgtatgaggtattactattctattttacaaaggagaatagtgaagtacagagaggttaagtaactgctgagccagggttcaaacccagataactccagacccctcagtaagagctgtattgttccaagggatacatgagaagactggaggaaggaattttaaaagcaggaaagaacttgtctgaaaactatgaaaaatgttaataatgtctactacatgctaataatgtctactaaagtacaactgtgaaaaggttgtcaacaaaaattccttatgacccaaggaaaactaaatttgcgtcccaaggctcttaagcaactgtatttaaactctgcacttaaaaattcatattacaaggccgggcacggtggctcacacctttaatcccagcactttgggaggccgaggcaggcgaatcacaaggtcagaagttcaagaccagcctgaccaacatggtgaaaccccatctctaaatacaaaaattagccaggcatggtggcacacacctgtaatcccagctactcaggaggctggggcaggagaatcgcttgaacccgggaggcggaggttgcagtgagctgagatcgtaccactgcactccagcctgggagacagagcgagactccgtctcgaaaaaaaaaaaaaaaaacttcacattacaaagaagcttaaattaaatgaattctgaacttcatttttttgcattttttgcatactgtcttccacataatactcaatttttaaacactgttagccaggttagtttgttgctctaagaagatgtattgctactacgacaactacatggcacttctgtacaagagatatcaaaagtaaataattagtatggctgtatagattatgtatcactaaggggaaaagacagtttacaatggataaatctggcagacaggaactcaaccaatgatgagatttaacatcatcattaatgagacaaaccaacatggtaggtaagcctttaaaaagctccagtgtagccgggcgcggtggctcatacctgtaatcccagcaatttgggaggtcgaggtgggtgggtcacgaggttaggagtttgagaccagcctggccaacatggtgaaaccccgtctctactaaaaatacaaaaattagtcgggcatagtggcacacacctgtaatcccagttactcaggaggctgaggcacgagaattgcttgaacccaggaggcggaggcggaggctgcagtgagccaagatcacaccattgcactccagcctgtgtaacagaacaagactctgtctcaaaaaaagaaaaaaaaaaaaaaaaggaaaagctcaagtgtatgacaatattcacatcttttactgagtatctgaatacttatgcacagagcagaattctccaaatcagctaatacctagtctgtatacacacacaagaaataaccaataaattattccctttaaaaataaataaatagcagctgggcacggtggctcacagctgtaaccccaccactttaggaggccaaggcaggcagatcacaaagtcaagaaatcaagaccatcctggccaacatggtgaaaccccgtctctaccaaaaaaatacaaaaaattagccgggcgtggtggcacgcgcctgtagtcccagctactcaggaggctgaggcaggagaattgcttgaacctgggaggtggaggctgcagtgagctgagatcgcgccactgcactccagcctggcgacagagcgagactccgtctcaaaataaataaataaataaataaatagcaaatgaagtgaacagaaaacccagaaataataacgagctcttactgagaggcctgaggcattataaaataacaactttccactccggcctgggcaaaagagcgagactccgtctcaaaaaaaaaaaaaaagataacaactttcaaagaaaaaaataactttgaataaaagctaaatcccttcttttcaaggttacactttttaaaaagtgttgagaaaatgtaataaaaataacaaaagagtggtatgtttgaccagtaataagaaactaatatataaagaagaggaggaaagaagacgtgcaatacgcagagtggtggaaaacttcatgagtggaagattaaatccgatgcagaacttaataaaatgtgcgccttacttcaaaggaagtttaaaaatggtgtttacaagggatctttctggggtattggaaatgtaatactggagtggggtaatggttgcacatctccacaaaattactaaaaataaactgtacacttcaaacaggtaaattctgtagtatataaattatacctcaaagttatttttaaagaactaacatttgttcaacaaagaaggaaaaattatattaagtttatctcactaaaccataaaaaggaagtggccaagaggaaaagtacagtaattcattcaatagacagaaaaataaaaatggaaaaatgcatagattaagaaatgttaatgtgtccatttcagcccttgaaaggacagtatagtatctccaggtaattctgctgctcttaaccagattttcttctttcatagatatatgcacaagtccaaaggagaaggaagacttcagtttaattgcatatcacctaggaaagagctgaacaatttattctgacccccaattactgcatgactgaaagacatagagatggtatctcccatgagagaagaatttcaagagaaaatttaaaaacagaaaatcaaatttataattgttttaaaagaatgtgtgggccaggcatggtggctcatgcctgtaaatcccaacactttgggaggccggggtaggagaattacttgaggccaggagttcaagaccaacccggacaacacagtgagacctcagtctctacaaaaaaaaaaaaaaaaaaattattttttttaattagccaggcgtggtggcacacacctgcagtcctagctactccggaggctgaggcagaaggatcactcgaacccaggaggtcaaggctacagtgaactgtaaatgttccacactgcactccagcctgggtaataaatcaagaccctgtctcttaacttaaaaaaaaaaaaaaatctgtggacattttttttttctttttttttttttggagacagggtctcactctgtcacccaggctggaatgcagtgatgcaatcacacctcactacagcctctacctcccaggctcaagcaatcctcccacctcagcctctctagcaaatgggactacaggcacatgtcaccatgcctggctaattttttttggtgttttttgtagagacaggatttcaccatgttgcccaggctggtttcaaactcctggattcaagcaattcatccacctcagccgcccaaagtgctggaattacaggcatgaactaccacacccagcctggtaatttctttacaagcataatgacaagagtcaattccctcaaccaggtgaaacagccaaatggggaattttcttggtatttttgaagaaaattaatttgcattggctcagggacttttgcagaagtttcccaaaacagcagtactgtacttttttactccatttgcagatacagagatcaagcaaaactgcacctataaacaaccccaatccacacttgctttgagctctgaaaatattaacctacactgacctctcctgcaccaacttcagcaaatcctaggtcaagagcctcaacttcccaaaacagcacaggtgtctctaatttcaaacccgccagtctccaccctgcctttggctaatcagtagcaagcccccaaaaaaagaaaaaaattaactcatataattattctttccttctccagaaaacaaatgaagtaacataaaacactacaaaattctatttcctctaaatggctattataaatagttcaagacactgagtcacaatattattcacctagacttgaaaagctgtaatatcaatgaacttgatatatttcagtaaaagaacatacatgaaaatttacagtacaatgcctaactccagcaggaattcaataaaagttggtacctttctttactttccattaattttatcacacagtatttccatggaatagtttattaccccaatataaaagtagaacaatagaaaaaagataatttactgaccacacagatcacacccagaaaattcagaccactagatgatgacaaaggattcatttacagaagtttaactttaatctaccgtctcctcctccttcctagacagcagcgtcaattccaaggccatgttccttctgctataggaagtggctacactgtttttccctgtagcaatgtactaatctcttctttgtgactgagagaaagccagtctcaagaacctgtgctaagtgtagatgcagcaagagtccagactgacatcaacccatagaaccccacacacaagtttacaggattcctggttggggagttccgttttgactgtcaagtttactctgcaactgagccaggtctcctgtaccaataagcaacgggaatctcaacatacttatggtggtagaaaactagaactacatgaactagcagtagcctttaccttgacaggaaatattctgacagaaatagttttgcagagctgcgtgaactgccatctatagctctttttgcaggcacctgacataagacagatacataagccaaagctctatctggtgtacttttgttcaggcccaggagcttaagataggaacaaagcatgttgtgtcaaatcaaactctagtggttacagatggacagatcctgtcatcagtaacaaaatttacagttgccagtaatggcctggctactgtctagtcaggtcctttgttgcatttagtctaccattcacacaggctactgatttttagagtgatcagaataagctagcctaccattacccaccaccctaaattggtttacataatggctccaacacaaaaacttctgccctcaaggactggattaaagaggtaggggtatgtgtgggtgggtacatgtgtaaattcatggttctgttctaggaccaccaaaattttacattggttatgttgtttcttagcattctctacattctaatgagatactagatgtagtccacaacattaaaccacaggacagaccatcaggaggcacgatgagtgagactgaaaaagataatgtttccccaaacaatagtcaaatctgatctattctaggtcagtacaattgaagatactaacgaccacattaggaaaggagggagggaagagtaaataaatctgggacctaccttgcttacaattcccacagacagatgaaattcaattccatgccaaccataccctccgatcactacaacacaaacagaaaaataaaagttcatgcaatataaacagttcttcccattcctaaaaggcgtttggtttcaaaggtaagaagctgtttcttatctcctttcaatcctctccatgcacacaacagtgttaagagttctgtcactggttaaaaaaaaaaaaaaaaaaaaggcccatgtaagtggagttaaataataggtaacactgattgggcacttcctatatgctagatactgttgcaagtacttaaatattaaaactaattctcacaacaactctatgagacaagtgtttttattaactcattttatatccttatatccaaatgacaattgtcctatacctctgaaaactgctcttattggtgttgataaatgcctttttttttttttttttttttggacaaggagtctcgctctgtcgccgggctggaatgcaatggcgcaatctcagctcactgcaacctccgactcccaggttgaagcaattcccctgcctcagactcccaagtaggctgggactacaggtgtgcaccattacgtcgggctatttttttttgtattttagtggagacggggtttcaccatgttggccaggatggtctcgatctcctgacctcgtgatccacctgcctcagcctcccaaagtgctgggattacaggtgtgagccaccgcgcccggccgagaaatgccttttaaataaacataggcaatctctaccaccgtaggtgggttatcataatggtttgtatgtataagtgttctacattcatcatttacttcttgagtcctcacaatgtgatgagcactaataccaggtgctgaagaggattcattctcttcccttaaggagttgagaaactaactggacagataagacaaaacaaaaacagttcaagaaatggaagtccttattatgaggcataatacagcctctttgtgcaatcattcacagtaaaaaatcagcaagctctggggaaaagagaggaaggctttacgtaagagatgctctaaagctggacctttaaaaataagttagatcagcaaagagtggagaaagtctttccaggcaaggaaaagagaacaaagacataacagagacagaatcaatggtatatctaaagtctttttttttttttttttttttttttgagataaggtctcactctgttgcccaggctagagtgcagtggcatgatcacagctcactgcagcctcaacctcctgggatcacataattctcccatctccctggccctgaagcctttcataatctgatcccacccagtctcacaagcctttgctctctggccactaatgtccctcctcctccccattacccacaccaaacttcctcctagaacatactgtctttgatagttctactgtttctcctactacctagaatgttctcttttccctggcgggtaacattaatcctggcactcaaaaaaaaatagcctctgttgtaaataatttttattatttaagatacaactgaggctgagtgccgtagctcagttggaagaagaaagaaagataaaagaaaataaatttagaggtttgactgttatcaaaaaaggaggggagagaaacaattcccaattaaataaatgaattgtggtttttaagcagtccacctcaacagatatggttacatataccctcaaactgaacacctatgaaaaggccagcacttcgggaggccagggtgggaggatcacttgaggccaggagttcaagaccagcctggccccatctctactaaaaatgcaaaaattaggctgggcgcagtgactcacgcctgtaatcccagcactttgggaggccaaggcgggcggatcacttgaggtcaggagttcaagaacagcctggccaacatggtgaaaccctgtctgtactaaatacaaaatacaaaaattagctgggcgtggtggcacgtacctgtagtcccaggtactcggaggatgacgcacaagaatccttgaacccgagaggcagaagctgcagtgagccaagatcacactgctgcactctagcctgggtaacagagcgagactccatctcaaaaacaacaacaacaaaaaaatagctcggagtggtggtacacacctgtaatcccagctactcgggaggctgaggcatgagaatcacttgaacctgggaggtggaggttgcaatgagccgagatcacaccactgcactccagcagcctaggcaacagagtgagactctgtctcaaaaaaaaaaagccaactattactctactcatctctcctccatgctctcatgctctcatagcatctatttctctgttaacacagttaaaacatttggttgtccccaggttttcttcttcctttctctcttacttgtctgaacaagaatcatcttttatacaactttgtatctcgcaagacctagcagtgcctggcaagtaacaggtgctcattatatacttgctgatagaaggcccaactgaccagaatttacaaagtgaataacgatccatttaaacaatctgttgtgtcaaaagctagtgtacttctacattctcacgaatacgtctgctacgtaattacaccaacaattcatgaacaaaaaattaaagtggattcactaaaaaccaccaactagtttttgcttgacaacacaaccaggtccttatccatgccaactaagacataaatgaaaggtaaactaattcagttgataatttaaatattatggttggtgatctttcttactaaaacggtgccacagctttgtatgtagagtagctaaaggtatttacattggctttagtcatggataaagaaggttacaaatttagaagtccaatacaaatccaaagtttatttttagaagctttccatatggtaggagtttaagaagtaaaacagcagccttttctctgccgaaagcagagggtagtagagcgccaaaggagcaaaccctctcctgactctgtgcctggcactgcttcacgcagaggaagaaatgtgtagggtaagcgagagcctcactgaaaatcagtcacccaaggcaacaggcattttgaaagtctgtgctatttgaaggcttaagtattaattttatacatgcccatgttcatttaaaacatttatggcttggaacttaaaaaatgttctaatgtgctagtttgtccacatattaatcgagtctgccaggtttgaacatgccaagtttaaaatactctccagatcgttatgcaaaggtatgagctcaatcttttagtctcaggaaaaggaatttaggagagaatgactaaaacaatagtccttcaatgaaagctacaacagaaaaagtcaactcctaaatagtgatgagttactttttaaaaatacctgacagatttcttacattaatctcaaattaagatcctggattttagctcaaagttgtcagacaatgttattttttggtggttgtttccctcccccgcccctccccagcctcctagagaatggatcttgaaattgattgctacatgagaccatcttatataaaggttgttttagtcattcactgactaagcccctttagaatccaagtctaactcattttatattgaaatgaattctatttttatatgaatagtattacaagcaaaattatcttaatcttttatcagcattagagaaatgccaataaaacctagaataactacacttttataacaagaacctcagaaactaacacatccagtattttcattttcagttggggaactacagcacaagagttcagtgatctgataaaagaaaaatgagccagaatctgattactagtacaatgtatttattctactacatactactaaacacactgtttttgaaattacaacagaaaagtttaaatatccattccctaactgggaagattttaaaaattagatgtgtgtgcccccccaaaattggaaatattgttccttaaaaacttgggtattagaggccaggtacagtggctcacacctgtaattccagtattttgggaagctgaggagggcgaattacctgaggtcaggagttcagcctaaccaacatggagaaattccgtcgctactttaaaaaaaaaaaaaaaatagccaggtgtggcagtgcacgcctataatcccagctacttgggaggctgaggcaggacaactgcttgaacccgggaggcagaggctggaggttgcggtgagtcaagattgtgccactgcactccagcctgggcaacaagagggaaactccatctaaaaaaaaaaaaaaaaaaacctgggcgtggtggctcacacctgtaatcccagaaccttggggggccggggcgggctgatcacctgaggttgggagttcgagactagcctggccaacatggagaaaccccatctctactaaaaatagaaaaattagctgggcatagtggtgcatgcctgtaatcccagctactcaggaggctgaggcaggagaatcgcttgaacccaggaggcggaggttgcagtgagccgagatcgggccattgcacttcagcctgggcaacaagaacgaaactccgtctcaaacaaacaaaaaaaacttgggcattagaaaactatagcaattattttcaatacttttggctcaatacatacgcacatagactctccagtggaaatttagcttttaaaagatttccttacattccaaaggggatgagaataatttttacaatctaagatgacattatccttatcttctaaaaaataaacttcccacaaagaaaaaaagcaatttcatagaattctgggtcttctttcaaacaagcacttctttggaaagaatgccactaatccattttaatttaggggaagagaatgcaaaggataaaaggaaagttgccaggcacagtggctcacacctgtaattccaacactctgggagaggcagaagcgagcggactgcttgaacccaggagtttgagaccagactgggcaatatggcaaaaccccatcgctacaaaaaatacaaaaattaatcaggcatggtggtgtttgcctaaagtcccaactactcaggaggctgaggtaggaggatcgcttgaccccgggaggttgaggccgcagcgagctatgattacaccactgcactccagcctgagcgacagagtgagacacgctgtgtctttaaaaaaaaaaaaagaagtgaagggaaaggaacaaaaatggaatgaagaggggaaaaaggaaaaggaagaaagacaaaagaaaatcaatttagaggtttgacttatcaaaaaaaaaaaaagcagagggaaaataacaatttccagttaaaggaataaactgtggggattttttggaattgtggtttttaagcagtccacctcaacagatattgttacatatctcctcaaactgaacacctatgaaaaaaatcttaatctctctctgcctgattcctctgtttgctctttcttctgcacccaaagagaagattaaataaactaggccccctgaaacaagtaagggaggcagaaatgcgaatccatgcaaagtgctggtaatgactaaagcgatccaagagtcttaaaggagtcaagagaaaccactgtgctcctaggcatatccataacctcctacaagaagcaatacactctgctgcctttcatatccaccacaaatctttcctttccgattatcggtgtgatgtgcatagagattttaaagaacagttaaggcagggcatgctggcccacacttgtaatctcagcactttgagaggctgagattatatttgattaaggtgacaagaggaaaatggaagcaatacctgtatatattaaaaagggagagagaaaataaagaaggcctatgtagcctgctggtcaacccagatgcagaattcaaccgaacatgctcatgtgctcattaaggtaccataacatatgcaatactttacaaaataaaaaactacaatcttggctgggcttggtggctcacgcctgtaatcccagaactttgggaggccgaggcaggcggatcacaaggtcaggagttcgagaccagcctggccaacgtagtgaaaccccgtctcttctaaagatacaaaaattagccggccgtggtggcacacgcctgtagtcccagctactcagatggctgaggcagaatagcttgaacccggaaggtggaggttgcagtgagccaagattgtgccactgtactccagcctgggtgacaaagcaagactccgtctcaaaaaaagcaaaacaaaacaaaacaaaaaaactacaatctcaaactgtccacttataagaagagtttcaaactctataataaagttcccagttttcccttcatctgccagcatcccataataagcatctcctgtttgaccattattaagactcagacatagtagctccagagaagtagatatagctctttccttttgaaactgcaaagcaaaacccactttacaatttttaagtttttgaacttttttttgtttttttgagacatggtcttgctctattgtgcagactggatcacagtggcacatctatagctcaatgcaacctcaaactccttggctcaagtgctcctccctgcctccgccttcagaggagccagactacaggcatgtgccaccatgcctggctaattttttatttttgtagtgacagagtctattttgcccaggctggtgtcaaactcctagcttcaagcgatcctcctgccttgacctcctaaagtgctgggattacaggcatgagccaccatgcccaacttcgaaataatgttttttaatacttccattttactgtcttatagtagctgacaaaacacaaatttaatttagcctagactctagcctagttttataataagttaatttcagcagttatcacatagatgacaaaaaaaaatactcatcgtttgatactgattaattctgaatgactggccataacctttaaagcctgaagatcagctgggtatggttacactgagccatggatgtgccactgtgatccacctgagtaccagagcaagactttgtctctttaaaaacaatgaaaaattaaaattaaataaataatataaagcttgaagatcaagactgaaatccctttcccatcacaatcagaggtagggggtcaaatctcagtaaatgaggaagaataacaaaaatataatgagtccctggcatctgttaccaacagtgaattcatcctgatagcaactggaacattccagtgatcctggcaatgaggaacatcgatgtaacatactccttttgttttaaatgcaaatttttctctcctgttccctggaatgtcccaaaacaagagaatggtccagagcctgagaacaaagcacctacgaagaagaacaacacagagagggacctatacaagactaccactagtatcacaatctaggtcaaggtcattggagaaatcacaaaatcacaccatctcagcattggaaagtgatcatcatgtgtcaacaaatattttccaagtgaccatgtgctagatgctaaggaaacacaaatgattatgacaaaatccctattcaagtcatgtgtgctaagtacttcaatacaggagttaactaagggatatgggagtatagcaggaagaataaaacagcagatttttcaaaataagttgccaagaatgaacttgggatcaccacatccaccatctgccaatattacaaacagaagaatcgtggtgattcaggataaagagaaagtaaggctgcagtcacagcagggctaggacttgtagcctcctagaatcaaggtcttgctctcctatgtggttggtttaaaaaatagttaaaggcacccctgtaatcccagaactttgggaggccaaggtagttggatcacctgaggtcaagagttcaagaccagcctggccaacatggtgaaaccccatctccacttaaaaaaaaaaaaaaaaaaaattagcgaggcgtggtggcatgtgcctgtaatcccagttactcaggaggctgaggcaggacattcacttgaacccaggaggtggaggttgcagcgagccaagatcacactattgcactccagcctgggtgacagagcgagactccatctcaaaaaacaatagttaaaggtgattatgatcatttctgtcccccttcatttcttcttcacaaaaaactggcatcacaagaaagcacagttctagtccaaccattcactcagtgccaatctctaatttttacaagacagtacttaatcctttaaaatatttgctgaaaaaatagtgccttcccttcctccagaaaattttatgtacacactaggctatttacagaggtctaggttacaactttaacttccagaataaaactaactataatcactactaatgccatgtgactttccctctggccgaagctctaaactgtctacctccctaggcttagagaagtctttctagctccgaggcttctgacacttcagctcttcattttactgctaattatgactctcaggaattcacccataaagaactacaggaatttaccctattaatccacaaaccacatttcattttcattttccagacaaatcttaaaggcctgtaatttacaacatcaaaaagtatcagatctccaaatggaaaaacttatctctgacataggagttttttcttattggtaacctctctctatccaatagaaacatacttaactaccataacatattctaacaaactgctgctatttcagcaattacaatagagtatatgcttttgatagtgagtcaggtcttgggagtggcttagcacatggaaattcaccagccggcatctacactgagattcaaggagacaaacggaatttttgcttctggtttttccaagagttaactagtgtttaaatcgactatattattctgaattacttacagatgaaatggcaaaatgtctgaattttattttaaaatatgaaggaggaggtgtggagtaatattaaacaagattggtcacatgttgaaaaaaaaaattttttttttactttttttttttttaatttatagagatgaggtctcactaggttgcccaggctggtccttgaactcctgggctcaagtgatcctcccaccttggccttccatagtgctgggattataggcataagccacggcacccagcccctgaatactgttgaaactgggtgacaggcccatggtggtggttcattgcattattctccttgtttttatatgtgtttcaaatgttccataataaagatttcaaaataaattttactaatgtcatgatctggtgaacttggaaaacagataaagaacaaagtgattcttggaaccagtgatctccataatctacctgagtaaaagctgttagtttcttttttttttttttctttttgagacagagtcttgctctgtcgcccaggctggagtgcagtggcaccatctcggctcactgcaagctccgcctcccaggttcacgccattctcctgcctcagcctcctgagtagctgggactacaggcgcccgccaccacacctgactaattttttgtatttttggtagagacagggtttcactgtcttagccaggatggtctcaatctcctgacctcgtaacccgcccgcctcggcctcccaaagtgctgacattacaggcgtgagccaccgtacccggccctaaaactgttagttacctaagacatacctaaatactggccaagcgcggtggctcatgcctgtaatcccagcactttgggagaccgaggtgggcagattccaaggtcaggagtttgagaccagcatgaccaacatggtgaaacctcgtctctactaaaaatacaaaaattagccgggcgtggtggcatgcacctgtaatcccagctactcaggaggctgaggcaggagaatcgcttgaactcgggaggtggaggttgcagtgagccaagatcgcgccattgcactccagccaggttacagagcaagactccatctcaaaaaaaggaaaaaaaagagatacctaaattctaacgcttattcctcactgaacatactattcagcacgatcaccatgtgctgacttaggcaccaacctaagtgctgatgatacagtgataaacagataaatgcaatctgtctgttgttgtcgttgaatgaatgaggcaagtatgtggtgccataaaccaaacaagaagagactaatctatgacctatcaggaaaagcttcccagaggagttaccatctaagttaaattctgaaaaattaaaccccaaaacacgaatcatttatttttgacccatgttaacctttatcacttacagattgtaagaccagcaagcaaatgcctatttctttatgaagtaaccacttgtctgtaaaggaaaaattagcaaaccatcactcattcaacaaatattagatacccaccatatgctaacatactagacaaaaaagataaaacatggtctctgctctgatggggtttataatctaacagcacaggaaaacaaaaacaagtaagtaggcaagccatcaagcagaaaaccaatttcaaacttctccaagttataaaaccagcaaagaagggacttttgtgggcagaaagtgccaactttttagatatagtgataaggaaagttgaaaggactgaagaccaacggatgacagtgcagccgactgaagggagtgggatgccagaagaggtggtgagatcagcaaagatacagtatgtgtgcaccttgtaggtcatgggatgaaatctggatattattctaagcacaatggaaaaaccaccgcaggtaagagttttgagcagagaagtgatgtgattccatttatgtttttaagaagatcattcttgttactctggaaagaatggattgatcgagaataattttttaccaagaagaattttaaatgagtaaaatcaaaacatcaaaactgattttggccagggaaaatcatctctatattccattaccaacctaaaatcttttaaattgccttacttagtccaggcttcatctacagtttgggttgggattgtttgttttaatgcttacaaccaacatgtcatgccctctgaggaggttcctgggaagctaaaacaggcccacatgcctggtggttagcattcttttcattctcaaattgctaaagtcagattaattttcatttattcatctcctattccacaatcagcttcttgattgaaaggaaaggagtaagggacttccttgagtgtttcaggagacaataaactctacggaaaatctgataaggaatgtgattatataacctttcttcctcctgccaactatgttccaggtggggactccactatgaaagcaattctaatactcctatccaaatctgccagctctcagaaagctgcctaaagcaaactcatttaattctctctgaaaaaaaaaaaattctcattccaaagtctgaacaagaataaatttctagtagtgtttgtaattgataaggaaaggaaaataaatttcaccatcaatctctggggcatgtggccaaataatcttaataaagaaacttaataaagttagttatgctcaaagagattttactcagtcatttgaaaaacagaatggaaggagtaacaggaaacaatgcctacatctgttaaatactcatgagctttacatatatttcactttatcttgaccacaccccaacaagattaagtatatttccactttactgatgaggacagagccccaggagtttacactgtctcaaggtcacatagctattaagtagcttccatggtcccatatgctttccattagacaaatgtttaaacaaagatctaaattatagaaattcttccacatgaccaatgaactaataataggtaagtttttgtttgtgtgtgtgtgcatgtgtatatgcttcatctggaggcctaatcaccaattataattcttttcagagggaaaaagtgcttaggattcctctttggagacatcagaccaccagaaagaagctctgaagacataagggagtttggtggcaaaagctatcaggttatttgttcctaacaaagccaaaggagctcctctttgaaggcagcatataatttctggggctagcagcagtgacttcctaacaaaggctctagggactcatgtacaaaaatcattatcaagctcaggagtgtcttgtaagtgatttggggtggttacactcagcaacacatacatacaaaaataactattttgttaacaaataaaatcaagtaagatagcatacatgaaagcacctaacagtgcctaacagaaaacagatacacaatagaaaattagtttcttccactatctgctcaaagttatttgtatgaaaaacaagtaactgtgctgggtgaagccataacctccttgccctcaaagcccagccagaatgagtttgcatacctggtgtcacgtttgctaagaacaacaggtacacaaggccgggtgcggtggctcacgcttgtaatcccagcactctgggaggccgaggagtgcagatcacaaggtcaggaaatcgagaccatcctggctaacacggtgaaaccccatctctactaaaaatacaaaaaattagcagggcatgctggtgggcgcctatagtcccagctacacgggaggctgaggcaggagaatggcgtgagcctgagagtcggagcttgcagtgagctgagatcacaccactgcactccagcctgggcgacagagcgagactccgtctcaaaaaaaaaaaaaaaagaacaacaggtacacaacaagctacatatcaaaaatcagaaatcttctcttaaggattattttatttcctccacgaatcagcaccatagcatggacagaaaggtatccttaaagcaagccttcccaacagctgagcacaacacaactcagcaaaaccacctagccatcagtgcaatctgcattacaatctgcattcatccatttctatgatcactaagcaatcatacatagcctggcacattacatcattattaaacactccacactagggcaaactattcttcaactgttccaattgtttaacttttgaaatggaatgatttttgcttcagaaaaattctttaacatcaattctattgtttagatgcttctgagatttagactttgggattaacaatctccaatataattaaagttgagattgtcatggtaataattccttcagttaatacagtaacaactgtaaggatcaaatgaaaatcatagacaggccatcaggggtcatctttttgtttttttctttgagacggaatctcactctgtcgcccaggctggagtgcagtggcacaatctctgctcactgcaacctccgcctcctgggttcaagcgactctcctgcctcagactcccgagtagttgggactacacacccggctacttttttatttttagtagggacgggacggtgtttcaccatgttggccaggctggtctcaaactcccgacctcaggtgatccacctgcctagccctcccaacagttctgggattacaggcatgagccaccatgcccggcctgtcatctaacttaaggtcctaattttacagaggaaacaactcagacccagagaggttagacaatttgttcagtattacgtagctgattagtgacagatgaaaaattttaaacttcaagtctactgatgcccctttggccaggtgacctttttaaataatagctgccacttatgggataattacagtgcaccaggtgctgtagatgtgacctcatttaatcccaccacaatcctatgagggaggcactatcaaatccattttacaaatgaggaaaccaggactcaacctcaggtctgtttgatgccaaagtctttggtcttaaccactacaccatgcctccctactttccattcattcattcattcaaatacttgctaagcaagtataatgtgtcaggtactgtctgagccctagggatactagtgatgaagatggacaaggtccctgctcttctgcataataaaaataaaagtacttcaatatgaggtacttttttgttggcagggggaacacagtaatgtgataataaccacaggggcagcactatgttatcccttatatatgaaaatactaaaaatgtaagattaccacatcgcacccattagaatgactgttatcaaataaacaagttttggtaaagatgtggagaaactggaaccctttacgttgttggtaggaatataaaattacatttagttgggcatggtggctcatgcctataaacccagcactttgggaggccgaggcaggcggatcatgaggtcaggagatcgagaccatcctggccaacatggtgaaaccccatttctactaaaatacaaaaaattagctggttgtggtggtgcacacctgtagtcccagcttctcaggaggctgaggcaggggaatcacttgaacctgggaggtggaggttgcagtgtgctgagatcacaccactgcactccagcctgggtgacagagcaagactccttctcaaaaaaaaaaaaaaaaaattacatttagccagaaagtacatttagtcagatattgtggcttgaatttgtaatctcagctattcaggaagctcaggcgggaggatcactcgagcccaggagtttgaggctatggtgagctaagactgcatcactgccagcctgggcaacagagtgagaccctgtctctttaacaaaaaaaaaaaaaaaaaaaaaacactttaaatttttgatagtgaaaaatgactaaccaagattttaggctgggcacggtggttcacatctgtaatcccagcactctgggaggcctagatgggtggatcacttgaggtcaggagttcaagatcagcctagccaacatggtgaaaccctgtctctactagaaatacaaacaattagccaggcatggtggagggcacctgtaatccagctactcgggaggctgaggcaggagaattgcttgaacccgggcagcggaggttgtggtgagtcgagactgcgccactgcactccagcctcagagtcagagcaagactctacctcaaaaaaaagtaaacccatcaaagataacaggtatttgaaataatatattctgaaaggcagataaacgtatgtcctctttaatatattaattctagcttgagcgtaagtacaaacagttctaatcagagtaaagaggataaatagatctttccaaattaaactatcaagattacacatacatgcaattccaaatgtctgtttcttttttttctcttttttttttttttttttttgagacagagtctcaccctgttgcccaggcttggagggcagtggcgtgatctcagctcaccgcaacctccacctcctgggttcagacgattctcctgcctcagcctcccgggtagctgggactacaggtacctgccaccatgcccagctaatattttatatttttagtagagataaggtttcaccatgttgggcaggctggtctcaaactcctgacctgagatgatccaccagcctcggcctcccaaaatgctgagattacaggcataagccaccatacccagcctcttttttcctcattcttatattcctgttaaatttctctcagttcctctgatgtctcagcagagacaaactgactactgtacaggtaaaggcagttcattaagctctcttactggactcagattgctgctgtaggaactgcctcctcttaaatttctgagctattatcagacagaagcagctcttaatctccttggcttccttttcaggggaatgtgccaagaaaaagtgggggagaaaagacctaggtccacagtatctcaagtattgtactttttatccattatggactctaaacacatattattcagcttcatactaggaatccaccatcaatcttcctggttttattaaacttgcttggcatagatatattagatacataagaaagaaaatatatcaattaggcgcaactactaccccagtgacactatgacataaataggggaaaaaaagtcttggagggaaaaataagtaaaaaaaaagagaaataatagaagggcattaaaggaagaggtgagtctgaaaacaaatttgagattggatgattcatttgtgttcaccaaagagagttgttttcttttactttttttttttttttttttttttgagatagagacttgctctgttgtccaggctggcaggcagtgatgccatctcggctcactgcaacctccatgtcccgggctcaagtgattttccggcctcagcctcccatgtagctgggattacacgcgtgtgccaccacgcccggccgattttttgtatttttagtagagaaggggtttcagcatgttggccaggctggtctcgaactcctgacctaaagtgatctgcccaccttggtctcccaaagtgctgggattacaggcgtgagccactgcgcccagcctatttttactttttatttttagaggtcttgctctgtcactcaggctggagtgcagtggcacaatctttgctcactgcagccttgacttcctggattcgagtgatcctcctgcttcagccttccaagtagctagaactaaaggcactcaaaccaccacatccagcttttttttttaattaaattttttgtagagacatggtcttactgtgttgcccaggctggtctcgaattcccagcctcaagtaatcctcccacctcagcctcccaaactgctgagatgacaggaatgagccactgcgccctgcccaaagagagctgtttcccaaaggagtttagactcatgctaactttaacaatgagcaaggagtttggagcatgggacaggaaagctgttccatgaattcagggcagcttgaccaaggttagagaaatgacaattatcagtacagaatgataaccagtaatttttaaagttctgtttgaagaaaaacagactaattctgcttgatgacctataaaagtctacattagtcataatcagatttcatgaagatggtacacagctatagactaactacaagaccaagaagcaatttggttctagcaactaaattaagtcagtccactcattgctcagactctaactggaaaggaagaaaaaaaacaaaaacaatttctatagctataccagaatatgtggaaatgtttttgcttcttctcatctaaaaagttatgtacagagtctgttattaagcctatgttatttttccacagatagcagagtacaaaggcaaaaaccaaagaaatggtagttgaaacagattctaagaacagcttatccagcatttgcttttataagtcaaatgtaaatttcatatataatcaactgacatttgtgtaattcctcacaatgagcaagtactttatttaggcaatgtaaatacatatggtagatactcagtaactatttgaatgaatgaatgatctcatgcatactcaagagaccacttccaggagaaaccaaaaaaaattaactctctaaaatgactgcagttaggaaacggcaagagaatgaaggatgaactatcttcctgcaatggggctgcaagaaggtacgttattcagccactcattcattcaacagaaatgtgaggacctattacaagtcaggcactcttacagtacacacatgtgtggcagtgtagattagctgttaagaactggctacctcaatcaaatttggcacgcaaacgttttttgtttagtccacagagtattgacctggagagtactttttaatcaactttgaagtataatttgcatacaataaaaagcacacattttgagtgtacagtttcagtgagttttgataagtgtatactctcataaatcatcaatctcaatcaagaaaaaaaaacatttccataagccaggcacagtgactcacacctgtaatcctagcattttggaagcccaaggcaggaggatcacttgaggctaggagtttgataccagcccggacaacatagtaaggctctgtctctacaaaacaatgtttaaaacttagctgggtatagtggtgcatggctgcccagctactcaggagcctaaggtgggaggatcacttgagcacaggaggtcgagcctgcagtgagccatgatcatgccactgcactccaccctaggtgacagagcaagaccctggcccaaaaacaacaataacaaggacattcccatcactcttcatatcctttgcagtcaatattccacccttactgcatctaatcaccactgatctaatttctatgactacaggttagttttgcctagtgtagaacttcttataaatgaaatcatatagtaagttctcttttgttttctttcactcaacatgtttttgagattcattcacagtgctgcatgtatccataattcattcctttcttttttctaagtagtaatccattgtttatttatccaacttgtttatccattcacctgttgatggcatttgggttgtttccaatttttccagctattgtgaataaagctgctatgaacattcacatggttttttgttgactgtatgttttcatttctcttgggtaacaaacacctaagagtagtattgctaaattgaataagtatatatctaaccttgtaagaaactgacaaactttccaaagtggctgtaccatgtcacactcctacaagcaacaggcctgaactactgctctacattctcaccaattcttggaactgtccatctttttaaactttagccattctaatgggaataaaatgctgtctcactgtggttttaatttgtatttctgtccaggtatggtggctcgtgcctgtaatcccaacactttgggatactaagacagaaggattgcttgggcctaggaattcaagaccaccctgggaaatacagagagaccctgtctctagaaaaaaaaaaatttttccagcctggctgacatggtgaaaccccatctctaccaaaaaatacccaaaaaatagccaggcgtagtggcgcacacctatggtcccagctactctggaggctgaagtgggagaactgcttgaacacacgaggcaaaggttgcagtgagccgggatcgtgtgcactccagcctgagtgatggagaccctgtttcaaaaaataaaaaaataagccgggcgtggtggctcatgcctgtaatcccagcactttgggaggccgaggcgggcggatcacctgaggttgggagtttgagaccagcctgaccaacatggagaaaccctgtctctactaaaaatacaaaaaaattagccgggcatggtggcgcatgcctgtaatcccagctactcgggaggctgaggcaggagaatcactagaatctaggcggcagaggttgcagtaagccgggatcacaccattgtactccagcctgggcaacaagagcagaactctgtctcaaaaaaataaataaataaataaataaataaaaaataaaaaaaaataaaaaaattttatgttagccaggcatggtagcacccacctgtagtcccagctacttgggaggctaaggtgagaggatcacttgagccacagaggtcaaggttgcagttaactatgatcacgccaaagcactctagcctgggtgacaaagtgagaccctgtctccaaaaaaaaaaaaaaatattatatttcccttgcaattatgttgagtatctttttacatgttttggacattcataaatattttttctttttcttttgagacggagtttcgctctcgttaccagactggagtgcaatggcgcgatctcggctcactgcaacctacgcatcctgggttcaagggattctcctgcctcagcctcccaagtagctaggattactggcataagccaccacacccaaatgattctgtatttttagtagagacgaggtttctccatgttggtcaggctggtctcaaactctcgacctcaggtgatctgcctgcctcggcctcccaaagtgctgggattacaggcatgagctgcagcgcctggcccataaatattttcttctaagaaatgtccattcaagtcttctacttattttttaattgggccatttgtcatattattaaatttttaaagttttttaaaacatattctggatatatatagcatgtgtaaatatttcctcccaagtctgtggcttacctttttagtttcttatggtgtcttctaaagaacagaaggctttaattttaataaagtgcaatttatcaatttttacttttatggtgagtgctccttacacgtgctagaaaaaaaaaaatctgcctatgtcaaggtctcaaagatttagtcccatgatttctcctataagttttatgcttttagtttgtatgtttaggtctacaaaccatttcaaattaatttttatgtatcatatgagactgggattgaggttcatttctttacatacaaatatccacttgttccagcaatagctgttaaaaagactatactttccccttctgaattatgtttgcgctattgctgaaaatcaattgactatatatgtatgtatctatttctggactctttatggtgttccaatgactggtaaatactgcattgtcttgattactcttgctttataacaagttttgaaatcaagtaattttgtttgttcttcctcttgtaaattgttttggctattataggtcccttgtatttccatgtgaattttagattcagaaagtcaatttctccccaaaaagtcctgctgagattttggggaagacacaatctttagattatttggggaagactggacagcttaacaatattgggtctttcaaatcatgcagatggtatatctccacttatttaggtcttctttaacttctcttggcaatgttttataattttcagtgtaaaaggtcctatattttcttttcttttttttttttttctcttttgagacagggttctgtcacccaggctggagtacaatggcataatctcagctcactgcaacctctgtctcctcagttcaagtgattctcctgcctcagcctcccgagtagctggaattacagatggccaccaccatgcccagctaattgttgtatttttagtagagatggggtttcgccacgtgggccaggctggtcttgaactcctaacctcaagtgatctgcccgcctcggcctcccaaagtgctgggattacaggcgtgagccactgcacccggccaatattttcatttaattatttcattaagtttattatttcattatttttatcagatttatccctaagtatacacatttttaaaatttaaattgttcatcaacattttaaaataaagaaaattcacaatttaaaaattccagacttctggcttctttttgaaaagaaatcagaagatcagcaattcaaagtctacactccttcatgccaacaatatactagaactaacaagtggataccttagagcatgtactcttcaatttgccacagttcctaccactctttattaaaacccatgatatacccaataccattcatttaaggcacctgcttggagcctacagagagcaaaaggcttgagggaagaggaaagagcatggtatgattagatatgcattttaaaactctggcttcagtgtggagaattgactgaagggagttagagagaatgacggacggaagaaaaccaattaagcatttatttaattggtttaactggaaatagggtggcttagactagctagagtagttttagtggcagagataagaaggtgacaaatgaggtaatatttatggagtgattatcaacagaaatggataatggaatggacgtgaggaggaaaagggagatgccaaagattccccttcaggtttctgacttatgttaacaaggtagacacaagtgccatttacagaaatggggaacgttggagccagagcaactttagcagtaggaaatgaggattaagagttcactttggaatgtaaatttgagatgtctgtgagccatcccaatggagatagaaagtgactaacattcaaaaaagatggagtagctgagcacagtggctcacgtctgtaatcccagcacttttggaaggctgaagcaggcggatcacttaaacccagcagttcgagcccagcctgggcaacatggtgaaacaaaaaatattctacaaaaaaatacaaaaattatctgggcatggtggtgcacacctgtaaccccagctacttgggaggccaaggtgggaggattgcttgagctccaggggcataggttgcagtgacctgagctggcatcactgcactccagcttggataacagagtgagcctctaccccagaaaagaaaagcaagacgaaagaaagagagagacgagagaaggaaggaaggaaggaaggagggaaggagggaaggagggaaggagggagggagggagggagggagggagggagggagggcgggcagggaggcagacaggcaaaatgatgaagatacacatttgggaatcattgtcatgtaaatgttatttaaagctatgggactggatgaggtctcctacagagagagaaaacaaaaggatttaaggctgagtcttgagaaaatctcacaaacggaggccaaattgaaaaggagctagcaaaagagacaaaaaatggcaggtgtggtagaaagaatggcctagccaggcgcggtggctcacgcctgtaatgccagcactttgggaggccgaggccggtggatcacaaggtcaggagatcgagaccatcctggctaacacggtgaaaccccgtttctactaaaaaatacaaaaaattagccaggcgtggtggcgggcgcctgtagtcccagctactcgggaggctgaggcaggagaatggcatgaacccgggaggcggagcttgcagtgagccgagatctcaccactgcactccagcctgggcgacagagcaagactctgtctcaaaaaaaaaaaagaaaaaaaaagaaagaaagaatggcctagccattaggagaataatgtcctacaaaaaatcaactatgtcaaatgccacttgagaggtaaaataagaattcaattcattcattcattcatttattcaaaaagtacttattaacacctactacatgccaagtactgttggtgttgaggatacagaaattgacaaagtccctgcccttgtacagacgatcatctagtgggaagagacggacaacaaacagatgaatgtcaagtggtaataagtcttctggagaaaagtgaagcaggataaggggagtagggaatgccagggattgaggagtaaggttgttttttgttttttttttttgagacggagtctcgctctgttgcccaggctggagcacactggcacaatctcggctcactgcaagctccacctcctgggttcacgccattctcctgcctcagcctcccgagtagctgggactacaggtgcccgccaccacgcctggctaattttttgtatttttttttttttttttttttagtagagatggggtttcaccgtgttagccagggtggtctcaatctcctgacctcgtgacccactcgcctcggcctcccaaagtgctgggattacaggcatgagccaccaggcctggccacttttttatatatggtaacctctctgataaggagacatctgagcaaacatctgaaaaaagtgaggaagtaaaccatgcgaagggagagagtatttcgggtagagggaacagcaagcacaaagacctggcagatgcaggaaaagcagggaaaccaatggggttgccacagagtaagcaaagggaggagtggcagatcttgaaacagactttagctactattaataactggagaacagataataagaaatcaagggcagaagcagagaatgcacttcaaaagaagatattgcaggccgggcatggtggctcacgcctttaattccagcactttgggaagccaaggcaggcagatcacttgaggtcaggaattcaagaccagcctggctaacacagcgaaaccagtctctactaaaaatacaaaaattagctgggtgtggtggctcacgcctgtaatcccagctatttaggtggctggggtgggagaatctcgaactcaggaggcagaggtttcagtgagccaagactgcgccactgcactccagcctgggtgacacagcaagactccttctcaaaaataaaaataaaaataataataattaaaaatatatatatatatatcaataatccaggcaagaaataataatgatggtgtgatggtcagttttatgtgtcagcttgactaagctacagtccccaattattcaaccaaacattaatctgaagtgttgctgtgaaagtattttgtagatgtaactaacattcataatcacttggctttaaataaaggaggctgtcctagataatctggatgggcctgattcaatccactgaaaggctttaagggctgagtgtggtggctcacaggaagtgaaaactaaagtagagaaaatctgtgttgttgtatagagtacatatacttttataaacagaatgttggtaaaaatatgaatgttaaaggtactcttgacaagcactcagaaggaaatgaggaacacgttattggaaactaacagaaagacgatcctcgttttacagtagcagaaaggttagctaaattgtgtccaacagttgtatggaaagcagaatttttaagcaaggaatttggaaatttagattcccaagcaacatactgaaggtacagcctggtttcttcttgttatttgcagtaaaacataagaggaaaaattaataggagaaatgttaaacaaaaagaaattggccgggtgcggtggctcacacctgtaaccccagcactttgggaggccgagacgggcggatcacgaggtcaggagatcgagaccatcctggctaacacagtgaaaccccgtctctactaaaagtacaaaaaaattagctgggcgtggtggcaggagcctgtagtcccagctattcaggaggctgaggcagaagaatggtgcaaacctgggaggtggagcttgcagtgagccgagatcacaccactgcactccagcctgggcaacagagcgaaactccgtctcaaaaaaaaaaaaaaaaaaaagaaatcagtacttgatgatttgggaaattctcagcttacctggatcacaaaagatttatttatttttggagacagagtctcactgtctcccaggctggagtgcagtggcgtgatcttggctcaatgcagcctccgtctcccaggttcaagcaattctcccacctcagcctcctgagtagctgggactacagacgcataccaccacacccagctaattttttttttttttttttgagacagagttttgctcttgttgtccatgctggagtgcaatggtgcgatctcagctcaccacaacctccacctcctaggttcaagtgattctcctactcagcctcccgagtagctgggattacaggcatgcattaccacgcctggctaattttgtatttttagtagagatggggtttctctatgttggtcaggctggtctcgaactcccgacctcaggtgatacacccgtctcaacctcccaaagtgctgggattacaggcgtgagccacaacatgcagtcttttttttttttttttttttttgtatttttagtagagacagggtttcaccatattggccagggtggttttgaactcctgacctcaggtgatccacctggcttggcttcccaaagtgctgggattacaggtatgagccactgcacccagccaacaaaatatgttaaaattaggaaattcactgttaagaaaagcatgctgtggagagaaagtcaagcatgttgcaggacaacctcttagtcatgctgaagggatcaggagtgtgactcatgaattccttcagccaaccataagcagaaggtaggaatggagatgggattatccagaaaagctctatagagaaccctcttgtctaatgacaagaacccccaaaatatacataggagacccacaaggtttctaacaatgttatatcagcagaaacactgtcaacttggactgaaaggacaaataaagaatgaaataaaggaaggctgttggctggatgtggtagctcacgtctgtaatcccagcactttgagaggccaaagcaggaggatagcttgagcccaggagttcaagaccagcctgggcaacaaaatgagaccatccctacaaaaaatacaaaaaatgagccaagtctggtggtgcatgcctgtagccccagctactcaggaggctgaggcaggagaattgcttgagccccaggagatggaggctgcattgagccatgattgtgtcactgcactccagcctgggtgacagagcgagactctgtctttaaaaaaaaaaaaaaaagaagaagaagactgaaagatgttggactaccaaaattctacatgcagcaatcaggctaataaaaatactctttactctttcagccgtaaaaagaaagaaaattctgatacatgctacaacatggatgactcttgaggacattatactaagtgacataagctagtcacaaaagacaaatattgtatggttccacttgtatgaagtacttaagagtaatcaaaaccatagagacagaaaagggaatggtggttcacaggggctggggagaggagaacagggagtcattgtttaatgggtatagagcttcagttttgcaagataaaaagagttctggagatgaacggcggtgatggtttcacaatatgaatgtacttaacaccactggacagtacacttaaaaatggttacgatggtaaattttaacacaatttttaaacaccgtgggcaaaaactctactcagttgcaaatatatgcttctcttcaagaaaaaggaaggataactatgaaagcagaagctagagccagagactcagagggcagagtctcgagtaaaagaaaattactcacaggctttgaaacataataaaaattttccctgctggattttgaaattacttagtaccagtaacccatttattccttgcattttctcccttctgaaaccggaattatctataactgttacactatacatgtctgaccagtgtattttgggaacagataacagatgatttagataatgagactttaaacttcagagttggtgacagaagagatctcgggcttgagttgatgttgcaatgggttgagacttttggggatgttggaatgagatgggtgtattttgcctgtggaacagacgagcagagaagagactatgataggctgaaaaatggcccaaaagatatccatagcctaataccgggaatctgtgaatgttaccttttacagcaaaaagggctaggagtctttgcaggcatgattaaattaagaattttggggccgggcgcggtggctcacgcctgtaatcccagcactttgggaggctgaggcaggtagatcacgaggtcaggagttcaagaccagcccggccaagatggtgaaaccccgcctctactaaaaagtataaaaattagccaggtatgatggtggcctcctgtaatcccagctactcgggaggctgaggcaggagaatcacttaaacctgggaggcagaggttgcagtgagccgagatggtgccactacactccagcctgggtgacagagcgagactcccatctcaaaaaaaaaaagaattatccaggtgggctctaagtccaatcatatgtccttacaagagaagagggaggcagagatatgacaaaaacagtgcaggagaaagagatgtgcagagagatttaaagatgctgaccttgaagattgaagtgacgctgccacaagccaaggaaagccagtagccaccagaaggtggaagaggtaaagaccagactctcccctaaagcctctggaaggaatacagcccttctgacatcctgaatttggctcagtaagactgattcaaatgtatgacctccagaactataagagaatgaatatctgttgttgtaaggcaccaagtatgtagtaatttcttacagcagtcacaggaaactaaactaatagagatggcttggaagagggtgattatggtggagatgattaagaagtgatcagattatggatatatcttgaagacagagctaacagtatttgctgatgaactggattctataaagtgagaaagagaagatgactccaagattctttcctgagtaactagaagagttatcattttactaaactaagggaaactcaacatgttcagcaacatgtaagccagctgtgatcacaatgaaaactgttttggtagaattggggactggataccagattagagagagttagaaagtccagagtactatgttcttataatttactttgaataccattctgttctctttcattgttattcctctattcattgccctcccctttacccagctccaatctttaatagaccaaagttatgtaacacggtgattgattctcaaagcaggccaaaatgttcaggatactgtcttttttttttattattattatacttaagttttagggtacatgtgcacattgtgcaggttagttacatatgtatacatgtgccatgctggtgcactgcacccactaactcgtcatctagcattaggtatatctcccaatgctatccctcccccctcccccaaccccgatactgtcctttaagccaagggaggacagaatcaggaaaggggtgttcattcatttgacaaatatttattgagcatctactatacttcacgcctggcactattctggatgctgagaatagggcagagaaaagacagatatgctccctggcatcacaaagcttataagaaaaacattttaaaattacatatttaattgtaactgtggttagtgctacaaaggataatttttgagtactatgaaaattaacatgtattaaatacctattttgggttaaatgctttacattcaggtaactgaatttacctctcacaactatcttataagtacatacagcttcaaaaagattcaccaagcatggtggttcacgtctgtaatcccaccacttttgagaggatgaggcgagaggatctcttgaaccacaatgggcaacacaaagagactccatctctacaaaaaaccttaaaattattagctaggtgtggtggcacatgcctccggtaccagctactcaggaggctgaagcaggaagatcacctgagcccaggacataaaggctgtagtgagccatgttcaaaccactgaactccagcctgagaaatggaggaagatcctgtgtcaaaataaaattatttcaatttaaaaatttaaaaagattgtccaggcacagtggctaacacctgtaatcccagcactttgggaggccgaggtgggtagattacttgaggtcaggaattcaagataagcctggccaacacagtgaaactccgtctctactaaaaatttttaaaaattagccgtgcatggtggggcacgcctgtaatcccggcttctcaggaggctgaggcaggagaatcacctgaacccaggaggcagaggttgcagggagccgagatcgcgccactgcactccagcctgggcaacagagcgagactccaactcaaaaaaaaaaaaaaaaaaagattaaaaaagattaattcccttgttgtctaagatcactgagctagtgagcaatagagccaggattaaaaacaggtgcattcaaccccatcactactatctctaaacagtagggaaaccaaataagtacccagaagaggcagggtggatcatgaaggtaaagttttgagaatccctgctctagaaagcgttttctaagctttctaagctcacctcatgaaagtgaattttggaaggcattcaaaaaatcccttgacactctccaaatagaataaaaggttacactataattaactcagcgttatttgggaagccaacaggctattagacatgttgaaaataaaatgtcatgattagcttgtccaaattgtataagtcatgcctggtttccatatatattgatcctgccagatacactttaagaatcagctttcaggtaaaggtcaaaacattaactttttaaaaagggtcattcatgctacagagtgtctgatctaggaaaatgattaatccactgactcagggtatataaagactcatgacagatatcacacaaatgaaccataacatcctatgaacttctactgggtaaaagaaatctttaaatttatctcaaatgactagcatatgatacattatgttcttggttccctgttcccattccaggactcctaaccccccaaaaaaacatctgaacggaaaggaagtatcaacaagataatgttaaatagttcaatgaatctataaaatagaataaaaggctcagtggctcatgcctgtaatcccaacattttaagaggccaagatgggaggatcacttgagcccaggagatcaagatcagcctaggcaacagagtgagacacctgtccctaaaaaaaaaataaaaataggaggggtgtgttggctcaaacctgtaatcccaacactttgggaagccaaggcaggtagactgcttgaggccagaagttcacaaccagcccaggcaacatagcaaggccctctctctaaataaataaataaataaataaataaataaataaataaataaataaggcctggcagggtggctcacgcctgtaatccataactttgggaggctgaggcaggcagatcacttgaggtcaggagtttgagaccagcctggccaatatggtgaaaccctatctctactaaaaacacaaaaattagtcgggcatggtggcaggcgcttgtaattcccagctacttgggagtctgaggcacaagaatcgcttgaaccccggaggcagagattgcagtgagccaagattgtgccactacactccagcctgggcaacagagcaagaagactccgtctcataaatgaaaataaataaataacacagaataagtaaataaaatagaataaaaacccacaacctctttcccttcaatgccacaaccttagagcatgaacctggagtgcaaatttaaagagtgaaaggctcttgcatagaagctttagttcaagtgatttcttctcataaagatgatcacataaacaatggacaaaaaagaaaataacccttacttttttttttgaaagtgtctcactctgtcccccagggtggagtgcagtggcatgatctcaactcactgcaacctccacctccccggttcaagcaattctcttgcctcagcctcccaagtagctggaattacagacccccaccaccacacccggctgatttttttgtatttttagtagagatggggtttcgccatcttggcagactggtctcgaactgctgacctcaggtgatccacccaccttggcctcccaaagtgctgggattacaggcatgggctaccatgcctgtcctaagatttactcgttttttttgagatgaggtctggctctgtcacccaggctggagtgcagtggcgcaactacagctcactgcaaccttcacctcccaagctcaagcaattctctcccacgcctcaagtttccagagtagctgggattatcggtgcacagcgccgcgcccggttattttttgtattttttgtagagacggggttttgccatgttatctaggctggtcttgaacctctaagctcaagcaatcctcccaaagtactggaattacaggcgtgagccaccacgcccagccaacccttacttttaatttctaaatttctcttgctctacattttaaaggaaagacaatatatacacatatatatggcaaactcaaaaagactactttaaatatatccatcatataactaaatacgaaacacaaagccagggccaggcatagtggctcatgcctgtagtcccaacactttgagagttcaaggcgggagaactgcttgaggccaggggttcaaggttacagtgagctacgatcgtgccactgcgatccagcctgtgtatcagaatgagaccctgtctcaaacacacacacacacacacacacacacacacacactaactaaagccaaagtttcaaccatgataacaccactctaacaccaaaattcaacacagtgcattctaaaatattaggaaaggacaactttccaagttcctgtaaattttgtggtagagaaaatatgtacaaattaaccacaatcaagagaccctggatcacttaccccatttacaatttaaaagatactgaaacactgacaaaaaaaaaaattctaaaaatgtggatattacagtatgcctttatttggtaatttttttgtttctgagacagtctcactctgttgcccaggctggagtgcagtggcacaaacacagctcactgcagcctcgatctcccgggctcatgcactacaagtgcatgtcaccatgctgagctactttttttacttcttgtagacacacggtcttgtcatgttgcccaggctggtcttgaactcctgggctcaagtgatcctcccaccttgtcctcccaaagtgctgggattacaggtgtaagccataatgcctggcccttatttggcaagtattaattgagcaacttaagatgtgaggttactattatagttttccacctcaggaatggcaaccagatacatataatgaataccgcacagaatattttctgagctataacatcttgattactactacaaagagttctcactataactgacattttcgctaactatgcaaaagacactgaacacgaaaagacatttactagaggcaaagttaggaacttcatatacatcatggtaggaagccagaattatttaattcaaaaacagatctggattcaaatcctggccaggcacagcggctcatgcctgtcatctcaacagtttaggaggtcaaagcgtgagggcaagagttcaagatcagcctggggaacactgtgacaccccgcctgcacaaaaaaatttagccgggcatgatggcacacgcctatagtcctagttatgcaggagaactgcttcagcagtttgaggttacaggagtttgaggacacagtgagctatgaccctgccactacactcatgtctggaagacaaagcaagactctgtctaaaaaaaacaaaaaagcaaaacaacaacaaaaatcctgttatctagaagttcctctagaagcttctctttgctcatctgcaaaatgctgctactaccacttatttcagagttcatatgaggattaataaggtagcacaatgtctactataaagtagatgcccctattacttccctctttacatttcttcataatccttataacgacctcatgttgtaaggattattaactctagtttacagatgaagaagctgaatcacaggaaggttaaggagtaagcctacagtcacatacctggtaactgtcagtacccagatctgctgtgccctaaaacttgacatggacatgttacctcactggatattttactctgtcatattatgaagttcagaactttgtttgaattatgcccattatgctttaaattttaatacaagaacaattattttcaaaaaccagaatcacccataatttccactcataattttagaggacaaagacctgtaaatagcctacctatctagaaattcagtaacagaggacacactccagatctcaaaatgaactagccaaattactcattacaagctctcatttacacagagaatgatttctaaatgcatatcaataagaatgagtggggagcaaatgaaccaaacataccacagaagtaaaaatgtggaagtaaaaaaaaaaaaagacattttcacaacgctctttcttccaaggattctacagatcttctattactgctatatgagccggccttaaatactgtgtgaggaactggcctgggctcagcccctggactgttgtggaactcaaatcatttaatttcacagtgcctcctcccactaaacaatgagagaactggacttgagtcatgaaccacagaactgaaggcaacttgagcaattagttccacccaatgcaccctgacaggtcacccaatttctgctttaacacctgcagtgacacagagtgtaattatcttctctcctcatacatgtgatatggattcagtatttttaagaattttggccaggcacggtggctcacacctgtaatcccaacacttcgggaggccaaggcaggaggattgctgtggccaggaatttgagactagtctaggcaatatagcaagactctcttctcttctctacaaaaaaaattttttaaattagccaagcagaggctgggcgcggtggctcacatgtgtaatcccagcactttgggaggccgaggcgggcggatcacttgaagtcaggagtttgagaccagcctgtccaatatggtgaaaccccgtctctaccaaaaatacaaaaaaattagccgggcatggtggcacatgcctgtagtcccagctacctgggaggctgaggcaggagaatggcttgaacccgggagacggaggttgcagtgagccaagatcgaaccactgcactccagcctggtcaacagagcaagactccgtctcaaaacataattaaaaaaaaaaaaattacccaagcaggccaggcacagtggctcacgctgtaatcccaatactttgggaggccgaggcggatggatcgcctgaggtcaggagttcgagatcagcctggccaacatagtgaaactccgtccctactaaaaaaaatatatacatatacaaaaaattagctgggcgtggtggtgggtgcctataatcccagctactcgggaggctaaggcaggagaattgcttgaacccaggatgcggagcttgcagtgagccgagatcccgccactgcactccagcctgggtgacagagcaagattccatctcaaaaaaaaaaaaaaaaaaaaaaaaattagccaagcatggtggtacatgctgttgtcctagctactcaggaggcagaggcagaaggatcacttaagacaaggagttttgaggttgcagtgagctatgatcccaccatatgcttcacaagagcttagaggtggaactagggcccacactaatacctagaatgagaacctgtgtggctgagtttgagggacaaggttaatctggagggcatttaaaaggtacaggactggccaagcacggtggctcatgcttatcatcctagcgctttgggaggccaaggcaggcggatcacctgaggtcaggagtttgagaccagcctggccaacatatagtgaaaccctgcctctactaaaaaatacaaaaattagctgggcatggtggcacatacctgtaatcccagctacttgggaagctgaggcaggagaatcgcttgaacctgggaggcggcagttgcagtgagccatgatcacaccactgtgctctaccctaggcaagagaacgagactctgtctctcaaaaaataaaaataaaaaaataaaaggtacaggcctgggtgtggtagctggatgacagagtgagactctgtctctttaaaaacaaaacaaaagaaacaaacaaaaaaacacctgggcagtttttaagtcaacagaatcgtttttctgttgtacaaaatcagagatttcagacttcaacttggagaaagctgaatccatttctatttcctttcctttcgacgtaacaaatctacttcctaaagtagtaaaatggaagtcatcttcattaggaagatcactactgcctctaaagagtttatctaaactgatgcagtttcacaaaatccgtcctttgaattcctaaacttctatactccagatttagaagtttcttataattaactttctaatttatttatttacttgagacagtgtctcatctgttaaccaggctggagcacagtggtgtgatcacagctcattgcagcctcaaactcctgggctcaagcaatcctcctgtctcagcctctcacatggctgggattataggcatgagccacagtaccaggcctatacctttgaaattccctccaggttaaccttgtccctcaaactcagccacacaggttctcattctaggtatttttattatgggccctagctcttgtgaagcacatgctcttttaagtactgcttccagctaaacccattctacagacagagagcccagtaaattcaaagatacaagatggtaagagacacccttaatggcaacttgtgcacctccttgggtcttattttaactgtggaattcacctaaataaagccactggttcactctactttgtaaaataaaaattatctagatgtaggtacttgacatagaaaaattgatggtgaagcagcaatggttaacatttaaatgcctccttctgcatactcatatcagtctatattcattcatctctctgactccaaactaattcacccagtcagttctacgctactgcccaaaaccaatgatgatcataataaccatgataatgacatgcatgtaaagctgttccaaggactttatatatttttatttaatcctcacagcaacaatatgaagcaggccccatttttatccccattttacagctagtgagtcacagagaatataaagtagcaagagtatcatagtcacacagtccaagttcatacacacggccggcaagtagagccaggattccgatctatgcagtatgactctagtatttatgttaactacttatgctgtgtaactgctcatctatcactaagttactgttttcatcaatataaaaaaaaatgactccaccttcaccatacacatagatttcaaatatttttccttatgtcaacactggcctaaattacttaaaacatttcatgtgaacctaatttagtgtctacctccacatattagcctccatgtgaaaggtacatagtaaacacacaataaatatttataaatatctgataaaggaattaaatttttcccattccttcattcctccaaaggtaatctttcctactctgagtcctcccctctcccctacttcagaacttcagtaccttcttttcaacattttctactttacccactgtcgtggccagcctccaagatggcccccaatgaccctcacctcctgccatttacattcttgtgtagtcccttcccacaatgtgtggccaacagaatactggaaaaatgatggtatgtgacttctgaagctaggtcataaaagtcaatgcagcagcttggtcttttgtattacatgctctgaggcaagctggctgccatgccatgaaggcattcatgcggagaggcccacatgaagaggaattgagatctcccaccaacagcctgcaccaacctgccagcaatatgagtagccaccttgaaaaaggattcaccagcctcagtcaagccttcagatgactgctacctcagctgacatattactgcaattttttttttttgagacagttttgctctgtcacccaggctggagtgcagtggcacgatctcagctcactgcaacctccacctccctggttcaagcaattcttatgcctcagcctcctgagtagctgggattacaggcatgggctgccactcccagataattttttttttttagatactctgccgcccaggctggagtgcagtggtgcaatcttggctcactgcaacctccgcctcccaggttcaagtgattctcatgccttagcctcctgagtagctgggactacaggcgtgcatcaccaaacctacctaatttttgtatttttagtagcgacggggtttccccatgttggccaggctggtctcgatctcctgacctcaagggatccacctgcctcagcctcccaaaatgctgagaatacatgtgtgagccaccgtgcccagccattattgcaattttttgagagacctgagtttgaatcactcagccaagctgattccaaattcctgactcacagaaactgtgaaaaataagaaatgttgtcttaaacactaactttcgaggtaatctgttacacaggaagacagttaacacacccgctctccaaaactctaatttccttgagagcggagactatttccttgattctcaaaactctattaaagccttagacataaacagcgcccatatttgctgaattgtgtcagtgggtcattctctttgttcaatgtcccccttcttccaaaatgtattcatttataaaaaactactccccaagcctataccacttcatccataacccatcaatgttttctcttttctctttcaaaaacctgaaatataacctcctgaccaaagctttttctcagtaaagaaatgtttcttatgtttgtcaattgcaactatcaaccctagcatttatgtgaatatatatacacacacaagaacacggagtaaatatatatttgttcatgttcatcttatattcaagaaatatttactgagcacctgctatgtcccaagaactgcctttgaagctgggaagaaaaacaaatatcctcacccctggggagcttacagtagtatatgagcttgccacagtgttttctcgaaatataatacaacgatctttgttaatacaacttaaaaattctaaatttccctttgtaaattaaatggctgtaaatctacaaatcgttttttaaatacacttaaataagtatttaagctgcactctcaaagaaagtttatacctgtttaacaaagttagtaaagtgcttcatatggaatctgtatatatcaatgtactccatttttactgaatgttcccacaggccatactttttaggaaatatcaccaaatttataagtataaaatatataaataaagatagcctttatttattatattgccatatataaagcttataaagataagctttatttattatatcgccttagtgactaaatcaaatatgaaacatttcacagaaagtaacttgcaatagatgtagtaaaatgataataatgataatatgggtagaactttctaacctctttcatatttacctctacaaaagcatgttaaaaggaaccgtataccatacttttaagtcagagattcaagtcctggttctgttaacttctgtatccctaaatgagttatttaactagttgcagcctatttccctatcctaaagcaacacaatcaaagcctagcttttatgtagtgggcatcaaggaatgttagtttccttctcccttcctggggcttataactggtatatcagaagatttatcaggatttttttttttttttgagacagggtctcaccgcacattcaggatggagggcagtgtgaacatagcttactgccacctcaaactcctgggctcaagggatcctccagcctcagcctcctgagtagctgggactacaggtgcaagccaccacgtctgctaattctttaacttttttgtggagacaagctatcattatgttgcccaagcgggtctcaactcgaactcctggcctcaagtgatcctcctgccttggcctcccgaagtgctaggattacaggcgtaagccactgtgccccgcctatcaggaaaactttccaagctgttatttctctttggaatttcctctccttcatctgagttaacattcagctcaaatgccattttctttgaagccttcccatacatccacaggaaaagctcccttgactctcccagtgaagtctggatttagagtgtatttcagcgcgttacaatcatctgtcattttttgcctctcccactagactgtgagctcctcatgagcagggaccatatctcacttatcttgacagccccagcccttagaaaaacacctggcacgttacaaacatggaacaaaaagtctgttgaatgaataaatgaagtcatcccttaagtagtacttgtaattactaacgggtgacccaaactttatggttttgccctttataggctgagattctatttcatactctttttaatcactccctaatagcatctggcagagtactaaggacatggaaactctccaataaatacttttgggtgatgggatacatattactcttccacctctcttgatttgactctaaataacttattcaagtggatgtgacttttggaagccttcttaaaaacgggctcttcttaatagttattggccaaaaactgaaacaaacactagagctaaactacagatatttttttctttgcaggtgtttttaaagaacgcagtaatggattgcttctttctaaatcatttcaataagaaacagtaacataaagccctttggttcgctatgaaaaatgcaaacgacattaagcaaaacttagtttaataacttccagccaaaggttccccaccctgcagtcatagggctgtgggccagctggctgtaccacctcacccccgggagatgactgcttttcaacagtaaaactgcgtaagtgacatttggagttttgggggtcttctgaagtaaaacatgtaggtctaacttcttactgacaataagtcttaacgttacaggcttcggcttgatgtagaaaggaccctgaaaagatctcaaaaacttgcaactcggggacattccagacgtcttatgagtttaaaactatgtaaaaacatacgaagcatggggtaattccattattatatttaagtgatgtattccacattcctgtatatacacacacttcatgccaaacagaggctggcaagcaagttaaccattcaactgccctttcgttatgctgcataacagggagacaacagagagaaatcttgacaatgccaagctgggctagtgcttaaaggcacacaggcaaaccaggcattctcaacatcccaaaagcaaacatttcttgggcccttactatgggccaagcactgtgtcaaacgcttcacgtgaattatttcattcgacacttacaacaaacaaccgtatgcgattggtgctattatcctcatttttcagacgaggaaaccaaggcacaagattacacagctagcaagtggcaggtttgggagtcgactcaaaaggtccagccctaggcactatggagtatcaaaggtacccgaagcggggagggtggactgcatcagcgtcctgacagacgctttcttaggaggtaaagttcttggccatcaagtttcagatttgcagagccctgtacacctggcagcattcaggtttgctatactggcaccaacaagtccagctgagcctccttgcctgggaatcccaaggactgcacttggatcctgaaggtctgcacaagaccccagagaaagcggccgacaccccgtccctgcaatcaaaacacatcccgggagaagcgagggcgaggacctccgtgcctccccgccccgcgcagcacagccctgccaggcagtgcacaggtgcacgaccgcgcccgcccgcccggcccggcccgggtcccagccccggcacagtgaccgccgctctgcgactccggccccgagggcaggggcagaaggccggcaagaagagggcaggggacgcgagggccgcctcgcccgaccccccgaggacgcgcgcagcagggtcgggggggaaaaaggatgctccaggcggggcgaggccgcggtgggggaggggtccccaacccggactctcactcaccgcctcgcgcggctcccggccgggttccgcggctcgccccactccggctctagccgcccgcgtctcctctcgaggctcactgtccagcccgggcgcacggagctgagaagtcgccgccagcggagggcgtgtggccagcggcaaccaagagggtgggaaagatgggaccgtcgctctcgccgccgcggccaccacagacactgccgccg

SEQ ID NO: 441 - DNA, 1786 bp, Homo sapiens
  source 1..1786: mol_type = genomic DNA
gtcttttttcagattcattttggcttaatggtgccttccccattttaaaagcggtcttttactcatagtgccccagccttttgaaggcacaggaacaggagctgggctaccaccttcaagggctgtcaaagatggtgaggtctgaagccaaaggcaagcacaccaaactccatgggggctgaatgctgtggtctgtagtgtctgtgcttctgcagagttagcctggtcccagaaagagggcatgtgcatgctggagtgaagagctgaatttgatttccaagcccctggctgggggtccagagggagggcaggggccacctcctgccggctccctgctattgttgctcagggccggccgtcttggtggtcaccagttcagtggagcccagctctgtggctggcacagggacactgtggccaggtggggtggttcctgggtcttccccaggaggaggccaggcaggagctgtggcatcagagattcccggagacagaatgatgaccttgtccaggggctctggggctgcaggcagagggggtagaggctccgtactcagtcacagccttccctccctcccctagaagactcctctggaggggcagtcctccgtcaaatgaagcccaatgcagggtggggaggggtggcacctggctgaccctgagtccagaggcctggccagtggggagctggcagggcagggagttggggagctggggctcagtctggcaaactcttcagggatttatgggggaaccaagctccgttagactcccaaagggcaggacagactcctccctcagacggggcccccttcctgcaacctgtctcttcctcacactggggtctgtcagggcagagctgttcctggctccgaccagggtctcaggggcaggactatgtctccctccccagcctgagctcctcagcgcaaactcttttccactctgtctccgtttccccttaaagcccttctctccccctcaggggccatgcatctccccctagaccgtcccgacaccccagcccctgcgccccgctcagactggttcccctacacacggaactcaccgtccttgtctccgtcgggggcctctgcggaggacgcgccgcgaagccgccgctgtcgccgcctccagctcaccagacccaccaggaccagcgccaggaccagtgccaggcccagcagcgcgggggcgccaaagagcagcccgggcaggggcagcgccgcctcgccggcccccgcgcccaccgactcctgcggctgcagcgccgtcctgggcgcagggctgctggccccggctgcttcgggaggggacagggagggaggccagggggccgaggggagggaggagcggggacggggaggggcggaggggggcgaggctggccggggaggggagggacagccggggggcggtggacaaggggagggagagaggcggcggtgagggccacgcggtgatcgcgggcccctccaggccctgcccacagggtcctttcagccctcggcgcccccgggggtcggggctctgcctgcgccctggcgatcggggccccgttctccccgcagctgccggcgccgcgcgccccgtgggtcccccttacccggtttcggccgcggcgtgcgcaggagcccgcaggccacgcagtggcggaccagcaggtcgaagcactcggccgggacgcagggcgtgggggctggcgcgtccctgccccgcaggctccggggccctcgcctcatggtgccgacgccgccgcacaagctgcggggactgaggctgagct

SEQ ID NO: 442 - DNA, 1483 bp, Homo sapiens
  source 1..1483: mol_type = genomic DNA
tgatttttaaactttttttagccacagaccttttgttcaaaggaaaccttaaatggagatgtaacacgccagctgcttaaagacacaggctctgcaagagtgagtgtgggagtgggagggggctacagtctcgccagctgggccccctcgctgcttctgcccagctctccctgctgcagcactggcactgcagggaaccttcccagccacggcgggctgagcctgggcctgtcaagccctgactggacatcctcaacagagaatgtttatggagtcagcacgaagccatgagaaggggcagcccaggggccagccaccctcacaggtcctccagggaggggccctcagagcttctcagcagggacagcaggttcagagctgagacaccgggcacgtggccagcacagatctgcagcacgcgcaccaggcgctgcgccatggtggccctaaagccttccacctgcggggagagcagagaacagcagtgagatagaatgctggccctgctcccttacccagagcagctgcaggggctgccagagcagggctgggggcggatacttgggggtagctcaggtcaccactgcccaccacagccacgccctcattcatgccacacctcagagtagcttccaactgcctcagcttgcccaatccttcaaacaacctccggagacatccagagcctgacctcctgctcaagaggaaatgaaggcttaacaaggctggctaggtcgaacaaactgtctagggtcacccagctagtgactccagagctgagctctgaatcagggctacttccaaccaatgcccaggcagctcgggccccagatgctcaagaccagggagcagaagatacagggataggaaggagggaggggcagcgggtggccctcaccacagataagaaggtgccatcaaaaaggaatgggcccaggggagctgtggggccagagagggacaagactgctctaggcccgggcacagatgttctagacacgtccgctggaagaacacgatgctgcccagtgtctgtctcaaaaaagaaagaaaaagaaagaaaaagaaagaaaaagaaagaaaaagaaagaaagaaagaaagaaaaagaaagaaagaaagaaagaaagaaagaaagaaagaaaaagaaagaaagaaagaaagaaagaaagagcctccagacctgtctctctatttctgccctagtttcccttcagtccactctcctcccggcagccagaggggtccatttaaaacccaagtcaggccacatccctccctggccccaagccctccagcagctccccaccaggctccactgatccagccccaccattcctgatttctccaccccaacccgccctttgctattgtgctgcagccacccaggcctgcctgccagaccttgagcacaccaggcaagtcccacactcggcccatgcacttgctgttcctccttccacgaggtatctccgtggcctgcct

SEQ ID NO: 443 - DNA, 8408 bp, Homo sapiens
  source 1..8408: mol_type = genomic DNA
tgatttttaaactttttttagccacagaccttttgttcaaaggaaaccttaaatggagatgtaacacgccagctgcttaaagacacaggctctgcaagagtgagtgtgggagtgggagggggctacagtctcgccagctgggccccctcgctgcttctgcccagctctccctgctgcagcactggcactgcagggaaccttcccagccacggcgggctgagcctgggcctgtcaagccctgactggacatcctcaacagagaatgtttatggagtcagcacgaagccatgagaaggggcagcccaggggccagccaccctcacaggtcctccagggaggggccctcagagcttctcagcagggacagcaggttcagagctgagacaccgggcacgtggccagcacagatctgcagcacgcgcaccaggcgctgcgccatggtggccctaaagccttccacctgcggggagagcagagaacagcagtgagatagaatgctggccctgctcccttacccagagcagctgcaggggctgccagagcagggctgggggcggatacttgggggtagctcaggtcaccactgcccaccacagccacgccctcattcatgccacacctcagagtagcttccaactgcctcagcttgcccaatccttcaaacaacctccggagacatccagagcctgacctcctgctcaagaggaaatgaaggcttaacaaggctggctaggtcgaacaaactgtctagggtcacccagctagtgactccagagctgagctctgaatcagggctacttccaaccaatgcccaggcagctcgggccccagatgctcaagaccagggagcagaagatacagggataggaaggagggaggggcagcgggtggccctcaccacagataagaaggtgccatcaaaaaggaatgggcccaggggagctgtggggccagagagggacaagactgctctaggcccgggcacagatgttctagacacgtccgctggaagaacacgatgctgcccagtgtctgtctcaaaaaagaaagaaaaagaaagaaaaagaaagaaaaagaaagaaaaagaaagaaagaaagaaagaaaaagaaagaaagaaagaaagaaagaaagaaagaaagaaaaagaaagaaagaaagaaagaaagaaagagcctccagacctgtctctctatttctgccctagtttcccttcagtccactctcctcccggcagccagaggggtccatttaaaacccaagtcaggccacatccctccctggccccaagccctccagcagctccccaccaggctccactgatccagccccaccattcctgatttctccaccccaacccgccctttgctattgtgctgcagccacccaggcctgcctgccagaccttgagcacaccaggcaagtcccacactcggcccatgcacttgctgttcctccttccacgaggtatctccgtggcctgcctgcctacttccttcaggtctttatttatttagaagtcctgtttgcaggggcgttccctggttaccctgcctaactcttgcctgtttaccaccacctgacacgccacgcctccactttccagcacgtcatttaccccatttgtttccttgactagaacaaagctggggctttttttgttttgttttgagacagagtctcgctttgtcacccaggctggagtgcagtggcaccatcttggctcactgcaatctctgcctcccaggttcaagcgattcttgtgcttcagccccctgagtagctgggattacaggtgtgtgccaccatgcccagctaatttctgtatttttagtaaagactgggtttcaccatgttggccaggctggtctcaaactcctgacctcaggtgatccttccacctcggcctccctaggattacaggtgtgagctaccgtgcccagcaggaagctggggtttttgactcttttgttctgtgctgtgtccctggagcctagaacagtggtcggtaccacagaaactcaggaagtatttttttaataagtcctctaagtttggtggcctttgttcctgaaatctatctctaggctgctgaggcttgggttccacaacctgcctcctgcagcagcctcgacccagcctcctgcctctggccaggcttcctccaatccacatcactccagagacgtgacccaaatgcccaggtctgaccacaatcatgactttgctcatgacatccaagaagaaatgacctaattctaccaccaggctcccagagctcagcaaatccttctgctgttgcttatgttacatgtctgcttatttcatgagattctgagagggcagggccaatatctgactcatttgtgttcccagggcccagcacagagccctaccagcagacctaggcaattatttcactgggccaatcacataccttcctgtgtttcctcatcaatggaacggggccggtaattcctgccacgcaaaggcctcaagatatatggtggggcttaaactcaattatgcagaagagtgttctgaagaggacaacaccagcatgaagaaggaggccagttcaaaccctgggtgctccatctgagggatgcaggcctatgtcctgagcaggcatttctgcagctcctgctgcggcgggaaccaggctgggacctcctgcttcctgcccaggccaagagagaacccaggacctggcctggcctgccacctcatggccacagacagaattacaccacttgtcacagggtgagtaggcaccactgtcccccaccagcacctgaactatggagcaaagatcgtgactcccctttagagatgcttcgtggcagacaaagtgacctattcaaagtcacacggtcagcaggctaggacagcagaacagctggctctacccctcactcacgagctgtctgaccctgagcaagtcgcctgttctctctgggaggaaagcctggcggggcaggcacttcaggtgtgcccaggcctcagggtcccatctgtgagatcagagtgctgatctggtcaggggctcaaaaagtagtcatcaactaggaaatcaaatgcgtgatagagtcaagtgtgtatcatgatcgatgcatcgagcaaggggcaggcctaatggctgctgccacatgagacagtgatgagacctgcccaatcctaatgtgatatgaaaacatccccatttctactggcgacagccacagactgctatcctctgaattctgcccttagaccagaggagtgccctgacaccaggataagggaccctggtctagacagtggtgatggattggtggtcacagatcatgtgctgactcggttctccctgcatttcatcactttgctttcggtaacaggcacaagacccagaacagagcagaaacacaactcttcgaaatgtatctcaaaaccaataaacaggtttccaaaggaatggagcaggcctggcacatgggtgtggcagtgcgggccctgggacccctcagtagacccatcgcggggagcacatcaactcctgctgaggcctctttagcaaaaagtcatcaggatttatcctgcataaaaagcggctaaaggccaggctccgtggctcgctcctgtaatcccagcactttgggaggctaaagtgggaggatcgcttgaggccaggagttcaaaaccagtgtggggaacacagcaagacctcatcgctatattaaaaagtaaataaacagtggccgggtgcagtggctcatgcctgtaatcccagcactttgggaagccgaggcgggcggatcacgaggtcaggagattgagaccatcctggctaacacggtgaaaccccgtctctactaaaaaatacaaaaaattagctgggcgtggtggtgggtgccggtagtcccagctacttgggaggctgaggcaggagaatggcgtgaactcgggaggcagagcttgcagtgagccgagatcgcgccactgcattccagcctggacaacagagcaagactccatctcaaaaaaaaaaaaaaagtaaataaataaataaatacttagctaggtgcggtggtgcatgcttgtagtcctagttactcagtaggctgaggtgggaggttcacttgagcccaggagctcaagtctgcagtgagccatgagtacaccactgcaatccagcctgggcaacagagcaagaccttatctaaaacaataacgacaacaacaacaacaacaaaaaggctactttcctacccctcgtggttagtttcaccttgtgagaaacaccaacaggatccagttggggcagaattccctacatatgcatccaaccatctacccacctacccaacaaacatccctattgcctgctgggtaccctagcttggggtgggacgagacaagatctgaaatcagagagttaaggggaaatcaggcattctgactcccagaggacacaaggatgcaccagttaaagagacggacatacgcttggcctcacaatcacttacaccccagcaggagagtggactcacaaatacatacacataagacttagttataactgagtatgcagaaactcagcaaaagcaaaagcagggcagcacgtgctagagcctggcatataagatgcactccagatgaaagcacatcatcctcacttcacacctgtgtaccccaaggctcagggtgacctgcccaggtcatagccagtgagtagaaaagccactcaaaccaggatcctgtgtctccctccccttcaggagctgcctcgctcggatactaagtccttcgataagcattcccaatgtgcccactgtgtgctgaccaccctttccccgcacccgagtatagtgttggtctctgtgatcagcatgctcacctccaggtcacagtagagcagggggctttgataggtgtgggccagcttcaccacggtgtgccggtgaatgctgcagtggctctcccgcccagctggaaagaagccatgagtgctatagctgcaatctctaccttcctggctggaattcaggaagtgctgggcagagtcactcacttccccactctggggctcagtttctttctagtcgcgagggtgacagtcctattctactttcttttctaggtagtcaagaatatcaaattagacaatgaagataataatagctcctaccccactgagtcactctagagtcagtgagttgacatctagaaattacttggcctgcatttgctcaccaatgcttcttgagaattatctgtgccaggcactctgctcaaggagctaacagttcagctgggaaggcagacaggtcagacacctcatgcatgccggagtgacactggggctgagttttgaggtatttgtaggggttagcaagacaaagaagaggaaatgtatttgacagaagcctagagtaaacaaaaagaggacggccgggtgcggtggctcaggcctgtaatcccagcactatctgaggcaggcggatacctgaggtcaggagttcaagaccagcctggccaacatggtgaaaccccatctctactaaaatacaaaaattagctgggcatgatggcgggtgcctgtaatcccagctactcgggaggctgagatgggagaattgcttgaaccagggagacggtggttgcggtgagctgagatcacgccatagcactccagcctgggcggctgagcgagactccgtctcaaaaaaaaaaaaaaaaaaaagggacgggccctgtaacaggacttacctaggtgtaaaccttggctctaccacttttcatctaggggcctggggcaacttaacctcatgactgtaaaacagaggtaataacacctacctccaataggaatatgaaaacaaagcaattaccgtgtctgcctcacagtgacagctcaaaagatgtcagccattattattttcactgttaatattacaaagtctcaggaacagcaggactttttcagagaacgataagctgacccagagaaggagagtcaccggagatgagactagctcagaaggcagaggccaaactgcaaagtgttttatgtctttagagtttggattttaccgaaagccacaggcaaccactaggcaactccaagtaatggcagagttatctgctcatattcactcttagaaaggctgacaacaggtcagattccaaagtatgtgtatatgtgttctttcggtttttaaatttaacttttattttaagttcaggggtacatgtgcagatttgttatgtagttaaaacttgtgtcatggggtttgttgtacagatcattgtcacccaggtattaagcctagtacccattagttatttttccagatcttctccttcttcctgccctccaccctccgataggccccagtgtgtgtaaaatacatgctctttccatcacccagggtgcctcagcaagaagcctacggccgccccagctttcccttggctgggggtgggcagtaacaggcgaggaacgtacttaccacctgtggcgaggaaacacaccttccccaagaagaagctggcatccacatggcgcagggactcctctgtgttctggagactggggtggccaggccagggtgagaaaacaaaccagagaacaaaactttacaacggagaaagcagaagtccttgcttctctgatcctagaggccagagaatgacaagagggtgactttctctggagaaatatttgtcctttaattttttttttttttttttttttagatggagtttcactttgttgcccaggctggagtgcagtagcgcgatcttggctcactgcaacctctgcctcctgggttcaaatgattctcctgcctcagcctcccgagtagctgggactacaggtacatgccaccacgcctggctaatttttgtattttagtagagacggggtttcaccatgttgcccaggctggtctcgggcaatctgcccaccttggcctcccaaagtgctgggattacaggtgtgagccattgtgcccggccgttgtgtattttaaacattgtgcactgaccactggctcctctctcctcaccttacagattgacctcagccagcctctcccatcctcaccacttcccatcacaagttaggtcaccgtctcagcacagtcctgagccaggcctgcctgagccctgactgccccttcctctggctctcacctgtatttgctgtgaagattaaccacaaacacgatcaggtcaattcggggccgattcacactggagggcaaagggagggactttgccaagtggctgaaaaacaggaaattgcaggactcaagatatccgtacccccctcatagcgaccgtttaaatgctgcccttcatgtggaaagaggccgtcaagggctccccacctcatcctagccacccgaggctcttgtggccacgactccttgggccagcacagaggcaggacaggtccggtcctattcagattactcctgtctgattccctctgccagaaacgggctctgtttagtcaccacctcggcaaggggaggttgggatataagacggcatgggactagccagctacgctgcatgctgggagaaggaccagcctcagaggagggggcgctgggcttcggagtttagcagctaggaccgaatccctctggagtgagagacacgtgggcccaggccacagccgcggctacttacaccttcagctcggaggcgcagtcctctttgagcatcgagtccgccagctgctgcagaagagcatcctccgtgcccaccagctgcgcagggagagagagcggacagtcgagccctaggcacagcaccccctggggagggcctggcccttcgacccactcccggggggatcgggacaccgccagcaggcggctcggaggacatttcccgagaagtggaccccgcgaagcggcacgggctgggggcctgaggtttggacccgctgcaggcctgtgggcaccgcactctctactacccgaccctcgctcccaccgccggcctctccaggaggccagacccccagacgcgggaaaaccaattccaggcgcgggaactcgccaatcagaagctgggaaagggtccgccgagcacctattggtgggtgcgtccctcaacctcagagagcggctactccaattggttcagagcatggctctccgcctattccccgcccccgccacggtagcgcgcgctggcttggcgcctcagagagctcagttgacctagtggctgaagcaccgcccaggaggaaaaaccggcgggggaagcagggccgcctgcacctaccaagatggtggccgtgttcaggccgggcagcttgtccaggggcctcaacaccgacatcacagccgcaggaccaaccgttgctcctgcggtgcgcgccgatctttcaaaccgccctgagtccagcc

SEQ ID NO: 444 - DNA, 8408 bp, Homo sapiens; identical to SEQ ID NO: 443
  source 1..8408: mol_type = genomic DNA

SEQ ID NO: 445 - DNA, 53023 bp, Homo sapiens
  source 1..53023: mol_type = genomic DNA
tcctccaaacgtacaagcgtgatcgccagaaacggttttgtacgtttacacaaaacattcacacagcctgtggtggaggctcctgtccaggactgaggcgcccgggagccgccggtcaccgttgtgcgcacacggaccctttccacagacgcaggccccggaacccaggctgggtcgggaacggcaagcgccagagggtgtccgtgtgggaacccgtcccattcacgcgcggccctacgtgtccccctggcacagagctctgggcaggtccagccacgaacccacagcggcaatcaacacgcttctgtgaataaataaaagtttatcattccgtacaaacgcactcattttccacaacagtttttacacgagccgcggtggcccggtggtggcacgtggggagcggccccgcggcggcgttctcgcgggcggcgtcacagcggctccaggtcctcgtccccgcatgcgtactcgtacaggtccacggcgcccagcggtgagggcgcctcgaagaagggcctctgggccagcggggagcgcagcgcactcagcttctgctccacagggctgagctcggcctcgaacctgcaacgaggggatggcgaagacgtggccagcagcgcggagcaggccctgggccgttttccgggaaacacaggctgctcggccgccaacctccagcacgagacagtcccctgagccgaccttgagctccagccgctgagccagcaacgcgctcctggctgaggacgccggctccacgaatgctcccgggggaggggcctgcggtgcaggtgaaaacccacccaggacgggacggagccccgggcgtgagctacacacagaggacctgggcgggcgcgcctcttccccaaagcgagctgcacgggacctgtgtttacaactgggtcgtggtgtccacacaggactggagaacaaacaggaccacagtttagacacattctcccaaagcacagaagctcccagtggaggctaccacttccgttctgaccagaacacgcagcagtgcgaggactggacgcgcgccttcccttaaggtctcggcagtgacgtcgggcgctgctccggggaacccagcgcggccacggaccacacagactctcagagatcctgtggggacacctctgctttccaagacgcccccgacagcctggcactgagctccccgcggtcacccccacggacctgagctcccactgccggagcaggcgtggacacggtgaaggcagtcgaccccagcgtgctgctggctgtgccgcagacacaaagccgggcagccgtgggggtggacactggtcaggtggggagcagaggtgacagacggtggtggggacaggcgcacacccatccaggctaggtctgggggccacagctgccttagggtgtccgacaggagaaggcagagactgggaagttgtggggacccagaggttggctgccaggtcagagccaccgtgcaaacaatgaccacgaggaggacggacacacaggacagacggcccagggtgggccgcaggggccctgtgctgcttggcaggaatcggacggggcggctgatgggggagcaggggttaaaatgcacgtccatggaacccatgggtcgggaacccaacggtaaccagaaagtattttgagctgcaccaaaatcagaaggccgcgggctgcggtgtccatggcccacgtcgctgcctgaagatactcaaggaaaacagcagaacaaaggggagaaacacccgtggttccctgggaagaggagtgaacctcgtcggcccctcgcctcactgatcacacacaaagtcagtatcaggagcgtgagagacgctatcactggattctgcagacatcagagtcacgagcaggaaataccaacaataacccactgatgggaacgggcaagtttccgaaacacacaaaccagcaaagctcactcaaggctgggcaggggctcacacctgtaattccggcacgttgggggaccgaggcggggagaaccctcgagctcaggcatccaagaccaacctgggcaacacggtgaaaccccatctctacaaaaaaatacaaaaaagtagccgggtgtggtggtgcgtgcctggaagcccagctactcggggggctcaggtgcgaggattccttaagcccagcaggtggagggtgcagtgagctgagattgcgccaatgccctccagcctgcgtgacacagccagaccctgtctccaaaaaaataataaaatactacagataatctctgcaaagagaatccagtaatatgtgaggataacacatgactcggcaagatctatcctgggaacacgaggctggctgaaaatgactcggtgtaactcgctgtatggacacacagaggaaccacggagcgaaagcatctgagaaattcggcccccactgcgagaaagcccccgcagaccaggaagagggagaacatcctcgccaatgagcgtgcttaccgctgcgtgaggggagacgtcccccaggactgggaacgaggacggcacacaaaccagcagggctcactcaaggctggccgtggtctgccctgacatccaccacatctccctgcgggttccaggccatgcagcaggcaagagaaaggaagtaacgtacacagagaggtgaaaaggaagacgagagacggacccactgacagacatgggctgtccacgcagaaaaccccaaagaaccgacagagctttgagatccagtaagtgagtttcatgaaggtgcaaaacacaaggtcaataaattctatatgctaccaacgaacaactggaaacgggaaccttaaaagcaccgctgacaacaggaaaacatcaggaaacactcagaagtctcacaacattcgcatcaagcgtacacggaaagctacaaaaatcctgccgagagacacggacggcgcccatggactgggcctcctgcggttatgaaggcggcagctgggcccacagggatccattcactcagcgagatctcactcaaaagttcagattgtttgtttttgttttggaaatggagttttgctctcgttgcccgggctggagtgcagtggcgcgatcttggctcactgcaacctgcacctcccgagtagctgggattacagacgtgtgccaccatccctggctttttttttttggagacggagtctcgctctgtcacccaggctggagtgtggtggcgcgatctcggctcactgcaagctccgcctcccagattcacgccattctcttgcctcagcctcccgagtagctgggactacaggcgcccgccaccacgcctggctaattttttttttgtttagtagagacggggtttcaccatgttggccaggatggtctcgatctcctgacctcgtgatccgccctcctcagcctcccaaagtgctgggatgacaggcgtgagccaccgcgcccggccagaaggagcctattcttatgtgttttcatacaaaggcaaagaaaccagaatagccaacgtagcgcgggacagaagcagaactgagaagctcagcacgggatggcaaaagtgaccacgtcgctccagcgtgcaccacgggaggccggtgggggccacagtccacgtggtcccgggaccagcactcaccaccacgtcagagtccaacacacgttcccacaggacggcagagcaaggacgggctgagtctaagattcacacacaggcagcccaacaccagaatggccccgacagttccacacggcgcccaagtcggaggcttctcaccacagccagctctgccgcgggaacggacagacgcgtgcagcagtgggacggaggaaggttccggaacggagcccgcacacggcacagtcacgacgccgaggcaacgctgcggcctgcaaagctgatgctgggacagtcggacacccggacacccacgtaccacaaggggaacctcaatccgagcttcacaccccacagggaaggttactcaagaggaccccagaccaaaacacaaaacatcgcagaggaaaatcttcgtggctttggattcagaaatgaattcttagatatgacaccagaaacaccgctgtaaaaataaccagtcagtgtctcctcctccaaattcagaacatctctgagacaccacgtgaagagggggtgaaaacatacgtcacaaactgggaaaaaggcgaacacgtcgcaaataaagggtttgtatgctgaagacacgaagaaccctcacgctccgtgagaaagcaaccagcccagggcctctcagggcctccaaggctggaaggccgaagcggaggctggaatggccacgggccctgcagcctgcccagcaggtgccagccgtgggataaggacagacgtcgttggcgaaacacgactcggcctccccgtgctgggcctgatgtgcgaagcctcgcgcccaggatcacagaaccccacgcggggaatgacgggcagactgcaccgaggcccggccctgtcatcggctgtccttacctcaccggccccgtgtcaggtctcaccccgcccctctgtgtccgcgcaccccacctgactgaccccgcatcccccggctgcacacacacccgtcctcccactcacccgtcctccccactcacccgtcctcccactgacccgtccccccactcacccgtcctccccactcacccgtcctcccagggctctcccgcagtctcctcggccaccaggatgtcgtactcctcggccgcgtacttctcccagtccgagagctcggggccgccgctgtcaccgtcctggaggaagcacacgggttacgtacacggcgtggcgcggcccggcccgcgtgcccgccgcactcaccctgagcagggagatctgctctttctgctcgtggtcgaggtacttctcgatgttgaagaaggtgtcgaagaagacgttagccagcttgcagcgcttcaggtcctgcagcgtgatcttccctgcggggaggggagtgcgtccaaggcgcgtgagcccggtctcaccttcggggcctgggtgtggggtgcgcgcgtcctgtcacacgtgcttaaggacgcggcacgaagctccgggctctcacgccacgtgtttgacgtgaaaggcggacacgcgagtgtcctggttctgggtggggactgaggcgtgggaggccgtgatgcggaggcgactaggggccaccggtgccccaaggatgcgtggactgggactagcgcagggaggcgcggccagcaggggcgctgctggatctgaaattacagagaacggagctccccgtgcaggcagaggccagagggtgtcccggggacactgagcagcaggaggcgccccatggccggggggggcagggctgcagggcggtgcccgggcctcagagccatttccaaagtgaaagtcccagagctggattctgagatgcagaaggaagccaggcggcgtggacggtggggctcccctttgccttagagggcacgggggtgggtgggaggagctggggagatggtgtggggggaacaggggtgaggggaggagccgggggggggtgagaggggaggagccgggggggtgagaggggaggagccggggggggtgagaggggaggagccgggggggggtgagaggggaggagccggggggggtgagaggggaggagccggggggggatgagaggggaggagccgggggggtgagaggggaggagccgggggggtgagaggggaggagccgggggggggtgagaggggaggagccgggggggggtgagaggggaggagccggggggggggtgagaggggaggagccggggggggtgagaggggaggagccggggggggtgagaggggaggagccggggggggtgagaagggaggagccggagggggtgagaggggaggagccgggggggggtgagaggggaggagccgggggggggtgagaggggaggagccgggggggggtgagaggggaggagctggggggggtgagaggggaggagccgggggggtgagaggggaggagccgggggggtgagaggggaggagccgggggggtgagaggggaggagatggggggggtgagaggggaggagatggggggggtgagaggggaggagatggggggggtgagaggggaggagatgggggggtgagaggggaggagatggggggggtgagaggggaggagatggggggggcgagagggggggaggagccggggggggtgagaagggaggagacggggggggcggggtgagaggggaggagacggggggggggggggtgaggggaggaccgccttgtgcggcatcagcacgaacgtggcaactgctccctcagcccagtgccaacgtccccggtgagctccggccctaggttctctaggtcacccctcggggggtgtcgacgccccgaataggaggttcttgcactgtgagactaggcacctgtggtgctggccctcctcacaaactcagtaggacagcgcctcacagggacgtcccctcaccctggtccgtcccccctcccgtctgtcccctcaccctgggccgtcccccctcccgtccgtcccctcaccctgggccgtcccccctcccgtccgtcccctcaccctgggccgtcccccctcccgtccgtcccctcaccctgggccgtcctccctcccgtccgtcccctctccctgggccgtcctccctcccgtccgtcccctctccctgggctgtcatccgtcccctctccctgggccgtcctctcgcccgtccgtcccctcaccctgggccgtcctctcgcccgtccgtcccctcaccctgggccatgccctcacggggcatcaccttcagtcctcggcttgaccaggtccagcatctggcagaggcagtcctggaagggcagggcctcgatggccatgctgtccagccttcggcactgctcctcgtagaagtactcgagctcgaacatggacagggcgccgtccccgtccaggtccatgcagcggaaccagtactcgatgctgcggcacggcgagctctgtcagcccctgccctgggccctcccagcccgtgacctgcagcccctgaggcagcccccaccgggggtgcacgcgtccccgctgtgccttgcagcccccaccgggcgtgcaggcatcccctgccccctgccgcccccaccgggcgcgcacgcgtccccctgtgccgtgcagcccccaccaggcgtgcacatgtccccctgtgccgtgcagcccccaccgggcgtgcacatgtccccctgtgccgtgcagcccccaccaggcgtgcaggcatccgcctggggacacatgtcacatgggcggctcccggcccctccactgggacaaacgcatgccgcagcaggaacccacctggtcggtgtttttttgtcttcctcagagatcaaaaaccagacaaagtcggcatagctgatcttcccttccttctgcacttttctgcctctagatcgaaagccaggatggagagacgaagatgcatgtcagggagagcttcacaggaacggagcccctgtccacgcgcctcggtgaggggagccccccgggcccggccctcctcctgcccccctcctgcccctcctcctgcctctccggggaggaggtggaggccccgtggccagagggttttccccagatccaggcagggtcaggagtgcaccttcgttactgctcactcaggcccagcgcccgacaagaacccccgacctggggcctgggccacccccttcctcagacttcgcgtgacagtcttgtgccacccccccccactagggattcacgtgacagagacacgtgcccccctcgccagggcctggggtgacaaccactcgctgtcggggcacaaaaagctcacgtcaggcaacgatgaggagagggaccggggtcctcgcaggggcaatggctgccgtcaggcgcctgagccgtacgtaccgtgtgactgctcctgagaagatcctgtctatcatcttggtagaaagggctggaaaggaatgcggttgatgggcagcccgcaccgtgcctcggccccgacgtcaccaccccccggagccgagactggatgcggtggggaccgaaaagctgagaggacgcctgggtctgggagagccccggggccccgatgcccctgcacggcccatcctaggggcccaccacgctttcccgtcgagcagagccaagtccagcatgaaatccacagagcgcaaagctgaccgcggctccaagaccgacttgtaaagagcagaatattcaggcctcaaaggtacagctttcagacggagagagagacctcgagtgtgatcacggaaacaaacacgtttcaaccaaaggttcaccaacgggagacgggagtgagacctcagcaacgggaggcgggagtgagacctcagcaacgggaggcgggagtgagacctcagcaacgggaggcgggagtgagacctcagcaacgggaggcgggagtgagacctcagcaacgggaggcgggagggagacctcagcaacgggaggcgggagggagacctcagcaacgggaggcgggagggagacctcgccaacgggaggcgggagggagacctcgccaacgggaggcgggagggagacctcgccaacgggaggcgggagtgagacctcgccaacgggaggcgggagtgagacctcgccaacgggaggcgggagtgagacctcgccaacgggaggcgggagtgagacctcgccaacgggaggcgggagtgagacctcgccaacgggaggcgggagtgagacctcgccaacgggaggcgggagtgagacctcgccaacgggaggcgggagtgagacctcgccaacgggaggcgggagggagacctcagcaacgggaggcgggagggagacctcagcaacgggaggcgggagggagacctcagcaacgggaggcgggagggagacctcagcaacgggaggcgggagggagacctcagcaacgggaggcgggagggagacctcgccaaggagaggcgggagtgagacctcgccaacgggaggcgggagtgagacctcgccaacgggaggcgggagtgagacctcagcaacgggaggcgggagtgagacctcagcaacgggaggcgggagtgagacctcgccaaggagaggcgggagtgagacctcgccaacgggaggcgggagggagacctcgccaacgggaggcgggagggagacctcgccaacgggaggcgggagggagacctcgccaacgggaggcgggagggagacctcgccaacgggaggcgggagggagacctcgccaacgggaggcgggagggagacctcgccaacgggaggcgggagggagacctcgccaacgggaggcgggagggagacctcgccaacgggaggcgggagggagacctcgccaacgggaggcgggagggagacctcgccaacgggaggcgggagggagacctcgccaacgggaggcgggagggagacctcgccaacgggaggcgggagggagacctcgccaacgggaggcgggagggagacctcgccaacgggaggcgggagggagacctcgccaacgggaggcgggagggagacctcgccaacgggaggcgggagtgagacctcgccaacgggaggcgggagtgagacctcgccaacgggaggcgggagtgagacctcgccaacgggaggcgggagtgagacctcgccaacgggaggcgggagtgagacctcgccaacgggaggcgggagggagacctcgccaacgggaggcgggagtgagacctcagcaacgggaggcgggagtgagacctcaccaaggagacgcgggagtgagacctcagcaacgggagggggggagggagacctcaccaaggagacgcgggagtgagacctcagcaacgggaggcggtagggagacctcaccaaggagacgcgggagtgagacctcagcaacgggaggcgggagggagacctcaccaaggagaggcgggagggagacctcagcaacgggaggcgggagggagacctcagcaacgggaggcgggagggagacctcagcaacgggaggcgggagggagacgtcgccaaggagaggcgggagggagacgtcgccaacgggaggcgggagggagacgtcgccaacgggaggcgggagggagacctcaccaacgggaggcgggagtgagacctcaccaacgggaggcgggagggagacctcagcaacgggaggcgggagggagacctcaccaacgggaggcgggagtgagacctcagcaacgggaggcgggattgagacctcaccaacgggaggccggagtgagacctcaccaaggagaggcgggagtgagacctcaccaacgggaggccggagtgagacctcaccaacgggaggcgggagggagacctcaccaacgggaggcaggagtgaaagcaccgtcgccgtcagcttgggccacgagaaggtcccgcagcctgggcggccatccctgcggtcaccggtgtccctgggacgcacgagccaaggtgccgccccccgcttcaggccgcagtgcgtgagaaacagcgcagcccggccgcacacggcatcctgccctgggaccgagagtgggctccagaggaacgcggaaagctggggccgcgccgggccgggggttcacagggacagtgagcgcctggttctgggccgattcccagctgtgcaggtgctggcccaggccacacgggccggcgctgtggagctgtgctctcctcgtggctagttaggggcccagggcgcaggtggctccctgaactgagcgcaggacaaatccagggaatgctacgtctgctcaggtgcgcgtccgacgcagggatctactgcggccacgcgacccaggaccagccccgggagacgcagacgggtgcagctcacgttcggggaaccaggcgtattatgagtcgaccacacacaacagatgccaccgtaattcggaaacagtcttggtcatatggttttttggggtaaaaagcacacttaaaggaatcctttagaaaactcaagccccacaggccacaggccgctttgagttcctgcaagtgtggatgactcttagaggggccgggaggcagtggctgctgtgaggacacctgggcggcaccggctcccgcggaggtatatgaacgaccgctaagcctggggctccacctagcccgggattggatggaaactgctccaggccttgggggctggaacctggagctcctgagggaaggcgtgtggcctgcccgcccttgctcgggtgttaacaaggaagccccacagcgctgctggccctcgggccaggagcttcaggaccagcggcccacactgaccctgtagacgcccccaggcagaggcctcgggcagaggcgcacgcggggacccagacacggggcagcgactggggaaggagaggcagctgcagacacagagcggcgagtgcgaaggagaggcagctgcagacacagagctgggagtgcggaaggagaggcagctgcagacccgcaggccctgagagaagggtgtgctcggtgtccgcgcggcccgcccgcccctgtgcccccacgcaccgtggtcattgtgccgcgccaggtcgtccgcgtcgatgagcaggtcgtggtccgtgtccagctcccagaacttgcagtagatgacgtagaaatgctcgtacgagaagaattcggtcagctggttgatgtccgcctcctcctccagcagcgccacattctgccaaaggacccaggcggcctgagcgcggggcctctgcggggatgccccaagtccgcctggctgcgggcggggcagggaaggctgggagggtcggggccgctccgtgggtgggggggactgggcagctggggccggggggcactccgagtgggggcaactctgcggtggggggagctccagcatgggggtggctccctaggcgggtgtgggggtgggggcagctctgggggagtcagggctcggctccccctcagggtggtgcccagtacggccccacccgcctcctagatcaaccgtggacccccaaccgcaggcggcggggttccagtgctcacaggcctgggggtgggctgggagcgcggtggaggtgggggtgggggtgggggtgggagagggggtgggaggggaggagggaggggggaggagggaagggaagggagtggaggtaggaggggtagggacaaggcagggggcaggggacagggggccgctccgcacctgcaggaaggagctcctccgcagctcggcgcaggtgatcctgccggaccaggaccggttcacggcgtagaagatccgctggatgacctgcgggggcgctgtcagtgcggtgggtgcgcagagacccccaggagcctcgccccgcacggagaccgggagccgggagaggggcgcgcccttggtctcagccgcacggggccgccagggcacaggcgggggcagagggaagggccctgcgggaggcgccgccccaggccgcggaaagcggggagggtctggccggggacgccccggagctacacgggcccaggacaggtgggaagggggtgcggccaccccggaaaaccagagtccccccaacaccgggctcccgggcgggtggagactctcccagagcgcggccgcctcctccggaagctcaggaaccccgggccccgcccgccccgtccgcagaagccccgcggcggccgctgcagaaacacccgcgccccgcgctggaaccgacggcccctccgctggggacccaccgtggtgatgtagcgcgagtggaactcggacgcctccttcaggaacgacagccccgggtgcgtgttcaccacgtcctgcgggtgggaagacacgaggcgcgtggtgtagacgccggccctcccgtgaggtgtgcggtgtggacgctgcagacgcggaccctcccgtgagcgatgaggtgtgcggtgtagacgccggccctcccgtgagggatgaggcgtatggtgtagacgccggccctcccgtgagggatgaggcatgtggtgtagacgcgggccctcccgtgaggtgtgcagtgtagacgcggaccctcccgtgagcgatgaggtgtgcggtgtagacgcggaccctcccatgagggatgaggcatgtggtgtagacgcgggccctcccatgaggtgtgcggtgtagacgcggaccctcccgtgagggatgaggcgtgtggtgtagacgccggccctcccatgaggcatgcggtgtagacgcgggccctcccgtgaaggataaggcctgtggtgtagacgcaggctctcacctgcaagaaggggacaaagtcctcctgcaccaggtagttgcagccggggctcatgagcagatggacgaacttggccgcgtcgtcgtggcagttctggaggattctggaaggacaggatgactgggcaccaccctcacaggggggtggctttcgaccccgcagacgcagggtggaacacgtgtgtggtgttccacgtggtgcgtggcaggtggccacacacgacggccaggcctgtgcccgtacaagggtttctcctctcactgcggcagcctcagggggcacccgtcctggcaccacggggacccggggacgcctccgccctcccgacacagccccctgcccagcccaggactcactttctccacatggcgacgaacttgtggacggacacggagcccgtgcgctccccgccggcgccatagaagagcggccccttccagtagagggggcagccgcaggcctggggcagagagggcaggagtgggcagtcagcagggcctggacgccggcgctcctgctgcgtacctcgcgcctgaccgacgccgcccagagaccctctgctgcagaaagacacagcacgctcagcgcggcctgtctgggcatctgcaaactcaacgtggctttcgctccagccttcaatcagtcatgagagctgagcgtgggagtgccgggcacgcagtatcccctgaccacagaccacgcgtgggcactgtaaccagaggcggctgcatccccagcgtctggaaatcaagcggcacgtactaagaaccagtaagtacgggaataaatggccccgtcagccaggcaacgcggtgaatcggacggcgacagaaacatctcatggaatgtgtgggacgcacctacagcagcgacccatggcaggttcacagccttaaatacacgcgtgaggaaggaaagtttaaaatcgatcgtctacacttctaccccaaaggaacaaatacatggcagagatggaacgcaaagtaaatagtaacagaaaatcaacaaaatcaaaactcgatgatttgaaagatttcttaaaaattaattaaccctggctggctgggcgtggtggctcatgcctgtaatcccagcactttaggaggccgaggggggtggatcacctgaggtcaggagttcgagaccagcctggccaacatggtgaaacctcgtctctactaaaaacacaaaaattagcctggcatggtggcgggcgcctgtaatcccagctactcgggaggctgaggcaggagaatcacttgatcctgggaggtggaggttgcagtaagccacgatcacaccactgcactccagcctgggtgacagagagagactctgtctcaaaaaaagagcaaatacagattagccatgtcagctgtaactacagatcctacaaacatcagatagtggatgctcatgaatcactttatgcctgtaagtcagatgactgctgaaacagactccccgatgaacaagtcaaaaaataaactacaatagaaaatctgaaagagctgtttctgcaagaaattgtgtccataatttaaaactgtcccaccaagaaaattccagcccccaaaggctgctcccatgagtcgaccaaacattgaaggaagaaatcacacatgcgttcccctggagaagaaaaacgaggggcgtttcccagtgcctgttccgaggctggcacagcctggacgcggtcagggacacaggaagtcacaggccagttatcactggagagcagaggcagaaatcccacacagaacacacagtagcaagtccaactcggcaataatagaacaggaatatctaataataataatagaccaggaaaccagaatcaggagggacactcttattctcataaagggtgctatggcctgaatgcctgggtccccaagatccacgtgctgaaatcctctcccccgaggcgatggtgttgggaggtggggcctcatgaatgcgatgagtccccttctgagggaccccagagagctccctcaccccttccaccccgtgaggacgcagcgggaaggcgccgtcgatgaaccaggcaccactctgccacaccgagatcttccagcctgcagacctgtgaacagtaaatgtcttgctggtgacaagctgcccgggctatggtgtttcttgacagcagcctgaatgctcagacaaagggcctctacgaaacaccccagctgctcagacagcgatgacacatgaacacttcttccctgtgctgggaacaagaggacagtgtcaccaccaaggccgcctggacggccgagccagggcagcaggcaagggaaagaccgaaagatacgacgacgggtaagaagaggcagaaccgtcatgattcacaagcaacacactgtgtagacaatccaaatgcttaccaaatacgggaattaataagtatcttcagcaaagttgctggatccaaggactatatgcaaaaataaattatttcaatatactggcaacaaacaactaaaaataaaatcttcaataatgccatctatcaagagcatgaaaaatcaacctacgaaaaatggaacaaaaatcacacacagtgtctacaaagcaaactgcagggcacggctgggtgaaatcaaagacgacctcaacgtggtgaggtggacctcactgctgagttcacagactgcagtttcctccagacgactctgttgacccagagtccacgcgatccccacccacagagtccagcaatccccatccacatgcaccgagggcctgttgttttggggtttgtagtatacacggacaggctcatgtgaaaacttaccagggaacacaaaagaactcacagggggaccaagttggtggatatgagtcccactgcccggtttcaacccttcctgtaaagtcagagtaatgaagactcagtcagtctctgtcgggcaccggtggcctaagagagcaagggaaggaagtgagttgggacagagccccgtggaatatccacaggcaaagacacttcacacaaactgaataccaggggatcccagcccgaagggtgaaaggccaaacagcggcccctcctggaaggaaacgagggacgctgcacggctctgccgcggccaaggtttctttcacgggccacacgtgcgctccctgaaggaagggagcaccgctgcaccgccccagcgcaggactcagggtcagctaccggcacggtgaacaccatgacaggacatgacacagagggagaaatgtctctgcaaggcgagattctgacgagggactcagaggcagaattttaagcatcagtgagaaagaggcccgaacacgaccgagtggacatgcactgccctccggagaggggtgcacggtggccgtagacaaggggaagcgcccagcactggcgccggcgagggcagggttcacagggcatggagaggtggcaacaagaacatgacacgcgcggctgagacaaaaaggactgaagacgccaggtcccgcgaggctgccaggcagctgggtgtcctccgcgttgctgggggaactgggacgccacgcagctgccgggaaagcggcccacggggcggctgagcgtaaagccccgtggcccggccaggacatctgtcctcccagaagcacaccagtgggaagagggcccgtgcccgtgagagcctgcacagatggggacgtcggctgcttggttcacggtgccccaggcgagaggagccggacgccagagcagggactggaggaataaactgtggcagagtcgtcctgacaggtgcagggcgggagtgaccacgggggggcgtgggggactgcagagggggctgcgcgccacagcggggattgcagtgctgctatgggaaaggacgcgctccggctggcgcacctgtggatgacttgaaggcagccgtgtgcggctggaggggccgggccccgcaggacgcacaggcacgtgccggctcccgtgatgaggatcctgacggagctcagccctggccacctggaagggcgtcccggtgcggtgggagggaacgagccgggtgcagcaccgggtccttgggctagtgctagtcccacgcttttgacctcatgagaccattctggctcacaggccgtgcaggtttcaaaccccaagcgctcaacacccagggatggggggatgtgtgagccttcacatctgtgctcctcaccgcgtgcaagacacaccgtcatgacccggtggcagggatggagcatcagatctatccagccgtgcaggatatagcgtctcatgtgtccagacctgcaggctggagtgcagtgtgtgatcacagcgtgatccatttttattctacttgtttttcgagacacggtcttgctgttgcccaggctggagtgcagtgtgtgatcacagcgtgatccatttttattctacttgtttttcgagacacggtcttgctgttgcccaggctggagtgcagtgtgtgatcacagcgtgatccatttttattctacttgtttttcgagacacggtcttgctgttgcccaggctggagtgcagtgtgtgatcacagctcagtgcagtctcaacttcacgggctcaagcaatcctcccaccttagcctcccaagtagctgggaccacaggtgcgcgctatcatgcctgggtaatttttttaatttctacagtgaagtctcactatgttgccgaggctggtctggaacccttggccgcaagccatcctcccgccttggcctctcaaagtgctgggactacagggatgacactgcaaccagagacagctgcacccccggcgtctgggggatgagaactgagcgggagagtgctgggcacacagtccccccaccacaccaaacccgaaaattacctccaaatgaattagctcataatttaaaataatcctaaagtaaatggagataatcaactctaaaatgcaaaagatacaaaggaaagcagttttacctgaatgtcacaaaatccttatgggaaagggaataaaacatcagataccctgatctgacttttaaaagtcttttcgtgatcgacacacagaaagaccgactccttgtggggcccggcaacgcggcggcacgcccacccgcacggccaggacagggaacgaggccgccagccctgacagtcccttcggcccctccgcagtccgctacggcgacggcccccaggcctcctccccgtggctccagttcaccttttccaggacacggcaacgggacccggccatctgcggacttttagacctggcttccctcgctcagcacatgcgtgtgggactcacacaccttgctctgtgtggatcgtctgcccaccttgctctgtgtggatcgtctgcctgtgtactgctgaaccctattccattatggctctgctgacctcagagtagctccctgagcaggaaacaccgccggccccaaggcccacgtgatggtgctgctgagggggactcgcgaggcagacaaagtcccgagcgtctacagtcgcacagggcacgccgacaccaaccgacaggtgtgagaggagaaaggaggacgccacaaccacggccggcaagttcagcacgcgttcctcggcgggtgacgggacaagaggacgatctgcagacacgtaaagatgtgaaaacgctgccaagctatgtgagcgagtgacatcgcggagccggaggagtcttcagggtcacatgaaccagtggtgggctgtggctcggagcccccacccaagtctcacggggaactgtgatcctgagtgttggagcagggctctgctggggggtgactgggtgatgagggtggacagcccccttgctggtctcgtaatcctgagttcttgtgagatccgatggtctaaaagtgggtggcagtggccgggtgcggtggctcaggcctgtcatcccagcactttgagacgccaaggcgggtggatcacccgaggtcaagagttcgagaccagcatggccaacatggtgaaaccccatctctcctaaaaatacacaaattagccgggtgtggtggcgcatgcctgtaatcccagctacccaggaggctgaggcaggagaatggcttgaacccaggaggcggaggttgcagtgaggtgagatggtgccattgcactccagcttgggtgacagagcaagactctgtctccaaaaaaaaaagagaaaagatgatacagacagcctgtgtttattgaaacaattcatgctgtcattaaaaaccttcccacagagaaaactatcccaaatggcttcactgatgagttctaccaaacattcaaataaaaataacacccattctaaacaaatggctccagaaaagtgaattctaaaggacattttccaagcaactctccgaggccagcatccccccgatgctaaaccagaccaagctatcacaagaaaaggagaccgcaggccagtccttcacgagcgcagacgcaacccctgcgaggcctggcaatgtggacccaacacataggagaagtgtgacactgtgtggtggaccagggaccgggggctgggggctcacccaaagaccgggggctcacccaaagaccggggctcacccaaagactggggctcacccaaggagcaggggctcgcccaaagaccggggctcgcccagggaccgggggctcacccaaagaccagggctcacccaaagaccgggggctcacccaaagactggggctcgcccagggaccgggggctcacccagggagcaggggctcacccaaagaccagggctcacccaaagaccagggctcatccaaagaccggggctcacccagggagcaggggctcgcccagggaccaggggctcacccaaagaccggggctcgcccaaagaccggggctcacccagggaccaggggctcgcccaaacacagggggctcacccaaagactgggggctcacccaaacaccgggggctcacccagggactaggggctcacccaaacaccgggggctcacccagggaccgggggctcacccagggaccgggggctcacccaaacactgggggctcacccaaacaccaggggctcacccaaacaccggggctgccttcacactcagacgtcagtcaggtcaagaccagtccttcatgaccacagacgctacccctgcgtggccgggcaatgcacgctgcggtggaacagggaccgggggctcacccaaggaccggggctgccttcacactcagacgtcagtcaggtccattcaccttttacaggaccaaaggaaaacctcactgccctctcaatacacgcagaaatacacatttagcatcccggacaaacttcaaggcacttttataattttaaaaagtaaactgaggccaggcgtgatggctcatgcctgtcatcatcccagcaccatgagaggctgaggcaagaggatccttccagcccaggagttccagaccagcctgggcaacatagcagaaccctgtctctaccaaaaaagaaaaaatcagccaggtgtggtggcgggtgccagtagtcacggctactcgggagggctgaggtgggtggatcactggagcccaggaggtcgaggctgcagtgagctgagatcatgccactgcactccagcccgggggcagaatgagaacctgtctcaaaaaaaacacaagagctcccagcaaacaagaaaccaaaagggaaggggcctcctgagtctgatgaaggacgccaggcagggccgctgcgtcacggacgacttgagcccgaggcgggaaggggcgtgctctccacggctctccagcactgcactggcaggccgagcctgtgtacagaaagtcagggaggagacaccgatgcagacgagaagagaaaggctgaactgtgctcacctgaagatgacctgaccgtgcgttagagactctgccggacttaaaggttgagctggtagagccgatgactgagttaaacttggtcagaaaatgcaaagtccacatataaaacctaacagtgcttctcaacattcacaattgacaatcatattaaagtaaaaaaataccacgtacagtgtcatcagaaacaggaaatgcttgggtatcaatgtgatgaaccgtgaacaagaccaaactacaaggcgtactgaaagaagtgaaagatgcctgaaataagggagagctggaccgcgttcatgagacggaagcctcaatatggtcaagattcttccaagttcatctggagtcaacaggatgcccatgtaatcccagcaggctgtcgtagcaacggagggaccggctctaaaattcacacggtgggaacgaacaacggtgcagccactcgggaagacagcgtgcaggttccccagaaagccggaagtggaactgcacgcgcacacggaacaccacgcgatccggccctccacacacgcacatggaacaccgtgctgtatatgccacaaacgtctccgagttctgtgctccaaatggttacggtggtgaattctgttgtgtgaattttcccataataaaaaaaagtgcctgctgtctgattctgtttacataaaattccagaaaattccggctaatctatattgacagaaaggaggcctgaggtagcgtgggatgagggcaggtgcgcgtcagaaagcagcagagaaaagtccagcgcacgtgcccgctcaagcgcaaggatgcagggacgcctattgtcttggtgctgtggatagtttcatgggtgggtacagacgtcaaagctcattgaattgtaccttccacacgcaccatgcatcccacatcagttatatctcaacacagctgccccaaaatgaaaaaaaggcaaactgatgagaaagaaacacgtaaggtggtcaacacgtacatcagggaaatgaggagtgcagccaggacgggacgcctgcacacgcacagaacggctaaaggcaaagcgtgtggccacgtgcccgcaggggtcaacgctgctgcctggaaatgcgtcactcagggccaccccggaagcagggttttttgttttttgtttttttgcgtagagacacagtcttgctcagtcgcccaggctggagtgcagtggtgcgatcttggctcactgcaacctccacctcccaggttcaagcgattttcctgtctcagcctcccgagtagctggaatgacaggtgcccgccaccatacctggctaatttttgtatttttagtagagatgtggtttcatcatgttggccaggctggcctcgaactcctgacctcaggtgatctgcctacctcagcctcccgaagtgctgggattagtggagtgagccaccactcctgggccctggaagcagttttatagcttcttacaaaactaaacatgtggccaccagatgaggcagagctcacctctgcggtattaatcacctcaggaaaatgcaagcatgtctgcgtaaatcagtgcacagacacacagcagctttactcacaagaagcaaaaaccaaagcaaccagacgtctatcaaccctggaacaggggagagatggagcacacacacagcagaagctactcagtgatagaaaagaaactgcccatacggccagggacacatagtgagccccacagtatccacaccctggccagccacacgggagccccacggtaaccacgccttggccagccacacagcgagccccacagtatccacaccccgccagccacacagcgagccccacggtaaccacgccttcgccagccacacagcgagccccacagtatccacaccacaggacttaatcagtcctcaacacacacacatagcgaaacatcttgctgtaccctgtatacacaaatattacttgtccattcaaaataaaatttaaaataaagatgctgccaggaagaagttagaaaccacagacaaaatgctccaagagtcctcatgtgaaattctaagagaggcaaagctacagcgaccggaagcacatctgcagctggcccgggccagggagaaaagaggggaatgatgaggtgcaaaaggaggcacgtgggacacccgcggcaggtgacaaacggccggtcctgcctatgaggatggatacccaggtgtgtgctttaccaaaatggatcaaattgtacacttaaaattggtgaatcttagggtgtgtaattatatgacaatacagctggccaaacaaaaaactattcaataaactaaaaaaaatgacagaaggaagtgtatgtaaaaaagatgaccatagatattcatgagagaaagaactgaaataatctgtaacactgacagctgctttactgaaagagatatacgttagtgtgtagcatgacggatcaagaaaggaaccggaaataaatgattctgtcaagaaagtgtctatgtatgatgcagatacgatcaagattttgtaaatcgtacaagacaaggaaaagctttagagcaagaaatttctaagttacgcaaaaaatttttagaaaaaatgtaaatcatcaaaatagtctccataaatgaaaaccctgaattagccaacaacgtttgaaggaaattaacaaagagaaaagtgtgttttcctgtgggggcagctgagggggtggagtttggtggaggtgaaggagctgatgactctgtctcaaacggcttcagagaaaacacagaggagtgacaatgatgaaagggaggaaatgatgtatgagatcagccctgactcacacagacaggaagaaccgggccaggagaaggcacacacggacctcgctgcacggccacggctaagatccacggggggacccccctcatcaaactcaaagtcccctcagacgtgagttctcaagcagccgccggccaaagtccacccgcctgacaacacgcgtgtggagctgtgactccaggccctcattcagtcactcacgcgacggggagaactcgaaacggcagtgacacccctactcgttcgtcccctgggccgggggcccggctcacagaaaaccgtcccaaaggcacacgatggagacgtggacggacatctgcaggtggcggcgagctgggcgccaccgagacaggctcagcagccttggcggggaagctgaagtttgcctgcggcccccacacacgcgggacgctcacagggttctgccgccacagcgcaggtggattaagtcgcgacagcgcacaccctgctggcctctgcccacagtcacggtgggtgctcgagcaccatgctctccgcctgcagggccgggtcggtgcgtgcaggcacagtggggcctgtggaggtgtctctcggactcccagcggtgcagacgctgcaagcgacacaacttcagtctcagagctctcccctgccccgctgggtcacacccaggtcaccctgcttctctggggcgtcgaagacaacgacaaaacttgctttttaccaccaaacgtgacatccagccaacggaccaggttctttcaagtcttaaagcctcactaccttagacggccaccaaggccagtgccgctgtgcgtggaagcgaggtgacaccgagaactgagtcctggaaggaaaatgacatgaaacgcgcacatgagaaccaggcgccgaggcggggaagcaccgcggagggggggtggccgctgtggggggcggcaccacggtggggggaggcgccgttggggagaagcaccgtggggatgaagcaccgcgtggggaggggcgctgtggcggggaagcaccgtggggacgggcgccctggcggggaagcaccgcggcgggggtaggggagggcggggcggcgccctggcggggaagcaccgcggccggggaggggcatcgtggcggggaagcactgaggggaatacatgggtcccatgcaggaacctcactgggctgcgcgagcggctttgtaggacccgaagcggacgcagcgcgtgagctgcaaaagaggtgtctgacccagcccgaggcgcgcagagaccctgtgggtggggccgggcgcactccgcgagggtgagttctccacacaacggaggctgtactgaaaaggatgaaggtgtcccagcagacggaatgccagcaaagagacctcccagtgaaggaactctcagagataccccacaacttcaagagcaccaaggataaaacgcggaagctgagcaaggcgtgttaagtcgagtgagtctgccagggcacggagcaggtgctcactccacacgggacaaggagatggcactgctgtaactacttttggcaagtttttactgagagatgaaacaattcttaatgcttctggtgttttaagttacagcatactaggtaaatattagttcttttcattcactacatgtttgcaaccgactgtaagaaagtttctaatatttcaacaaaaatgattatagaatgatcctaatttttactggaagatggttttgcatggttgtgacttatctggtcctttcatggccccacactgccgtacaagacagggacacctctacaaatacggagtgacttagcaaaaacaaatatgcaagtgtacaacagcatgctaatttttctctaagaaatgcaagaagtatgtatgttcatactcatacacatatttgtacataattgctcatattaaaagctaaaataacaataagaggataaaccaaagctatggaaactattacctctggggtagaaacagcacagacagggacagaacctggacttacctgaatgtgtctagtttgttagtgctcactttgtaaccatggaggtttttacatatttataaaacaaaactttttaaaatactttaaaaacacaatccctaatagaaaaagggcggggacacttaatgtgttctttcagacccgtattgccctaaaaccaaaaccagacaaaggactcacaagaaaactaccaagcactgtcttctctgtgaatccagttgcaaaattattggaatccagcaacatataaaaaagatgagacacagcgaccatgcggaatttatcccaggaatgcaaggttggtttaacatcccaaaaccaactcatttaatagactgtattaataagttaaaaaaacaaaacccggccaggtgcagtggctcatgcctgtaatcccagcactttgggaggccgaggcaggcggatcacttgaagtcaggagttcaagaccagcctggccaatatggtgaaaccccatgtctactaaaaatataaaaattagccaggcatggtggtgcatgcctatagtcccagctacttgggaggctgaggcaggagaatcacttgaacccagaaggtggaggttgcagtgagccgagattacaccactgcactccagcctgggtgacagagcaagactttgtctcaaacaagcaaacccaaaaaacaaaaacctgctcactcccgaggacccccttcacagctgcagagctggagagggctggggggcaggggtctcaccgtgaggggctcacatgtaccgtgcaccgaggctctggggctctgacttggaggggtgggagcatccactggccagcgactccacctggagggtaggaggctggagatgcgggcacaggtccctggaaacacaaccacccaccaggggtccagacacgcatctctggtgtaggccttgccttggtaacggacagacactaaactgagtgtgctccatctgtgggcgtccaggcggtcagcctggagagcatgcagctgagaaggaaagcaggcggcgaatgatgcacgccgcgccgcagcactcagggtgagtctagaaatgggcccatggggctgctgccaggagacgggtccacagctgcccagcctgggatggccgctcctcgggcagaaaggggcaaggccaggagggtgcagaacggcctccgagagccacgagagctggcgccactggccccggaggggagagaaggggagggtggcacagggcgggcctgcgctcttcacagcatcaggatgagaatgcagacggaattcccactcgcatttcagatgcttaagaattcacacagcagcaaccagacagcaaacctcagaccacaactataacctcagagaaaacctgggccgctcccgcacacgtgtgaaacgcaccctcctcggccgtgccgcctcactcacgctcgtgtgacacgcacccaccacggccgctccgcctcaccctcacatgcccgcagtaccacctcggctgctccacgtcccacgcgtgacacgtaccttggccaccaggcccatgtcatccatggtggccctctcgtgggggaaccgggcgaaggtgctctcgatcttgctgatgacggcatccacgttgacggagtcctgcgggcgtcctctggggaagtagaaggtcggaatgctttggctcgtggccgggggcagaggctcttctttccgtgtctgaacctgaagagtcgacagacagcgctcagttagaacctgggagcatcgaacgccttcttcacccggacaacacacggggcctctctagggccgacagtgctgaggccacctgatcccagccgggagaggacacactgcaatccctgcgggggaccacacacgtactccactgcagggcccaccttcacccaggaggccacaccatgctgccatggaccccactctgggtggcggctctgcgccactgagcccccatcacaccgagcagggccctggggacaagggcagctacgtgccccaggcacctgagagcccagccaggacccactcccgattcccatgagccacaccactgaccccaccacacctggcagggacctggggaaaagggcagccacgcaccccagacgcctgagagctcagacgtggagaggcacaggtgccgtccacaggcaaccctgtccctggagcccggaagactcacattctgagaggcagaggcagggcaggcaaccacacagccaggagaaggggtcgaccaccaggtactgctgcggacacgcctcagcccctcacccggtgcacagcccacgcccacgggctcttggccccactcagcaccagcactctcctcacccagtatatctgcaggccccagaacactcactcaagagtctcctgcttgcatctctacacaacctgcgaggtggacatttgatctcatcccgtgatgttaaaacaccatctgaaacagttaacagcatcagcaaccgtactgcgtcctcctccatcaactgcccaagggacggtgctgcgtcctcccccaccatcaactactgaagggacggggctgcgtcctcctcctcctccaactacccagggaacggggctgtgtccttccccatcaactactcgggacgaggcttcgtcctcccccatcaactactcaggggacagggctgtgtcctccttgaccaactacctagggaatggggctgcgtcctcctcctcctccatcaactactcaggggacggggctgtgtcctcctcaaccaactgccatggaggaggggtccagggaggaagtccgcataccagtggaccacagctcagggcctttgcacccacaatcctgactgcctggatcaatccaggactgggtccaagctccagtgtccacacagagaaaacagcccgccctgctactcccacaggaccctcaccccaggtcacaagggtcccacagacagcaccccaactgtccccaccctgctactgccacagtatcctcaccgcaggtcacaagggtcccacagcgccccaactgtccccaccctgctactcccacaggaccctcaccccaggtcacaagggtcccactgacagcgcctcaactgtgcccaccctgctgtcgctgcaggaccctcacccacggtgagactcagttgtttttctctgatccccatgtaggaggaacagaggccgcctccgtgacctggggcagagcaggcttcccgcagtagctgccgactgagtgctccttcagcacagctttacctaagggcacaccccttccctgtgattcagaacgtgacctctgtgtcctggggcaggaggtccctgcatctccccgagcccgcgatcccacagtgcatctccccgagcccatgatcccgcagtgcatctccccgagcccacgatcccgcagtgcatctccccgagcccaccatcccacagtgcatctccccgagcccaccatcccgcagtgcatctctccgagcccaccatcccacagtgcatctccccgagcccgcaatcccacagtgcatctccccgagcccgcgatcccacaatgcatctccccgagcccaccatcccacaatgcatctccccgagcccagcatcccacaatgcatctccccgagcccgcgatcccgcagtgcatctccccgagcccgcgatcccgcagtgcatctccatgagtccacgatcccacaatgcatctccccgtgcccgcaatcccacaatgcatctccccgagcccaccatcccacagtcatctccctgtgcccaccatcccacaatgcatctccccaagcccgcgatcccacagtgcatcttcccgagcccacaacgcattcccgcagcggcgccttcccgtctctcgctgtgggggtcccactgtggagcctgcggctcttcctccttcatcacgctgggttcacacagctctgctatttggggtacggaactgaccccgcgaatattctgcagtgagctctcgggctcctgtgtttggcaatatagcaatgacctgggtacacaaaccaaccttcctgatgaaaactgccaagaaccctggacagaatagttgacaaacgtcttctagacggcgcccacaggctggcaggaaaggaggacacctcaggccacagctgcctggaaggaagaacccggggaagcccgtggagcctgaacaggctctgccttcagaagcgtgggccgagcgggctcacccgaaatctctcacagccttgcagagctctggggaagaggaggcaaaacgcagggtcctccggggaagctcccagaacgcgtcaccttcagtgggaagaatgagctccaagtaaatccccagcgcgcctccggccccaggaatgaaagtagcagccttcacctggagctgctggtacgagctgggcaggggggagttctcccccgagaactgacggctacagccgactctcctgcaggtttgcaaaccaaactcacggtcaccaggatgctgcgaaaaccctcaaaccggccgggctcgtgcctgcaatcctggcgctttgaaaggaggctgagggggacagactgtctgagctgaggagttcaagaccagcctgggcaacatggcaaaacttcatctctactaaaaaaaaaaaaaacaaaaaaaaaaaaacagaaaacaaaaaacaaaaagagtataaaaaaaattagccgggtgtggtggagggtgcctgtactcccagctactcgggaggctgaggcaggagaatcgcttcaacacaggaggcggaggttgcagtgagctgagatcgcaccactgcactccagcctgggcgacagagtgagactctgtctcaaaacaaaacaaacgattaaccaggtgtggtggcgcatgcctgtactcccagctactcgggaggctgaggcaggagaatcgcttcaacacaggaggcggaggttgcagtgagctgagatcgcaccactgcactccagcctgggcgacagagtgagactctgtctcaaaacaaaacaaacgattaaccaggtgtggtggcgcatgcctgtaatcccagctactggagaggctgaggcaggagaatcgcttcaacacaggaggcggaggttgcagtgagctgagatcgcaccactgcactccagcctgggcgacagagtgagactctgtctcaaaacaaaacaaacgattaaccaggtgtggtggcgcatgcctgtaatcccagctacttgagaggctgaggcaggagaatcgcttcaacacaggaggcggaggttgcagtgagctgagatcgcactactgcactccagcctgggcgacagagtgagactctgtctcaaaacaaaacaaacgattaaccaggtgtggtggcgcatgcctgtactcccagctactcgagaggctgaggcaggagaatcgcttcaacacaggaggcggagggtgcagtgagctgagatcgcaccactgcactccagcctgggcgacagagtgagactctgtctcaaaacaaaacaaacgattaaccaggtgtggtggcgcatgcctgtactcccagctactcgagaggctgaggcaggagaatcgcttcaacacaggaggcggaggttgcagtgagctgagatcgcactactgcactccagcctgggcgacagagtgagactctgtctcaaaacaaaacaaacgattaaccaggtgtggtggcgcatgcctgtaatcccagctactcgggaggctgaggcaggagaatcgcttcaacacaggaggcggaggttgcagtgagctgagatcgcactactgcactccagcctgggcgacagagtgagactctgtctcaaaacaaaacaaacgattaaccaggtgtggtggcgcatgcctgtaatcccagctactggagaggctgaggcaggagaatcgcttcaacacaggaggcggaggttgcagtgagctgagatcgcaccactgcactccagcctgggcgacagagtgagactctgtctcaaaacaaaacaaacgattaaccaggtgtggtggcgcatgcctgtaatcccagctactcgggaggctgaggcaggagaatcgcttcaacacaggaggcggaggttgcagtgagctgagatcgcaccactgcactccagcctgggcgacagagtgagactctgtctcaaaacaaaacaaacgattaaccaggtgtggtggcacatgcctgtaatcccagctacttgagaggctgaggcaggagaatcgcttcaacacaggaggcagaggttgcagtgagctgagatcgcactactgcactccagcctgggcgacagagtgagactctgtctcaaaacaaaacaaacgattaaccaggtgtggtggcgcatgcctgtactcccagctactcgagaggctgaggcaggagaatcgcttcaacacaggaggcggagggtgcagtgagctgagatcgcactactgcactccagcctgggcgacagagtgagactctgtctcaaaacaaaacaaacgattaaccaggtgtggtggagggtgcctgtactcccagctactcgagaggctgaggcaggagaatcgcttcaacacaggaggcggagggtgcagtgagctgagatcgcactactgcactccagcctgggcgacagagtgagactctgtctcaaaacaaaacaaacgattaaccaggtgtggtggagggtgcctgtactcccagctactcgggaggctgaggcaggagaatcgcttcaacacaggaggcagaggttgcagtgagctgagatcgcaccactgcactccagcctgggcgacagagtgagactctgtctcaaaacaaaacaaacgattaaccaggtgtggtggcgcatgcctgtaatcccagctacttgagaggctgaggcaggagaatcgcttcaacacaggaggcagaggttgcagtgagctgagatcgcactactgcactccagcctgggcgacagagtgagactctgtctcaaaacaaaacaaacgattaaccaggtgtggtggcgcatgcctgtaatcccagctacttgagaggctgaggcaggagaatcgcttaaacccgggaggcggagggtgcggtgagctgaggtcgcaccactgtcctccagcctgggtgacagagtgagactctgtctcaaaaaaaaaaaagtgagatgaatacttggacatttttagccccaaatttacagagcatgcaccccattaacagacactctacggggcaaaagctgaggaaatgcagcagggagaagccaagagctcccaaagggaaggttggaattgaaagaagggatgaagagcaggtcagcggtaatgagtgggaaaacctcggcagctgaccacataaatcagtgataacaatgtatgttcaatttaaaaaacataaatcagtgaaaacaacgtatgttcaattaaaaaaaaaaagtcaatacaacagcctgtcagtgacatgctgactggatgagtgtgagacggtttgtgagttggaggaaaagatactgattaatattgggctttgaaaaatttagtcgacgttccttttttttttctttatagagacggggtctcgctatgttgtgctggctggtcttgaactcctggcctccagcgattctcctgcctcagcctcccaaggcgctgggatcacaggtgtgaggccccgtgcccggccagccattgacatttgtaggataaacagtgagctagtaggaagcgtgtactccaaacgagagaaaaggcgaccaagctgaaaaagagcaggagacagaggtgcaggatgagacggtcacagtccatcacacggatgagcaggcaacatcgacctcaatgcaccgagtgctctagttacaagacaaaggtctgactgcagaaagaaaacagcattcacgtacatgggagacacagaggacagaaagacaggagatatatgtgacttaaggacccagaggctacacatttttttttgagatggaaaaagagcaggcagacagtagagaaagctggtgtcgctgtattaacatccatgaagtgacacaaggtgatggacagacctggagacagacaggccaccaaggaacgctgaagaggtcagtcaggggaagacaggctgatgctaactttatccatgcctgacaacgcagcctcggcactgatcaagtaaacaccactggacacaaactgagcccgctaggcaaggcggagcccacccaccccgggcacagacacagggaaggccgggaccacccaccctgggcacagacacggggaaggccgggaccacccaccttgggcactgacggggggaaggccgggatcacccaccccgggcactgacggggggaaggccgggaccacccaccccgggcacagacacggggaaggccgggaccacccaccttgggcaccgacggggggaaggccgggaccacccaccttgggcaccgacacggggaaggccgggaccacccaccccgggcaccgacggggggaaggccgggaccacccaccttgggcaccgacacggggaaggccgggaccacccaccccgggcactgacgggggggaaggccgggaccacccaccccgggcaccgacggggggaaggccgggaccacccaccttgggcaccgacggggggaaggacgggaccacccaccccgggcaccgacggggggaaggccgggaccacccaccccgggcaccgaccgggggaaggccgggaccacccaccctgggcaccgacggggggaaggccgggaccacccaccctgggcaccgaccgggggaaggccgggaccacccaccctgggcaccgacggggggaaggccgggaccacccaccttgggcaccgacggggggaaggccgggaccacccaccttgggcaccgacacggggaaggccgggaccacccaccccgggcactgacggggggaaggccgggaccacccaccttgggcaccgaccgggggaaggccaggaccacccaccctgggcaccgacggggggaaagccgggaccacccaccatgggcactaatagacgagagatggaacaaacaacacaaccaccccatgcgggcacagaagatttacaagcttaatctcatggacagaaatagactcggccccagcacagctgcagagcacacattcttttcaacacacacagctcacttgggaactggccacctctcgggctgagctgcaggtctcagggggttctgaaggaatcacagggactgctgccctgccccaaacgtagccggtgaggccaggcatctacggtaaacacagaaggagcaaaaacagctgcatgtatgtggaagaagaattctaaagccagccgcctgttcattaaaaagttcagacaaaccagaggggcctgtggcggccaggtcatccactttaaatcctcctcagtacgtgtactttaaaaagaacttcgtaaagagcccgtcacccaaagcgcactgataaaggcgacaccctgactcccaacaagctatttctgttgagggcactgagaaggcagctccctgactcatcacaattccagaagtcacagatacatgtgtcgcccttccagagtacacccacagttttgcaaaacacgtccatatacgaccaaaaacaaaggctgagcctaacactgaggctgcctgtttttgcgtagaagtgcgtgcgcttgatgggtgcaggtgagtgtaccccgagaacacaggccacgtgcaccgtgacacatcctctcgcgacaccagcctcgggcagacccccgcatgtgcagagggtgcgcacagcaggcagggcgcggtgaccagcagaaatgaccctcgcccccacggcagcaggaccggacaccacgatcaaagccacagaggaggtgccggagcagcagggggccggcggaagggacgctcagtacgggctgcaacgcacagccgtgcccccaggagcccccgctctgcagcggcccccactctgcagcgggaggcggaagcacgggaggctgtggtatggaatcagggacggggggtttggccgggacgcacactcatggattccagctgagcccctcgcccacccagatgacggccaccccctggaaggcagggcctgctgcaagctctgagcattcttctcggcccagcacttgactcccagggaccctctgagagggctggtagagggctgccagctacacctgcaaaccgcacgctggacggctaaacacaggagtcaaaaaggtcggtgtttacacagaggagccgaacacggagatgagaggccccacgtgtgggtttaaaaatcccctctctagcaaagagggagaactggtgtggaggggtcaacacagaaacgcagcaggtgcaggtgtctgagtaggccagagctcacgtgggctaacattcactcagacacatgactgcagccgagcaaccgggcctcaacggacgctgagagacgtcggctggggcctgcacccacacctgcagcccaggcactggcgcctgcagccacggctgcagcgaggcgtgagtctccacagagctcggaaggctgggctgggggacgtggggatcattctgtccaccagccaaggggtgacggtggatgccgcgcaacacagcgaggggaggatccggcaccctccctgcgtccacaagcccctggcggatgctcctgagcttggtcttctgtgtggacgttcccacccgggcttctgtttcccgttaaccccccttgctgcagctccctgccaggtggggaacccaagccctgccttctccctgccactgcccagggagtggcatcctgggcagcgtcctggccaaaccaaaggctgcaagggttttggtgaccactggccttgggaggggaacggcacgtgccctggcggtgagagcaggaggtgcgtcagggacgcccagagcccaggctgtcaccacgctgaagtcagttccaagtacagcggggctgccgcgtaggggacggcgctttcagccatgcgtggtgccgtgtagggtctgtgcgtccacccgaaggaccccgtggggacgccggacagtgtctgtgtgaccaggacaggtgaagaggggcgtctgtgtgctgagtcagtgtgtggggagcgggagagtcactccccaggcggggagggccaggctaggcagcacagctgtcctgggctgggaacaaggtctgagctgtcctgctgttgcccggggacagaaggcccgagaatccctgggcaggaggcgcaggcagtggctccggcaagaagagctcagccaagcagctgcacggccccactccaggtacatgctgggtcctacagtgagagcatgagccgtgtaacacgccatcgtcacacgggagcctccccggacccacggtgagagtacgtgtaacacgccatcgtcacacgggagcctccccggacccacggcgtgaacgcatgctgttccgttcccaaggccggcggtcgctgaacgcccccaccccccgagtttggtttgtcaaggatgccggtgacagggaagtgggcagtggcagggaggaggaggagcttgggttcaccatcggggcaggcagcacccgccagggggttagtgggaacagaagcccaggtgggacgtcgcacagtcagaagatcaagctcaggagcacccgccaggggctcgtgggtgcggccaacgttggccgtggaaggctgtgcccgtcagaggacccctgaaaacagtaccgtgctgcccggccgggagcgtccgaaggcggaggtgcggcaccccaacacgtccagtggctccaacacgggtgctccctgacaaccctgagggtgtgtccaagtggggtggacccaacagacagagcccacactcatgcgcggagtgaaagcagccaggaaacgtccccttctcccccaacaccacccccacaaatacccccaaatatgcctgtaattcctccaccacccctcagacaacatgcatttcacacgtctgtcctcactccctaaaaacgtggaaacctattttctgtaaaatgaagcaaacttctgtaaacggaattcatgatttcccagaaactgactttttaaaaataaacagtcctcacaggtgcatcgtcaccacagccccccacagaagagccagggccccactgcagggctgaagggcttcctcatccagccacgtgcgagctaatcacctcattgactctgcgaccagcgagcccgcaccgcccagcacctcccaccatctagagcaaatcccgcacgaggctgatctcgctcttcgcaggttaagaggattttaaagacaccagcctcgcccttacccacttacaggcaaaatgtcaaaacctggaagacagaggtcaaaaactccgaaggagtgcaaaagttgatgtgagatcttacagaaaaaatttcaattaaaatatcaacagaaagaagtgggtcttcctcccccttcaagcaggatgccttggttcaccttgatgttaggccactagttccagactcctggaactgagtttgaaaagcgcgtctgatgtgccacgtgggtgtgaggcgcccgccacgcacaccctgtctggatgaaattcggatcagattcggccgcagccaaaccctaaattctcaaattatactgggattgtcacaggaagactcttacacgtttaaatcacatggtactcgtaaaactaactcatacaatatacacggggtacagacacaaattttacttccctgagcacttatgagaactgagattaaatttcaaagccagctggggtggaggctcacgcccctactcccagcactttggaaggcccaggtgggcgatcacctgaggtcaggagttcaagaccagcctggccaacatggtgaaaccccgtccctactaaaaatgcaaaaattagccctactcgggaggctgaagcaggaaaatcacttgaacccaggaggtggaggttgcagtgagccgagatagcgccgctgcactccagcctgggaaacagagaggcttcgtctcaaataaataaatataaataaataaatttcaaagccactgagttactgaataaaaccacgctgcataaatagtccggtatgtgagtgatatctcaaccgactcttaagttagccagtgggaaggaatgctgggtattgcaataacgccgggaaagtttcacccacccgacgcctttacgaagggtgaaggagtttcccgatgtttattaccagcaatgcaaggtatatttaaattaaaaatctgtctgcagcgaacactcccaggcgctgacggctctcacccgccttggttgatcacagcaaggcgcgcactcacagccaaaactcccgggaaaggagcgagtgctcttttcaaagcccggttttcctaacaagcttggcaccgcttcccacagagcagcacccggttttcggcggcgtgcggcccgagcgggtcccctgcgcccacaactggccctgtaaatctggcgtttgggccccgccacgcaacaacgggtgcacggccagcagcggcgagcgggggcccacgcggggccgggagggcagggctcgccgggccgggaggcctcgcccggtgtcgggcagccgcggggcgcgcggggctgacctgctggaaggccttcagccgcttcttgaaccgagagggcagcacgaagtcgcagccgcgggccagtgaggccagctcctggcgcaggtcggggtcctggcgcagcgagcgctcgcggagtcgcatgccgccggcgcgcagggctctccgcgggccgggccgggcgccgcgctctcggggcagggccgggccggggccggcggggcgctgcaggcgtggcccgggctcagcgcgctccatgcgtcgcccgccaggcgctctggggccggggcccgcgccgcgcgcattcctcaggctgaggagggcgcatggcgccgggggtgggggcggccgcctctcccgacccgcgactgtgcagacccggctgctcccggcgctgctctcctctcctccttctccgctccctgcactgccctccgctccctccggtcctcttctctcctctccccgttcgctccgggctgggccgtccggccgggcaagggggcgctttctgcaccgcggcagccgtcacgtggctcgccctggagcgcgcatcaacaggtccccgagaggagagcctgggcggaacgcgcatcaacaggtccccgagaggagagcctgggcggaacgcgcatcaacaggtccccgagaagagagcctggggacggcctcggggacccaggcgaaggcgctccccgcgagaagtgaggtcccccccctccacgacaacaccagagctggctgcaggctcggtgccgactccggcttgcccctccagagcacagggcacgccaggtgcagctgcgcctccacaaacacgcacggcagcccagacatcccggcagcccggcatcaaagcgcgccggcatctccgcccctccccaaacttcaggagtttctagaatacagctaagctgcagtgggcatccaggatctcgtcttctctgccactgctcactgtgataactgcgcttgtttgcaatcgtatttagaacaagaaaagaggggcggtggaaaagggggacgggcaactttaaatgagggtgagctgacattccgggggcctgcacctcgatcccaccgggaaggagacaggataccttcgggctgagggtcagaaactggccacatccctgccaggctgaacgctgtcagcagaaagcctcccgggtccccgatcaggaaggtcctgcgtgaccgcctgcatctgttacagtcaataaacctccttggacgggtcactatcaccccgagtcaacagcgtgcactgggctctcccgctgccgcacgctctgttgagtctggaaaaacgcaggatgacacggatctaccactgtggggtcacgcagaggagtttccctgccctgaaaaacgtctgtgtggcactgacgcacccaacccccgcaagccccgatctgtttcctgtctccatcgttttcctttttccgagtgtcctagacttggaaccagaagtctgcagccatctcagactggccttttcttctcctgcaaccttccacaccacctctgacgcccaccacagccccccacccgcaaggccccttccaactcttcttaggggtacgcccctctccacttccttctcttccacctccttcccttctccagccatcctcggatccctccatccttctcacttccttactgtccttgaggattcagaagtcggcctctgacccccggtaagtctccaaagggaagctttaagacagcaccagagggaatgtgctcaaaccaccaggagacgatttaaacaagtgcacccagtaacccacgatgcggggcgcaaactcacagggcagaggtgccgcccagtcacccacgatgcggggcgcaaactcacagggcagaggtgctgcccagtcacccacgatgcaggatgcaaactcacagggcagaggtgccgcccagtcacccacgatgcaggatgcaaactcacagggcagaggtgcggcccagtaacccatgatgtggggcacaaactcacagggcagaggtgccgtcccgtcacccacgatgcggggcgcaaactcacaggacagaggtgccgcccagtcacccacgatgtggggcgcaaactcacagggcagaggtgccgccccttcagttcatatcagcactacacacggacggcctcccaaacgcagctaggggaaccagattgggagccaacctcctgtgatctccctccgaaagtcaaagatcaaacccaaaatgcgggggaagcgagccaacgggcgcgatcctcacactcaggcaacatgccctgtcctgccacgccaggtgacacacgccctgtcctgccacggcgggtgacacacacccctgtggactttactgccaggtttcctctttccgtacaagacttttggaacacagccaggcacagtggctcatgcctgtaatcccagcactttgggaggtcaaggcaggcagatcatgaggtcaggagttcgagaccagccaggccaacatggtgaaaccctgtctctactaaaaatacaaaattagctgggcatggtggcgggtgcctgtcatcccagctacttgggaggctgagggagaagaatcgcttgaactcagaaggcagaggttgcagtgagccgagattgcgccactgcactgcagcctgggggacaagagcgagacttcgtctcaaaaaggaaaaaaaaaaaaaaaagacttttggaaaacagcctcaaaatcctgaagtgcacacataggcagagatttagactctgacctggagccctcgaaccacctctggatgcagtcccactgcccccctggagcccttgcgtcctgtcccgatgcagaacccgcaccacccgcccccagtgcagccacagggctgtctacaccggatgggggagggacagggctgtccacactcgacagagcccccatggggccatccactaccgtgtacagggacgggccgtccacagtggggccgccatggggctgtctatacactactgtatgcagggacgggccgtccacacccagtggggccgccatggggctgtctatacactactgtatgcagggacgggccgtccacacccagtggggccgccatggggctgtctatacactactgtatgcagggacgggccatccacacccagtggggccaccatggggctgtctatacactactgtgtacagggacgggccgtccacacccagtggggccaccatggggctgtctatacactactgtgtacagggacgggccgtccacagtggggccgccatggggctgtctatacactactgtatacagggacgggccgtccacagtggggccgccatggggctgtctatacactactgtatgcagggacgggccgtccacacccagtggggccgccatggggctgtctatacactactgtatgcagggacgggccgtccacacccagtggggccgccatggggctgtctatacactactgtatgcagggacgggccgtccacacccagtggggccgccatggggctgtctatacactactgtgtacagggacgggccgtccacacccagtggggccaccatggggctgtctatacactactgtatgcagggacgggccgtccacagtggggccgccatggggctgtctatacactactgtgtacagggacgggccgtccacacccagtggggccaccatggggctgtctatacactactgtatgcagggacgggccgtccacagtggggccgccatggggctgtctatacactactgtgtacagggacgggccgtccacacccagtggggccgccatggggctgtctatacactactgtatgcagggacgggccgtccacagtggggccgccatggggctgtctatacactactgtgtacagggacgggccgtccacacccagtggggccaccatggggctgtctatacactactgtgtacagggacgggccgtccacagtggggccgccatggggctgtctatacactactgtgtacagggacgggccgtccacacccagtggggccaccatggggctgtctatacactactgtgtacagggacgggccgtctacagtggggccgccatggggctgtctatacactactgtatgcagggacgggccgtccacacccagtggggccgccatggggctgtctatacactactgtgtacagggacgggccgtccacacccagtggggccaccatggggctgtctatacactactgtgtacagggacgggccgtccacacccagtggggccaccatggggctgtctatacactactgtatgcagggacgggccgtccacacccagtgggtccgccgtggggctgtctatacactactgtgtacagggacgggccatccacacccagtggggccaccatggggctgtctatacactactgtatgcagggacgggccgtctacagtggggccgccatggggctgtctatacactactgtgtacagggacgggccgtccacacttgacaggaccaccacagggctgtctatacactactgtgtacagggacggggccgtcatagcattgtttttgcaccacaggccagcacggaatctgcgaggcctgttttcagcctgttccccccaaattcctactctgaagagacaacattgccatctgggccgatgaagcccctcacggcacccgaatctccaccgtccctctgctgtcgggacacaatcttaccatcaacctctaaaggctcctaaaatgcccagaagacctttatgcaaaattttcataaaaatctcttcacttttcattctcactaaacatacatttgttcagacggcttgttttaggataaaaatgtgtcttccatgagcaaacataatggcttttctgaaatcccagatttgaaaggcttacgaaggcgacctgccctttgtgagaaaaagtttttctgaacatccaaagctaaaagcatagctagtaacaggcaagcctatgagacaggaagatggcccagaatcctgtcctcaccctgcaggtgccgtctgcagagcacggcttcctccctgtttcaaaggccctgagaggacaggctccagcggattcaaaacccgtccacctcatctcaggaaacggcatggttctctctgtcaacagaaggggagggagggatgaagctctttacacagtttccatggttgcagattctcggaggttgcaagaagggttttcgacaccttccttcctcctcacaacgagactctcatcggtgcccactatgaaaacgtgaataggtcgttgttacgaaggcagtgagaactgaacgcagacaggcacgcacctgtacaaaagctacagtccctgggcaagctcaaggctcccgcacgaaaccttcagaaaccctgagctcctgccctgagggttctaggtgcttttgtcttacaacatgtttgttaagaacttctaatgaaacgttaagataaccacacctgtatgtacatgcacctgtgtgtgtgtatgcacctgtgtgtttgtgtgtatgcacctgtgtgtgtgtatgcacctacgtgtgtgtgtatgcacctgtgtgtgcacctgtgtgtatgcacctatgtgtgtgtatgcacctatgtgtgcatgtacctgtgtgtatggacctatgtatgtgtgtatgcgtgtgtatgcacctgtgtatgcacctgtgtgtatgcacctatgtgtgtgtgtgtgtatggacctatgtatgtgtatgcacctgtgtgtatgtatctgtgtgtatggacctatgtatgtgtgtatgcgtgtgtatgcacctgttatgcacctgtgtgtatgcacctatgtgtgtatgtacctgtgtatgcacctatgtgtgtatgcacctatgtgtgtatgcacctgtgtttgtgcatatgcacctgtgtgtgtgtatgcacctgtgtgtttgtgtgtatgcacctgtgtgtgtgatgcacacgcacgcccgtgtttatctccaaataccctgttctaatgttctagaatgctggcacccggtctgataaaaatcacaggttaggtggacaccaaaactgagtagcttccagaaattagagaagaactaaataaacagatagaaacttaatcaaggaggtgcaagaggtgtacccggggaagtacacaacgttgctgaacaaaacctaaatgaatggaaagtcctttgtttgtggattggaaaatactgttaaggtatcaattatcctaaattgatccacagattcaaagcaatcccaatcaaaattccaacaggcttttcttgctggaaagcaatttttaaagaacaggcttggactcacagtatctgctttcaaaatttgctagaaagttacactaatctggaaagtgccatgaaggtgaggggatgcacatacagcaatgggatggaaataataataaaacagacgtacgtactcaactgactttcaacaacacaattccacggggggagaaaagactgttcaatatacggtgctggggtcatccagatacctcacctcataccacgcagaaaaactgacctgaactggatcacaggccgaaacgcaaacctaaaaccacactgctttctcaagataaataggagaaaatatttgacaccttgtggtatgcaaacattttgtaataagacacaaaaaataagagtcataaaagaaaaaagttgaaaaactaaacacttttgctctttgagacactgaagaaaacaaaaagcaagccagactcaagagacatatgcacacaccacattgtcttaccaaggacttgccaacagttgtatgtaaagagctctcgcaactcagtgataacataacccaatttaaaaagcaaacacacgacctgaacagacgctcgacagtgggaaccacatgaatggcaaataagcacctgaaaattcctcggcgtcaccaggccgcagggaaatgcaatcaaaatcgtgcagtactggccgggtgtggttgccctcgtctgtcatcccagcactctgggaggctggggcgggtggatcacctgaggtcaggagttcaagaccagcctgaccaacatagtgaaaccccatctctactaaaaatacaaaactagccgggcgtggtggcgggtgcctgtaatcccagctactcgggaggctgaggcaggagactcacttgaactgcaggaggtggaggttgtagtgagccgaaattgcgtcattgcactgcagcctgggcaacaagagtgaaactccatctcaaaaaaaaaaaaaaaaaaaaaaaaagcagctcatccacatgaggttcttaattccccttgtaagaacttactttaaagatgcatttagggtcccccctagcagaagcaccctggcttgcagcatcagcccatcgatactggcgttttctttcttttttttttttttagagacagagtctcactttgttgccccggcgggagtgcactggcacaaacatagctcactgcagcctcgaactcctgggatcttcctgcctcagcctcacaagcagctgagacttcaggcatgaaccaccatgcctggctgattttactattttacagagatgggggagtctcgctatgttgcccaggctgggctcaaactcctggcctcaagggatcctccctccttggcctcccaaagtgctgggattgagccactgcacccggccaatgctcacattttctaatttgtaccagtttctcttccccaaagacgggaaggagccactgcaagcacccctttcaaacacagaatgcaatctctctgctcagtaacgatgaaggcgtaggtaacgtaaaacaatgccgttcctttcacccttggctggggagttcaatggacctagcgtgaaccctcctgacagctcatactccattctgtacatgtgtgggtgagaaaaagctgctttatttatgaaaatctcttcctctgaccccagcatcgcccctccccagccagagtttgtagcatggaactgcatccttcactgttaacgtggcctcgcgtattctgtatatgggatggacaggaacaagctcatctttttttttttttttttttttttgagacagagtcttgctctgtcacccaggctggagtgcagtggcgcgatctcagctcactgcaagctctgccacccaggttcatgccattctcctgcctcagcctccggagtagctgggactacaggcacccgccaccacgcccggctaattttctgtatctttagtagagacagggtttcactgtgttagccaagatggtctctatctcctgaccttgtgatccgcccgcctcggcctcccaaagtgctgggatcacaggcatgagccaccgtgcccagcccaagctcatcttttttgtcccaatgaacagacacatctttctaagttattcacttcttgagattcagctgaagtaagccataggttccaaacacgtagacatgtttaaggtaaacttttagtcccaaacaaggtcagtcactgctttttgaaaattcttgccatctcctaagtgcagaatcctgcaccctgcacaccctggccgccatgcccacggtccacacgcatccttccttctgcttctccggtcagaccactccagtccctcaacgtgacctgaacatctcatctttttttttcttttttttttttttttgagacagagtgtctcactcttgtcacccaggctggagtgcagtggcacaatttcagctcactgcaatctccgcctcccaggttcaagtgattctcctgcctcagcctccagagtagctgggattacaggtgcccaccaccacacccagctaatttttgtatttttagtagagacagggtttcaccatgttggccaggttgatctcgaactcctgacctcaggtgatccgtccacctcagcctcccaaagtgctaggaattcaggtgtgagcgactgagcctggtctcattttcaccgcctcccttggtcctgccccctatacccaataaactcagtgcatttctcaagttccactactcacttcctcctcaaaactttctccaggagagaaatgatgtctccctgctttgaacacctttggaacttaatttccacttgttagaggcttcttgcctgatttacagaatatatcatcctctcacatgcacccaaatggcctcgtttgcacagacctgaccttccgtcaatattcccagccctaggagaattcatgcaaagtcacaatagtcccagccctaggagaattcttgcaaagtcacacaattcaagcatttaccttagcgtctggctgtcattcaacacgtttaaggacaaaatggcagctcattagcgatcccactgagaaagcaagtcatggaggggaaccatcattactagcacatgcttcttgagtcctggccctcctctcaacctcctcagtaaatgagggatttgggcaagagttcctaaggtgcttcaggttttgcagctcactgggaaagtgcactgggccggagctcaagagatgcgtcctggggccctgagtcccctcctggatcgggatctggagggcctgagccagacggtctccaagctgcctctagctctagttcacattttcatcgacacgtacttttggaaaatgttctagatccatcagaagacatcggacaaccaccggtaatttagaacgcaaggagctcacctcagattgccacccacctctcactcagcaagtagagaggctggtccattttggctggaaaactgtggtgctacgtaaatatcactttgtgacatgcttattagtgctgctgatggaaagctggtgttcagctgaaaattttcaaatggtataaacaagttccgacggaacattctgaatatttcaggcttccgtagtattctcgggacaccagacgcaccagccatacgtgtttctataacatctggaagcaatgttttatcgctttaaactgcatagtataaaacgacagaaagcatttttaaaaatacacggctgtcggcgggcacggtggctcacacctgtaatcccaaaactttgggaggccgaggcgggcggatcacgaggtcaggagatcaagaccatcccggctaacacggtgaaaccccgtctctactaaaaatacaaaaaaattagccgggcgtggtggcgggcgcctgtagtcccagctacttgggaggctgaggcaggagaatggcgtgaacccgggaggcggagcttgcagtgagccgagatcgcgccactgcactccagcctgggggacagagcgagactccgtctcaaaaaaaaaaaaaaaaaaaaaaaaaaaaaaccaaaaaaacaaaaaaacaactaagttcccagtcatgactggatgggagtttggacacaccttattatacccctcctgctttggcagtttaaacacaaccaaccagcaaaaaggttaaaatcaacatcgtaagactgacagaacagactctgtggcaaacaagaccaagggccacctgaggtgagggttaagtcacacaccgcctacacttaaagaataaactacagttccaactgccaaagcatttctttttctccagcagctaaatgtccttttaggttattcactagagacctctgcagaaactcgtttttgagattcaagaagtaaataaaggatgtttttctttttctctattgcttatcttggcctcaagctcgcgcacgcaagaagactctctctctctctctctctctatatatatatatatactttttttttttttttgagacagggccttcctctgttgctcaggctggtgagcagtggtgcaatctcagctcacagtaatctccgactcccagcttcaagcatttctcctgcctcagcctcctgagtagctgagacttcaggtgcgccaccacgcctggctaatttgtgtatttttagcagagatggggtttcgccatgttgcccaggctggtctcgaactcctgaactcaagtgatctgcctgcctccaactcccaaatgctggaatcacaggcgtgagtcaccatgcctgaccaatataaacaatattaaaacacctgcagcttcctgtcagatcctgatgaacagacccctctgttccaccagccgtaactacagctttgactgggaaaagactgattccaggccaggtgtggtggctcacgcctgtcatcccagcactttgagaggctgaggcgggtggatcacctgaggtcaggagtttgagaccagtctagccaacaaggtgaaagcctgcctctactaaaaatacaaaaattagccgggggtggtggtgtgcgcctgtaatcacagctactcgggaggctgagggaggagaatcgcttgaacccgggaggcggaggttgcagtgagctgagattgcaccattgcatctcagcctgggtgagagtgagaatctgtctcaaaaaaaaaaaaaaaaaaaaaaaactgattgcaatcactttatcctggtaactactcaccacggactggttctggccggttgacagaggctgcagagttgcttcaccttttgacctagggggcctaaccataatgcatttaaatgttaagtctccgctccaaggtgaactcgggagtaggtaacatgcatgtttgttcaatacccatgcgtcaggacacccttggtgaatatccatagctcttcctataacttcttgaatatatacacttggccaacccactcagcataaattcccgtctcatcttttcttccctccaagtgcttgtttttagttttcttttttttttttttttttttttttttgagatggagtcttgctctggtgcccaggctggagtgcagcctctgcctcctgggttccagtgattctcctgcctcagcctcccgggtagctgagattacaggtacattagccagaggctgcgcttctcacctgcggtgtataatcaccttctatgaaataaatggcgtttcttctaagaaatacagtgggattttgggaggccgaagcgggaggattgcttggacccaggaattccagagcactctaggtaacatagcaagacctcgtctctgcaaaaataaataaataaataaataaacaaaaattagcctggcgtgatggtgcacgcctgtaatcccagctactggggaggctgaggcaggaagtccaactgtgtttgcgccactgcactccagcctaggagacagagcaagaccctgtctccaaagaattgtaaaataaataaaaaacggaccaggcgcagtgactcacgtctgaaatcccagcactttgggaggccaaggcgggaggatcacttgaggtcaggagttcgagaccagcctggcccacatgggggaaacccagtctctactaaaaatacaacatcagccaggcgtggtggcacgtgcctgtaagtcccagctcctcgggagcctgaggcaggagaatcgcttgaacctgggaggcagaggttgcagtgagccaagatcgcgccatcgtactccagcctgggcaacagagcaaaactctgtctcaaaattaaaacaaattaaaataataaaataaaataaaataggaagcctttctacctttataaattgtgtgatttttaggttaacaactgtcaatgacggaatgttcagtacgtgggactttcttgtctgtatgtgtgtggtggggggggtcggggcggggaacagactcaatatgaaaccgttttggggtctgacgctcgcccaccagcctccatcgcgcagccacacgcccactatgcgaccagagccacctgcgcagttgttagcagaaggaagagtaacttactactctcgtccctgcggatctacgggtgcctcgaacgtggggcgcgttcctggggctggaggcggcgcccaggggcagcgcagggcccggcccgggggttcccgggggttcgagcccgctgggccggggggcggcgagcggggctgtgggccaggccccgggctgctccccgtcccccggggtcggctggtcccgcccgggcgccttgatccggcgcaggcagtcctgcagcatccgctgcgtgctggcctcgctgagccagtacaggaacagctcgtccaccttcatcttcaggaccggctgcagcactttgccgggcggcatggcgggggctgggcccgcggcgcccccggacgcccgcgccccgccccgccccgggggcttcggtccgccccggaccgacctcggtgatgcgagcacggcccgctgagggggcgcggcgcagggaacagggcccgcgcctcgggaactgcgcggactcgcggggcgcggggaccgaggagggggcgcggtccggcccgcgctgctcagggcagcttcaaaacgggcgcgccggccgcgctcccaaacaagggcgcccgcgttcac

SEQ ID NO: 446 - DNA, 1882 bp, Homo sapiens
  source 1..1882: mol_type = genomic DNA
atgtggacactgggagaaggaagtgagatggaaaagttctttgattgcatccaagaagtgaatggtcctcaaggtgcagcagaggaatttgtaggagagagggatgattgattgacggctttttttttttttttttttttttgaggcagagttttgctcttgttgcccaggcttgagtgcaatggcgctatattggctcactgcaacctctgcctcccgggttccagcgattctcctgcctcagcctcctgagtagctgggattatgggcatgcgccaccatgcctgactaattttgtatttttcgtagagatgggttttctccatgtaggtcaggctggtctcaaactgccgacctcaggtgatccagccaccttggtctcccaaagtgctgggattacaagcgtgagccactgtgcctggtcaactgacgtcttcatatagccctccgtctatcccagttagcatggagggattttaggtaggtcatacagaaaccgggtaatgatggcaggtgtggaggaacagaatgtaccactgaatgggaggtccgggggaaacatgtggcggaaatatcctcccgtgccacgtgatctgccaaaattgaacacggggagtttaggaggggtgacatgtcagtttgggaactatctttaggggtgctaacccaaatctccctttctccaattagagcaccctgccttcctcattagatgtcacccccccccccgcccccgacttcatccgccatgtcctgatggtgctttgtgacgtataaggccttccttcccgcccagggcgaccattggctgggtagtggagtgttgaccaatcacagctcaggggcgtgattgtctcgtcctgggatcgcgagaggggtatatacagggaggccaggcagcctggagttagccgaccgttgcgagacgttgagctgcggaagatgagtccaaagccgagagcctcgggacctccggccaaggccacggaggcaggaaagaggaagtcctcctctcagccgagccccagtgacccgaagaagaaggtgagtgaccctcccaagctcctcctcgtcttcccctcgcctccttcctcacaagaagcctctcctgtcctcacttggcacaaccccccaacccggcccccaccgcttctgaggacacgtccctgttcccagcctcctccatcctcgtccctaaaccggagcccttctgtgatctccctgttgtccttccagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggaggccgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaaccactgagtcaggagagccaggtggaggaaccaccgagtcaggagagcgagatggaagaactaccgagtgtgtagacggccaagtactcccctatctccgagagcagcgactaagttcaggcccagccgccagacctcagagatctcaccagcggggtgcttgccattctgaagataataaaatgaatgtgttgcaaattga

SEQ ID NO: 447 - DNA, 28672 bp, Homo sapiens
  source 1..28672: mol_type = genomic DNA
cttaaaataaaagttaaaaagaaaagtaccatcctcccacagggtcaaatacatatgtagtcgatacaagatacttcaaaaaagtcttatacaatgagatttggttttgcagcttaaatttcttcaatttaagggtacatcaacaaggaatttattgaaatacagtgtatcatacaaatagaatattcacatgaaatgatcaaaggaaggggtaaggagaaaagtattaaaactgaaaatttacctagtgaataagtggacataacaattgagaatctatccacttcatgtcacttatggaaacaacacattaagattaaactacatgtttgctagagtaggagaaagtatataccacagggaccatcattactctagagtgggtctatgcataactcctcaaaaagaggccatcgttggtgtttatgtgctaaaagttgtgtattttggcttctgagaaccataaaattgactcaaagaatagtttcaaagagtaaaagaagaaatgcgtgacaattgaagacatggaattaaattggtttgtctctaactgcctcttagtaatcaagagttcttgcttggcaaaacctcataaaaacagatttaggatttaagacagtgtcagtaaattggtacaagcccatacacaagtcctcaaagtgatggacaactactcagaaagtaaaaaacctgggatcagtacaacgtgatttaaaaatgagaagtgaatgattattctggatttaattcttatttactaggctacttggttctttgtgtttagtagtattttatctatttaagttcccataatagatgtatccagtatatagaacaatagctaaatactcagagaggtatggcgagagagagagagagagagagagagagagagagagagagagagagagagagagaatgaatgacaaccagcttgataatctcctaaactggggtggggtttaggggaggaagatgagaggggataagcctcttcaaaatctcctaggcttctggatatctgcccctaactgcactgggagcaactgcacacacctgtggaaagcaaactgttatggtttggctgtgtccccacccaaatctcatcttgaagtgtatgtagctcccacaattgccacacgttgtgggagggacccagtgggaggtaactgaatcatggaggcaggtctttcccatgctattctcatgatagtgaacgagtctcaagagatccgatggttttataaaggggagtttccctgcacaagttttcttctcttgtctgctgccatgtgagacatgcctttcaccttccaccacaattgtgaggcctcctcagtcatgtggaactgtgagcccattaaacctttcttttgtaaattgcccagtcttgggtatgtctttctcagcagtgtgaaaatggactaatacacaaacctttgttcctccagtcctgatcaaaggtctttaaccatgagttgcctatttctcaaatccttcctctcctacctagttccttcagttccagagctacagggacacagctaagtcacggaaacacccatgcttcacgtcaagatcatgccacatattctccatggaacctaagtggtggccctccattttccatgttcctcaatttacccaaagaacctatcctcctccattttttaaaggacacaacagttcaccaaaaatgattccttatcacctaagtgtatccttcttaatgacgttgtcaaattctaataaagtgcctcttatatccatgtgctaagtaataattcaaatattaaaaataaacacaaatattacaaggagtaatacaattgagtcatgatagattttctaaaaaggatttgattagaaacttccatcaaaaactatctaaaacgtgttttgcattataaacttttatgcattttattcaaaccaattttctttaagtaaaaacttaacagtgtcatcaaaaccacactgatacaaagattccattttcctcttgcttgggggaaaaagggcttggttgagtctcaccaggtttgccagggacaactagaataaaaagaccaaaatttaagctgtaggatattgcagtacaggtaaatatacactatttttataatctaggttttcttatcacagatacaattagcagtaacaaaaaatcagtaggaaaaatttaaacttcagaagttacctccactgatacactaaaggagagtttctcagccttggtactgctgacatttggggccacgacgtcttaactgtgggacagtcatgtgcactgcaggacgtttaacaccattcctggcctctacccaccagatgccagtagcaccactgggacatgataaccaaaaatgtctagtacaatatcatcccatgtggaaaactattagactagattaagggaatcagtatttttatgtcaattattcatttgggtccctaagtttttctccactatttttatatatttcattacctccatctttctaagcaaataaatgattttatttaaaattgctctgggccaggcgtggtggctgaggcctgtaatcccagcactttgagaggccgaggcaggtggatcacttgagcccaggagctcaggaccagcctaggcaacacagtgagactttgtctctgcaaataatttttttaaaaaagtagttgggtgtggtggcacgcgcctgcagtcccaggtacttgggaggctgaggtggcaggattacctgagcctgggcggtcaaggctgcagtgagacatgatcttgccgctgcactccagcctaggggacagagcaacaccctctctcaaagaagaaaaaaattgctctgatatcctaccaagtttattgatgtaaaaaagaagtgaagaaaaagcagtgacagttaataagcagcaaaaatgggtgggcgtggtgcatgtctgtaatcctagtgctttgggaggccaaggtggaagaatcacttgagccagggagtttgagaccagcctgggcaacctagtgaaaccctgtctctacaaaagataaaaaaattagccccgttcctatggctgatacatgttataaagtattaaacaacacactaaggagaagatgcaactcctacctacaattatcaatgaacttccagtgcttgggaaacacgttgaattctgtgggaatttttagtagatcagaactcttcaaatatcactgaacataattactcaccatgatatcctgcttggcgatattaacatacagatctagctgccctttgtcctgcggggagatgtccagtcgtccactgaagggggagatggttactgtccggccgacgggcaggatgggaagagcgttggtgaggcctccgtccacccacttctgtggaaagaaacatctcacgtcagcacacgtcaacaacacatcctgcacaaagaaaagcagcttctaataatatgtgtgccttggatatgcttttaaattgctatttttgaggactaatcccattggggatctgttctgggggtaaaacaaatcttggtacacatatcacttaccaatataagaacaactctggacagaatttaactagattattgtctgtaagacttgaattcttactgactacagtgcatgcttaagaagccatgtgtaattagattggggttcattatttaatcaaactaaaaagtcaaatttactgtggatgctgaacaaaacatccaccagcagaggaggttccatttttattatatgaattggaaactggcattttctgtggcaaacttaaaaagtaaatacagcaactagaaatgcttctaattccaaagtggttcctgtgctcttgaagcaaggggcatgtcctgaagccataaggaatgggagtgctgcatcaaagcacacattcctcagtaggcactcagtgctctcaagcccaccgcaaaggggagtgagtgatggagaaggcggaggacagaagcctcccaaggaagaaaatgaaagagtcttggggcaatgaggacggacaatgaggtgctcaaggtgtgtgcagcctcagcccctagctctacagaagcgcacaatgagaaatggtgactgaagaaccacacagacaatattccttctgctgtctattccaaggccaaacagtctcaatgcagccatgatctgatgtattcacatgatcagctatagcactcaataaacacaacacacatggaaataacacccaaattgtctaagtttatctgttattaaaaatagccttcagataatatacaaaaaaacaaaaagtctggtaacagttgaaagtcctgtatgcaggaatctttagtgaagtttgtaaactgagttttgcttcaatgtgtaaaatgcaatgcagataaaacaaacctttgttattcaacataaaggtggcaagaggagggagaaacaggccaaaataaaatgttctcaactcacttaaaaccatgcatttatttcttccaatgtgtctttttcatgtccttcttgtgtttatttatttatttatttatttatttatttatttatttatttgagacagagtctcgctctgtcgcccaggctggagtgcagtggtgtgatctcagctcactgcaagctccgcctcccaggttcacgccattctcctgcctcagcctcccgagtagctgggactacaggcgcccgccaccatgcccggctaattttttgtatttttagtagagacggggtttcaccgggttagccaggatggtctcaatctcctgacctcgtgatctgcccgcctcggcctcccaaagtgctgggattacaggcatgagtcactgcgcctggccaattgtgtttatttctaaagctgatgacaaaatgagtggtattacattatttacaaaggctctggacagccacaaactcctccaaaggaaataaaagtaaataaataaaagataaaaatgggttgaaaattccttttgagagaattgcattttggtggaggagagagtataagtagattggattaaaataaaactgacctgcataatttgcatattgtcattatttttaaaagatataaagattatgatatattatgtgttatgtgtattacacatacttatttatatgtgtatgtgtatatgcatgtacacatgtgtttgtgtatgtgtgtttatatatgtacccatatgtatacataaaatatagctggttatgtaactgtatgatctaaaagggaggtttgcaaaaaaaaaggctccaaaatatctgattctgtcccagaacctgctttttttccctgattgctttaggtgtaaatatcaaattctggaataggataatacccagaagggaaaagaaagacagcttccaaaattatttcatattgtcaacagaagctgtcatcaacgatgtaaaaattcatacaggtttcatcaagaaaaattaaagatatgcaactttaagtaacagctcttctgatttattcaacttaatgaaaagaagggcaatctggctcagtaaattaaaaagtgttctaatttactgtggggttaatgactgctgttttagggaatcgaaaatcctttttccaaattttgttcactcttgttagcttattctgattagataaatgacaagggaaaatgtatagcagcttatcaaatcacttgattaaacttgcaatgataccggctccttcacaacccttgatgctatagccccactgctcagatatgctaaatgtggtacctcttactcctgatttatgctctcacgagctgtatcacttaggacaatcacacattcattcgggcatacagattccagcagtttctggaaacaaccgtcacaacaacaaatattcttcaacctccaaattaaaagtagaaacattttatatcttgtgctctactgatagtttaaaatcttgcatagtaaacacttctgcccatgaattctctggctgttcacaacatatggctgtgagtcattcccaccttcttgcttcatgggcagcattttacatgctggtagctacttccatgagcttctgtgactccaaaattgtccttaagaaaaatagctgctggtctaccccgttagagttttcctgtgtgtttgtcagttttcatcacatatcaccatcatcctcaaaggaaaagggagagcaagtacataaaaattccaaggcaaaatagtttcaaaatcatactcgttacaggctgtacagtgaccacctctcagtcccactgctagacctactactcttttctctaatctttggccatattctaaatgtgttccacattcaagtcaatgcctgagtcctaagacatagaaataagcaactgctcaatagaaaaaccaaaaacaaaacaaaaaaactcatgcccaattgtggggcagacatctactgtgattgttctctgaaagttatagcactgaaaactggaattaatagaatcacttctaaagagataaggctacccattacacctaaacaggctagaatattcatctggcagtacttgttaaacttcgctttagacattcatgtgttatgggtagctattgagaacatgccttatgaattcaagtaactgctattacataacgcaagtggaaaacttaagaaaggacctgatgagttaacctgtactgaaagggccagtttattcattcagcaagtgatccctgagcatctagtgtgtgtctggatgtatggtagatgctggggatatgtttttgatagaacttccatgaagggctccattttcttaaggtatattttgctcaaaaaacaagtgaataaaaaatactttgctggaagaatgaatgttgctatctataattattataaataccatggcagagggcctagtagtttaaaagtgatttcacatgtataatttaatatgcgaaccctgtaaggcagaaaggtcatgcttgtatattcagttccctcatgttacagaagaggaaactgaggcttgcaggtttccttgctatagttcacggggtggtaaactacgacccaccatctgcttcagtaaataaaattttattggcacatgaccaggaccttttgttgagatattgcctgcggctgcttccctctactacagcacagttgagtaggtgtgttgacagagacaatgttgaaagcatttgctatctgatactttacagagaataaaacatctattgctatagaatatacaggcaagaagggatagttgtcttttcacttcaggttttttttctcgcacactgtaaaattcagggatgctcgatggggcagggcaaattagaactgatttctgaggggtgagaaagaagtaaatgtgctttgaacaataatttcttatttgcaaacatatctgcattgctttcatgagatagcctacagacagcaatgcccaacaatgctcttgattagcaattcctaaaatagaagggagagggaaagagacaaagagatatccacttccttagacacaggtgagaatcttccaattacggtgggaagaagagacagatgagattttttaatcaaagaaagacaagtaaaaatacaattctaaaagagaggttgagaaacctgccatactaacctctactaagcattgattcttggtgcattgctttcttggtttttgcatgtgtgaaggatgattaaaaatgatgactccagatatctacttttgagaaggctctaaagggttaacagttgaccatctataaacaccatacagaaaatttttcctagaggactaacatgttgtttcaaaaattaaacagacagtgcaaaaaaatctaaaaagtgactgaagaataagagcgtctatttcagaataactagaaattgatatccaggtttccatccagccaaatctagctggtggcaaggccagctaccactgtttgctatgacagtgacagagctgcatttccatgtaaaaagtctaagccacgaggaaatagaagcctaaggaccacagtatcaacctcatataaaagcacagttacatggagtattccacaattctctttcccacacaagtgtcaataatgaaaggaaaaatgacccatatccgcatggactagggtaatacaacagtgcattttcacgttcctgtaatagtatatacttaatcttaaccaaaaggccaagaagcgatcttgtaatactacacagtcaaaatattacttgaattccaactcagatgaaagaaacaatgcaaaatcctacagcttttcttttcttttttttttcagacagagtttcactcttgttgcccaagctggagtgccatggcatgatctctgctcactgcaacctctgcctcctgggttcaagcaattctcctgcttcagcctcccgagtagctggaattacaggcatgcgccaccatgcccggctaattttttgtatttttagtagaaacagggtttcaccacgttagccaggctggtctcgaactcctgatctcaggtgatccgcccgcctcagcctcccaaagtgctagaattacaggcgtgagccactgtgcccagccaaccctacagcttttcttctgatctgcatgtgccagttctggagatgattttattctgatattttagtcacctgccaatgctaattctatctcttaaaacaaatgagttaagaattcctcttgaaaattttcattcttattccaaattgacaagaatctgtgaaaacatggcctaaatgtgtgaacattcctgtggatttattctaccactggaaagagttcatatgtagtaaagaaaaatcattagtcaaaaatataggactaaacttcaatttatttccattcattcactgacaaatctattaatgagtatgtactataaggtatcaaaatagtcataagatgaagccagagaaagctacagaactttttaaaataatattttttaaaaagcagttttctttctttcttttttttttttaaacagggtttcactctgttgcccaggctggagtacggtggtgtgatcatagctcactgtagcctcaacctccccaggctcaggtgatcctcccacctcggcctccaaagtagctgggactataggcacatgccactatgcctggctaatttttgtttttttttttttgtagagacagggttttgccatgtttcccaagttaaaaagaaaaagcaattttcaaagacatcattccactttaaatcactggtagagggttttgaaaggactcatactggtatttgctgtggttgaaattaatcttaagtcttattaaggtatgattcttctaagcgattaataaaaacattttttaatgcacatattggatccacaaatatatcttaataaaatccagtaatacccgcaatgtagaaatgaggaggtctgtgtatttaacaaaagtcacaagtggagagactagactctgcccctgttggctgagtcccactttctctgcctttcctgactcagtgccacaaatataagtaacgctaagtccctttttccccttctgccacctccactttcgtcacttcagaaaaacaactaaagacaacaaatacatcaaaacctgagctgtatgaaaacatgaaaatctagaaaataagaggtgtattcagcacaactgaaatgtttatgtaatttaagtcacataaaaagcttatacccacattaaaacactgcatttaaagcaacattcacgcttccctgaaaatggaaaggaaagattctagaaaacaactcggcatggaagccctattagaatgtgggaggtgatcaggcttaaagagagttagtgttaagcagagaatggcacttctaaattgtccctttctggtgttataaacaatgcaaggccgctgtggctctctgtcaatcatgtgcatgaggcccccttattgtggactccattaaacaacagaggaaaactgaatgctttcaggagacataaggttcaactctacaagtaattattggtgtgcctcctatgcacagacaccacatgatcagcaagacactgtcctgggacattgtccagggtcaaggggcttgggtgggtcgctttccatcttcctcacagttctgggcctgtgcgttccctgctgtttaattgtggctgtcactctatgtccatgtccaaagtacttaatcacatcatggaaagttcactagaaactgattcctcattcatgcccttttaaacattgctagtcttcctgtcacacacccacaacatggcgctgcggctggacaggaagaaaacaaggaacgcattgtttgaaaagaactaaagggcaaagcagagtaagaggcatagcaaagatagaaacattaaggactatcttggggaagttgaccccttccaagctcagtgacttcagtgaagtagactgatgtctttacatctcaatttcctcacatgtaaaattggaagtaagaatccctacagcagatagcactggattctggtgtatacaataataacaaaagttttaggctgggcacggtggctcacgcctgtaatcccagcactttcggaagccaaggcgggtggatcacgaggtcaggagatagagaccatcccggctaacacggtgaaaccccatctctactaaaaacacaaaaaattagccgggcttggtggcatgcacctgtagtcccagctactcaggaggctgaggcaggagaatggcgtgaacccgggaggtggagcttgcagtgagctgagatcgtgccactgcactccagcctgggtgacagagtgagactccatctcaaaaaaaaaaaaaaagttttacttcttttttctggtaacaggaatatcgagggcaggctggtaaggtagactcctcaaatcatttaggacctgggtatttccagctcactatttggccatcttcagggtgtgatccttgacctcatgatgaacaagagctgctggagctccagtaatcacatctaagttctgggcaacaggaaaaatggaaagatatacaactttccttgtactgtaagtcccacagttattcggctcacatgtcattgcccaacaatgaaataaatggccacacctaactgcaagggaagctgggatgtataacctagctgcacagccacaggttcagataaaaattgggattctgttactaagaaagaagaagaaagtgtatattggaagagaacctggagcctctaccacctgcctctccttctaagatagaaacactcttaatttgtaagtgagagactggcgtaatagggacatagaggaaaaatattctaatctcctaagtggcaaagtaattttacttgtcaattcaacattaagtatttcaaatgacagcatctgaatatgtggaattttaccactcactctcaacccattaccttctgctctatcaaaacatacattctccatattacctgaagcctattatgatttgcactagagagaaaagaaaaaattccaaagctcagcaaagctcaaggaaagacactgatgaggaccgatgagatcagaacagagacactgcctcgatcctattagccaaagggtttgtaaaactcagttcttttgttgagagaccatcaattccttgagcacaggcctggtgctgggccctcaaggtgagtgggtgaatgaatgaatgaaagatggttaaagcactttgtatgtactcttttattaataaataaatatatattacatatatataaaataaatgtaatttattcatcctgaatatatgcttgatctctgatatatgctaaatagatactttattagatatatgctaaatacttttattataaaatatatatctctgatatgtatgaaatatctactctatttgattataaaacatatctctggcatgtgttaaataggtactatatttgattaaaaaatacatatctctggtacgtgttaagcagatactctgattataaaatacatatctctggtatgtgctaaacagataccctatttgattataaaatacatatctctggtatgtgttagatacctactctatttaattataaatagatatctactctatttagatatctagtagttagatatctactctatttaattataaaatatatatctctggaatgtgttaaataggtataatatttgattaaaagatacatatctctagtaattgttagataactgattataaaatacatatctctggtgtatgtgctaaacagatactctatttgattacaaaatatatatctctgctatgtgttaaatagctattccatttgattataagatgcgtatttctggtatgtgttaaatagatactgcatttaattacaaaatgcatatctctggtatgtgctaaacagatactctatttgattataaaatacatatctctggtgtctgtaaaatagctactgtattaattataaaatgcatgtttccagtatacgttaaataaacacattaaaccaaatactatatttggttataaaatacgtatctgtgacatatgtgaaatagacactatatttgagaataaaatgctcatgttgaacctgtgtccatgcaatggaggagctgccttgggtcgaatggtgaatactcaaaacaaactctgtgtagatcacagaaggaagctgggtcacagtcagcgcagacttcaggtggaagcccatgtctaaatttccctaaaagaactggcatcctgtcttaagtgccagctccaagtgaggagcactctcctcaaacaaaatgggttttggccttgcagtgatcaacgtgtctgggtaagtagagagccttggaggggagtgggtcgtcccctagcagaggggctgaggacaggctggaaggaacctatgccgcattgtctgggggaggacaaggtgtggagccctaaagccttttctcaccctgacggtggtacaactctgcttagaaggggctgtgagtatggactttactaggtggaaaaaaaatcgttcactgctaacaacaacagaatatatatatatgatgaaaataagagcatcacagtcaatcattcccattcacaagatcttgatgataagttatcactagccctgtatattctttccctcttaaagagaaacaaagctatttaggaggaaaaaaacataaactgatttgaagccactagaataattataaaattggatgtttcaaaagaaacatattaatatagggaggagggtaattcctcagttataacaagcttacctgccctttgtattccactagcttcagtcctgcataaatgggcacaaaactgctggctaggaggacctagatggataaaataaagaagcagctcatgattacaggcatgaacattcagacaatacagttgatgtagtattgactagcaaaatctcaataaataagccccacagacttcaagtgcagcactgcacgtaattacataaaagataacactttatatcggaaaagactctaaacagataggtacaagttgacatactctgaatcaatcaacttcacctaggtaaaaatcagcattttaatagtagacacacaagttactacaaaatgaaatttaaggtaagtctaagttcctgagtatgtaaaggttacagataaattatatgtaatgttccatcatatactgtaaaaatcatgttacagttgcactcctgctttctggaggaacaaagccctccgattatgacaggagagattagtccgcagctcagagatgttctcatttatgtcaccaggatttgcaaagggaatggcatattttatgttccaatgacgtggtcaggatatgtaatggaaccctggcaagcagtgacatcaattatgctttatctcccatttaaacagttgaaaaagattgtcatttaggaaattaccattccatacatcatgggaagttgggctctgatagcttttctgaaatgtaaatgttttattttgccgtgtagtttccaaatcactagtgttctatttgaaaacatacagcattagatactgaatattttttaagctataatctttcaactgataagtgaaagactctggctgtttgttgtcaaagatttcatgagttttttttcatcatacattattcagaaatggattatggctcaaatgctgacttgcagatcatccacttacaattatttagaactcagaaggcatttcctccaaaaatcaatgttataggtatggtttttgggtcagctctcaaaagcctatttattctgaactgcaactaaattacagactcagtcaccagcataacaatttccataggaaaatcctcttttgagctgtgacccgacacagctggaatccactcttgccatgtttatttctgcaccaggtacagggaacttccatagctttcttatgcagtggttcttccttggacatgtctcctgtttcctcattaccaaaaaacccactgaaaggagagggacttgtgtctctcctggtatgtccagcccttggcagagttagtactcaacaaacatctgttgggtatctctctcccttctctgtgatgggaatggacccaacactcctccacctacctcaatagtggcactaaagaaggttgcccagtgctgttggtggcatgttggttgcaaaggcacaggcctggttgtaacagctcctatagcaacaggctcctgacgagtgcccacagaagcttctggggcctcaggtttcagcagtggcaaattcaagggtaacagcacaacacaaggactccagcaggaaagaaggtaagaaatagccaagtgtgaaagggttctattgcaccatgctggtgctaggtgccagaatcagttatataatttctgggtcctgtccaaaataagataaatgcagggccccctgttcagaaagtatggagaatattaagatgttgacagcagagcattaaaccaatggtgaggccctttggatagtggagccacgtgcaaatgcacaggtcatacattcatgaagtagaccttgcctcaaatatagtgtctcatttaattatttctcgaccctgtctcaaaaagataaagttgctcaaaggtctctctgctaatacgtggttgagactgtccccagaatcaatttaatataaaatgtatatttttaccagagccaacatacacgtcagatttctcacaatgggtctttttttcatcttttggtcaatttcatgcacatctatctcaatcgcttgtttattgaaatattgaaagcatgctaatttgcagcactgtttcccaaaggaaagcatgcacttctatttattttttatgtgcttgtttatttatttattacaaggcataataataacctcacgcaaggtctgccaaccttctacaaaatgtcaatgtggacatgcccgcactgtgacattcttctcaaaatctcaactttaaatggcccgcataatgcaatactgtgacattagagcaatcatgtctctttcacaaagaggcaaagcaggagtgagtagcaccttgggtgatttggtgaagatcgcttaataaatcaataggagagagaggacagaaagcaggcatcttcaactccaaccctctcagtccaccggtagcaatgacatcattggcttcagagaaaggttgtttacggttaaggtaactgcattcaccctaactaaacctgaccttatcatcaattggctatgcttttaaaaaaataatcacagaccctaggtatgtttcgcaagcacaatgtagctatttaatgaagttattcagcaaatgcaacactgcaaagcaataactagagcaatttgtagatagcgtacatattgtgaaattacagtacttagaggtctttaaagaaccaaagacaatacataaatataatgatttatttcactattctgcagagagacatgtggactgcaaaaaaatcactaaccttagaattatgttttttttttcttttcccccgtgtcaaagtataatgtagagttcacaagttaatgcttgcaactattttgagatatttggatgaaaaatgctatccaattactttcctacagataataacagtaagaatcctcctaaatgatatgaaaagtgcaatgaactggaaaatacttgtcacttctccaaatcaatgtatttgtttttgtcatagctgactctccctttatatggactgatgatttgtatatcaaaccaagtttagttgggaaattagctttagatagttaagagctaagcagcttttcttatttgtagtcagcttactgccattttattgcaggcaaatagaatttcctaagaaaggagataaagactgacattctaaggtcatgtaataaaatattatgcctaaacatgtgcttttagtgtatctcacctcacaatattcccagtgaaattcacctcgccaatgaacctcaacacgtctacagcacttgttctcaactggaggtgattttacccgctagggacatttagcaatgtgtctgtcataacctggggtggagggtgggggggggggtgtgtcctgctagcatctactgaacacagaccagggatgctgctcaaattcctacaaaggacagacagctgtcacaatacataactatctgggtaataatctgggcccttactgccaggagtgcagtgtttgtggttgagaacgctgatgtggaaagcaggggtatacttttcacaccctatcacttggtacagcactttaaatgttggacatatgtgaaaccactgatttgtgttcttactaaacacacaatgataaaaatgagagctagtgtcttcctgtagcaactgtataaaacatcgccaggtgcgcattcccgacacgttctgattgactctcttcattttgcattttacagaaaagaggtatttagaaaattatgtggcctagcttccttagggattaaattctcagcaagtttcatttatgcctaaagtttactgtggactttaatgagaattaactgtttatacagaacttgctgctgtagttcaaattcaaagacagattcaaatttatcttcctcagtttttccaagataatgaccaatcttaaattcagtttttatttcaccttcacaaggctaaatgtgagaggatcttgttaagagcattctcacacatgcaaagaaattcaggacatcactgcaacagagacagggcagaattttctcaagacggccagggacactatggtgcaggaaaggcttcctgggtacctctaccctagagcattcacacgtgtcaaaagaccctttcggaaaacacttgtgcatcagtcttaaacatgaagaattcaatgatttgtaccaattcagggaagtagtggaactctacgacgccattgcactgttaatttatgcatcatttcagctcagccttggaagttgcatatgactttcttttaacctaggggctcacctccctagttaggctttgctgaaggctaacattaaaatgtgtttggatttcctagttgcatgcatgcttctaaagaaaaagagcccacaataaaatctggaactcgaaatgaatgagttggtatgcaaaatgcacacacttgacactcgggggatactgtgtagagcggcacaccaggagaggaatcaggaaggaatcatgctaaataatgaacagtatgaagggatggatgtctggagagtggaggcacttgaaggtgaccatgcacatctggtgtgtacttaagagctgatgaaatactttcatacatacttcatttgaccttgttctgaaggtctccatcttaaagatgaagaaaccaaggctccaagaagttgagactcgccaagggtcccagagcccaccaacaacagggttaggtggatgtgtaccacccctccatgactcttttcaattccctaaattatctgcatttgcaggaactgatctcagcttggtgttgatctgctggcgacccacagacataaagggtcatccttgggggtaacatttttctgggtgtggcacctggaaataaatctctcagacgggaaataaagacatgattttggaggggggcctcctggggctctggttaactctataaaggggtctcccctctgcaggctgccttcaagtagttgagcagacatcatctgtgtttccctttgtcagtacagttactataaaggaggaggggaatggttggcaccaataaattctgaacaaaggaatgccttaaggcctgcacctgtcttataacagtttataaagtagaaaagactgagttaaatcctcatgaacgtaagattcaaaattctgtggaaattcaaccccaaataaaatgaatagttggaccacacagtccacaagggtttcaagaaaacaatcaactagcattgcagctatcaaatgagtgatttttccatgctactaaaggtgaagctcattaagataaattaagtatgaatcatcacacaaaattatttattttaaaaaagaaggcttataatgatgagctgtaaaatcagatgcctaaaggtagcaagaactcagtagcaaccatttcctgaagtattacagatatcggttagcacattgttcatgaagacaggtaataagcaaggggttaaagaataacactgataagaaaaagtaatcctattcagcctgaagaaaagaaagttgtgatttaatatggctttaaaatttcatgacagattcatacaagggtgctgagcaggggtgtgtgtgggttattatgttattcgttcattatttatgaaatattagctccattcagcatgcataaagggctttatcatttaaaacacactttcacatgctttatcttatttattctgtacagtaacactcattagtattactgtgtgaattactccatttcagagatgagaaaactgagactcaaaagtaatcagtccaagaggacaacgtcaggaaacgacaggcctagacatgatcaccgggacactcataaaacaagtaatcattcttgaggagattcaaaaacacgtcaaaatacacacacagacacaaacacacaagcacacactctcacatattctaagctacaggtttctagttggattttcaggtacataggcactctgtaacaaacagcatcagtcagctagtggataatgaaaaactaggcattttttaaaaaattcaactattaagtagcagaataaatgagttaatgataaaaacagaaaatacaacatggagcaaagtttaaagaaggtgaaaatcaccagtgtttagtatttcatgctctcccatgctcttttactctaacttgagttttaatcaacctctctctttctctctgtctcccatcccctcccatctacagaatatccagatactgggaagtagacctgtattagttcattttcacactgctgataaagacatacccgagactgggtaaattataaagaaaaagaggtttaatggcctcacaattccatgtggctggggaggcctcacaatcgtggtggaaggtgaaaggcacgttttacatggcagcaggcaagagagagaatgagagagaagcaaaagcagaaaccccttataaaaccatcagatgttgtgagacttattcactaccaggagaacagaatgggatggggaaaaccatccccataattcaattatctcccactgggtccctcccacaatacatgggaattatgggaactacaattcaaggtgagatttgggtggggacacaggcaaaccatatcaagaccccaggctgtatgttcagagcgaggtgtgccaagccctgggagacccacagctacccatcatcgagctgcttcaatgcatggcttcagagcctcctgtctccacctaaggggagtggggtgaccttcaggcagcctccccagtcccaaccaaaaaggtcggaagcaccatcctcccatggcaccacctcagacaacattctcccaccagccacttctttcaccggaacatatatacttgatcatgtccctacctggcagggggtttactttacttcctcttcacacttcttcctttgctacatcatccctagtcttcccgcactctcactcttttcccctaaatgcttcatgagtattccaggcataggtttcacagtttgataatcaccatctgctatcaaggaactattcatccttcctttttagttctgaaaaatgttaaaacatcctcctaaacacgtggaatgtttcttgtagaacctagaataaatgtcaattattccatattctccttacaaagtattacacatttgtgtcaacaatttctcttctgttcaatgaactcaagtaattacacaaattctctgaatagttattatccaaaacaaaggaactagaaaaacgtcatgttttcttaacagcaatagtttgctattgccgttataacaaattactacaaatttaaccccttcaaacaagacacatgtattgtcacacagtctgagggtccaaagtctggtatgggtcccactggggaaaatccaggtgtcggcagggctgcatctctttctggaggctctgggggagaatgtgtctccttgctcagtcaggtgttaggagaatccagttccataggttaaagggcagatgcccccttttctttgctggctgtcagtggggacctgctttccgagaagcctctgtgcttccctggcatgtggttgctacatctccaaaccagccatgacacagaatccagaaaaggtgtccacttttcaagattcatgtacttagtttgggtccacttggataatatgggatcatcctcctatctcagacctttaatttaatcacatctacagaatcccttttgccaggtaaggttatatctggacaggttctggggattagggtaaggacagttttgggtgtcattcttctctctgccacataaaagggatggatagggaggatgagcattttatccagtgtggggtatatatagttagggaagaatgctagacacatgaaccacagtcacagctgggccccagccagctatgtgattttgcccaggtcatacagtatggagggcccagcttctttcttttcttttattttaaatcgagccagtgtaacagatgcaaccttggttcatatccattcgtttcacgcatattacggagtgcctacacaatggctggcagtgtggcaggtactgggctgcggcagtgagcaaaccagagaaacccctgcctcttggagcttacattctggtgaaggaggatggacaatgaaagctgaacaggacagcagtaaaagaggtagcatgctaaagagtgatatgtaaatcaggagggatgtggggagatcaggggctgagagttctgtcattgtagacagaaaaaccagggatggaccccgtgagagagatctggggcagaatccccctcattttatgtcacaagagcacacagtctgttcctaggtaaacaagaggatgcatgtctgcccaccgcaagccttatctgtctgtattggacattgatggcttaggaccacttagcatgggttgcccagctcttcccttgacactgtcaagtctacataatattgtaataagattatagaataatgtctttttataagatagactcttgtaagtgagagaatgacgtaatagggatatcgagggaaaatattctaatctattaagtggcaaagtaattttacttgtcaattcaacatttcattaagtatttcaaatgacagcatccgaatatatggaatcttaccacttactctcaacccattaccttctgctttcgaaaacatacattctccatattacctgaagcttgttatgatttgcactagagggaaaaacaagaaaaaattccaagagaagtacaccctttccaccctacaaatattcagtgcattaccacagcaggcacattggtatttggaaatcaaccagctgaagtatttcccagagatgatgaattctcaaccaaccaactttcaaatgtgtttggatagaaagacatcagaacaaaatggaagaaacaaaatggaacattagattgaaaagttaggagacctgggtaccagaattagctcccactgccacgcaggataatcttgggtacataggtacgtacatcacataaaatctttccattcacttctctgttaaaaacataaaagggatcaggtgtggtggttcatgcctgtaattccagcactttggggggctgaggtgggcagatcatttgaggtcagtagttcaagactggcctggccaacacagtgaaaccctgtctctactaaaaatacaaaaattaggtggacatggtggtacgtgcctgtaatcctagctactcaggaggctgaggcaggagaattgcttgaatctaggaggcagaggttgcaatgagccaagattgcaccactgcactccagcctaggcaaacgagcgagactccatctcaaaacaaaaacaaaaacataaaagggtcacaataacacctaccctacttgatttacagaaggacttgaaggactgaataagagagtacatgttaaaaaccctacatacactccaaagtattagccacataaatttcaggaattattattgctactaaactgcatcagcgacttgcttcacataatcaacgtgagatctgaacattgcaggaaaacactgaacaagtacagggagcatttggatcacagtgcatcataaggcggcctcaggagggatcctggcgaatactttcatcaaacaagtaatttactgagcactcaaccatctatcgggcctggtaagagacacaggatctaaagaacgtggtaatgctcattactttatatgaagtattgaaatcagcacttgctgatttcttcaaataggaaacatggctttgttaccttaatgaggtcctccctggaggaaaaagtggagactaagtgattttctctggttttggcgttggtgatggatacgtgcagtcggttctgggccagctcgtgagcgctgggaggaagaatcgactccatcccacttctaaagaagaaaaagcaatctgaattactcacctttaattattgaactccctgtaaatattttacaagagagaatgctgagcttgccaaagtttgtacagagagtcgtcaacattctgtcttcatgtacttttgggcaaaatgtactctgtataccttagtcgggccatgaagtcataaccgggcgttactgccccgaaagactgccttctgatttcttcggcaaacttgtaggtaaattggttacattcctaaaaaaagaaaattaagaagtgaccctaggtgttgtaaagaaaacaatcattccacttctaaaacttgggattctatagacccaacagcaaatgtagggtgtcatgttattaaaggtgtgcaaattccccacctggccggggcctcacccaccactctcaggccctttgcaaggtatacactctcaagaatcctaatctttttttgttttttcctttgtaaagcaccttaaatggcctttgccccatctgaaaaatccttgaaggctcaatctgaattttaattgagcacattcttcaaaaggtttcctcagcgcaattaaccttctctcccacccctattttgtggtctcagcagcagtttgattacaaccgtgcaacaaagctgattacaaatgacagcaccagtgacagaaataggagtagtgacgtctatggtttgcacagactgaatcagagtcttcggagattcatcttgggcactggtattttataaagtctttcagggatgctcatgtctaccctggactgggatccacagaggtgacactgtcagttcatcttcacatcaccctgcagggtgggtataaccatcccacttgacagacaagaaaacggaggattggagagttcaagtgtctatcccaatatctcattaaaaatgagtctcagagccagaatttacatctaagtctattttgtattaaataatgaattaatttggcaaccaactgggcaccaggtacttggctaggcactgggacttggagaggacaagatacaaagaccctgtgctcatgagagtcataagtgcctccaagagcaggtcatagagggctataagagcccccacaagggtgtgtttggctctcatttagtgcaaaaaataaataacaacaggtaaactgttttgagaatatgaggacatcaagtctcaaattcaggtaaatcattcaatgtcttaacattgcagaatttcagttaagtggctatattattgcagcagtctctcctctccccacaaagatgtccacattctagtccctggaacctgtgactaggagaccttctatgttaaaagggactttgtagatccagttaaggaccttgagatgaggagataatcctggatgacctgggtaggcccaatatcatcacaaggtttcttgtaagggaaggagggaggtaggagaggcagagttggagagatttgaagatgctgtgcttatggctttagaaatcaaggaaggggtcaggagccaaggagtctgggcaccctccagaaactggaaaaggtaaggaaatggattctcccctggagcctctggagagagtgagcatggacattttgattttagctcagtgagacccttttagacttaagaccgccagagctggaagatgataaacacatgctgttttaagccactacgctgaaggtcctttgtcaaatcagcaacgggaaatgaatacagtgtgtgtcaacctccaacctcatgggttgccaaaggtttccctccaatttgacacccaggctgggacttaaatataaacaggagttgggcagaggacgaaggtgaaagcagaggatagtaaaaacaacagcaagaacaattctgagaggggcacagagctgaaatgtgtccctatggcgagccacaagtagggctaagtcacatggggccttgtgatacatgctgagaaacctgggtcacattgtcctaagtccacagacagcccctgccccgggggtaatgaggtgatcagatgtgcctttgggtgacatcactctaagcgctatgaggtaggtggattgtagggagcttgaattgatataggctgtgggaagctcctgggtgagaaatgggggtagccccaccaaatgtatgttcattctactgagctagactgcccatctagcctatttctttgtactaatattagttatattcaatactctccatagcccggaccagactgtaaacttattaaagatggacttattcatctttgagttccccactgagtctagcaccatggcttcctcgcaaattgtgagggctgaggaaagtcttgcagcattgagctcttccacatcaatgtctaaatttgcctaccacttaaaatatgcccagtatcaggtgctcctcttaattattcatgcataagctcagaagattaattacacacgtatttgtcacaacagtaaaaagcttgaggaacttatatcatcagcgagaaccgagcgaacacgaatctgagtaggtagaaacatttgctaaaaaaaactcaaggctatcctacaagtggattatttcagatgctaaaaataaaggaactaaaataaccttaagtcaaagggttactttggctgaaaaattattttgaagaagaacaaatgaggatgccctaaggaaactaagaaaattattttctaccttcccatgggagcaccagataaagacacacaccttttcatcataccagcaccatcagacaacacaacccagtctctcatttagtgcaaaaaataaataacaacaggtaaactgatctgagaatatgatgacatcaagtctccaattcaggtaaattattcaatgtcttaacatggcagaattttagttaagtataaatggctgtactagtgcagtatttccaaatcaggttaattctaaatcatacaatacattttttaatttgctgataattggaaaccaagtctacataactccaaagcttaggatttgccacagctcaagaaaagactgcagtaaaaaggaagaagtgacaccctgaaagccctctgcttcaaaaacgaaacacagttatgggaaggaggtagcttgtaattcaaagcttatgaatctgctagtttagggggaattttccgacctcatttataccttgcatggcttaaggttctggtcctgtttaatctctgcagtttttaaatcacttttctagttccctgtaaatcaaccatataaagacaggaagataggtggatttctgaatgattggcctcaaatctagcttccctttgataagcagctcacaaaagatctgaaatgagattctgatgtttaacattgcatagttttggaattttaaatgtgactgaaattcattcttgggtatgagggtgttaaattgttatttcattattgttcaaagctgctagagtacgtaatgattaacaaatataatattctccaactacggaatccagctctcacagtcagcaaatgattgatcactgtctggatagcagaaaacagattttaaaacatagattgcattaaataaagtacttaatgaataattatttgtattacttctggataaattgcttggaactcagagcttcctcttactgtgagaattaaaaaagaattaaattcctataccattccacttaatagaaactgcatgcccacattttaatttatgtatctatttctaagtagcagtgaggtaagacttgttgcccacatgttcaaggccttgaaaacaggccccatgctcttctcatgatcatagaaagaagaaatatcctttgcttgaaaggaacagagctggaatcttaaggataaataaaaactcaagagtaatataagtcattttatttccttatttcactatcacccaaaataatcttttccacaaccagagcacagatccctaataattacatcttaagagaaaagtcctaatcctttctgtttccaagcaaacgattatttctctgcagtgttaacttagtagagtcaatgctggtgtttgcctttgggtcttaatttcttgatgaggaacacagcctaagttactacttaattacctctattttttctggtgctgttagcagaacagaagcaaccaacgatcccgcagacgccccagcgaaggctttgacatccttcacaagttttttgccatgtctgcaaagtgcagatgctgcccccaagtggtaaatgcccagaaatccacacgctgcaaatgataggttgatgtgcttcattctagctgtagcactggcaatacaaaaaacaaaaatgctgtaagttggaatagtttatcccacatactgtgtagtcttatgttgatcatcgttccaaggctttcttctaacatcattctctgttttaagcacagtggtttcaattaattctaattaaacacaagaatctttcaaggaaaccctttctttccctcctcaccttgacccaagtcttatacattaaaacaaaacaaaacaaaaacattccacatttattcggtacatagattatgaatctacgatttaattacttggcaggaaacagacgtataaattccagttgacaagggcatttggtcttttctcttgaccctttgaaacgttttgcgggtgggggcggcactaccattatgaaacagaaaattattagagaccgtatcaaattccaaatgaacaatacatttgttcttggtaagtgtatcagaagatttcaaatacagttccctactccccttcccaatttctattgtgagcacccatgcttttatgaacgccaatacaattactcagtaacgcaataagcaatcactcaacaatgcaatacatttctttgccaagtatctcaacacaaactgaggtcatgcctggtgaaggcaatttaaggctctatgaaatgtcagccacgccactttatacttggaacacatctaaatacaaaattacatgttttcctatgcctcagtgcgcacaatttgcccaagtgaatgaaattgtgcctccacaaggctgtccattctgaaggtctcagggtttccttgggggcccaagggccccattcagggaccccaagatgaggcacattacagggcctcgaatttagggacctaagaccgcctgttcctgatgcacccggccaggccctgtgagggcaggtggctcggccgccgcaggctgcgctggcgtccgcgtaggctgagtcccagtcatcgatccggggtcaagccccagttttgattccacttctgcaaatggggacgggaagggggttgggtgtgtagcaaccaggcggccaggcccagccagcacaggctcagtgccctcccgcggcttggaggccggcagggccggggtggtccccgcatcagtcccgcaggagcacacccttgctgggccccagggctccgtaccaatgcagccccgggacacttccgtgttgaacgagtccctttaaccagatggcggggccgggccgtcactcaacgccattccgccaccaaggccgcgctacgctctccgcgagccggcccaggaaagtcctgcggcaggggttggtacc

SEQ ID NO: 448 - DNA, 28977 bp, Homo sapiens
  source 1..28977: mol_type = genomic DNA
cttaaaataaaagttaaaaagaaaagtaccatcctcccacagggtcaaatacatatgtagtcgatacaagatacttcaaaaaagtcttatacaatgagatttggttttgcagcttaaatttcttcaatttaagggtacatcaacaaggaatttattgaaatacagtgtatcatacaaatagaatattcacatgaaatgatcaaaggaaggggtaaggagaaaagtattaaaactgaaaatttacctagtgaataagtggacataacaattgagaatctatccacttcatgtcacttatggaaacaacacattaagattaaactacatgtttgctagagtaggagaaagtatataccacagggaccatcattactctagagtgggtctatgcataactcctcaaaaagaggccatcgttggtgtttatgtgctaaaagttgtgtattttggcttctgagaaccataaaattgactcaaagaatagtttcaaagagtaaaagaagaaatgcgtgacaattgaagacatggaattaaattggtttgtctctaactgcctcttagtaatcaagagttcttgcttggcaaaacctcataaaaacagatttaggatttaagacagtgtcagtaaattggtacaagcccatacacaagtcctcaaagtgatggacaactactcagaaagtaaaaaacctgggatcagtacaacgtgatttaaaaatgagaagtgaatgattattctggatttaattcttatttactaggctacttggttctttgtgtttagtagtattttatctatttaagttcccataatagatgtatccagtatatagaacaatagctaaatactcagagaggtatggcgagagagagagagagagagagagagagagagagagagagagagagagagagagaatgaatgacaaccagcttgataatctcctaaactggggtggggtttaggggaggaagatgagaggggataagcctcttcaaaatctcctaggcttctggatatctgcccctaactgcactgggagcaactgcacacacctgtggaaagcaaactgttatggtttggctgtgtccccacccaaatctcatcttgaagtgtatgtagctcccacaattgccacacgttgtgggagggacccagtgggaggtaactgaatcatggaggcaggtctttcccatgctattctcatgatagtgaacgagtctcaagagatccgatggttttataaaggggagtttccctgcacaagttttcttctcttgtctgctgccatgtgagacatgcctttcaccttccaccacaattgtgaggcctcctcagtcatgtggaactgtgagcccattaaacctttcttttgtaaattgcccagtcttgggtatgtctttctcagcagtgtgaaaatggactaatacacaaacctttgttcctccagtcctgatcaaaggtctttaaccatgagttgcctatttctcaaatccttcctctcctacctagttccttcagttccagagctacagggacacagctaagtcacggaaacacccatgcttcacgtcaagatcatgccacatattctccatggaacctaagtggtggccctccattttccatgttcctcaatttacccaaagaacctatcctcctccattttttaaaggacacaacagttcaccaaaaatgattccttatcacctaagtgtatccttcttaatgacgttgtcaaattctaataaagtgcctcttatatccatgtgctaagtaataattcaaatattaaaaataaacacaaatattacaaggagtaatacaattgagtcatgatagattttctaaaaaggatttgattagaaacttccatcaaaaactatctaaaacgtgttttgcattataaacttttatgcattttattcaaaccaattttctttaagtaaaaacttaacagtgtcatcaaaaccacactgatacaaagattccattttcctcttgcttgggggaaaaagggcttggttgagtctcaccaggtttgccagggacaactagaataaaaagaccaaaatttaagctgtaggatattgcagtacaggtaaatatacactatttttataatctaggttttcttatcacagatacaattagcagtaacaaaaaatcagtaggaaaaatttaaacttcagaagttacctccactgatacactaaaggagagtttctcagccttggtactgctgacatttggggccacgacgtcttaactgtgggacagtcatgtgcactgcaggacgtttaacaccattcctggcctctacccaccagatgccagtagcaccactgggacatgataaccaaaaatgtctagtacaatatcatcccatgtggaaaactattagactagattaagggaatcagtatttttatgtcaattattcatttgggtccctaagtttttctccactatttttatatatttcattacctccatctttctaagcaaataaatgattttatttaaaattgctctgggccaggcgtggtggctgaggcctgtaatcccagcactttgagaggccgaggcaggtggatcacttgagcccaggagctcaggaccagcctaggcaacacagtgagactttgtctctgcaaataatttttttaaaaaagtagttgggtgtggtggcacgcgcctgcagtcccaggtacttgggaggctgaggtggcaggattacctgagcctgggcggtcaaggctgcagtgagacatgatcttgccgctgcactccagcctaggggacagagcaacaccctctctcaaagaagaaaaaaattgctctgatatcctaccaagtttattgatgtaaaaaagaagtgaagaaaaagcagtgacagttaataagcagcaaaaatgggtgggcgtggtgcatgtctgtaatcctagtgctttgggaggccaaggtggaagaatcacttgagccagggagtttgagaccagcctgggcaacctagtgaaaccctgtctctacaaaagataaaaaaattagccccgttcctatggctgatacatgttataaagtattaaacaacacactaaggagaagatgcaactcctacctacaattatcaatgaacttccagtgcttgggaaacacgttgaattctgtgggaatttttagtagatcagaactcttcaaatatcactgaacataattactcaccatgatatcctgcttggcgatattaacatacagatctagctgccctttgtcctgcggggagatgtccagtcgtccactgaagggggagatggttactgtccggccgacgggcaggatgggaagagcgttggtgaggcctccgtccacccacttctgtggaaagaaacatctcacgtcagcacacgtcaacaacacatcctgcacaaagaaaagcagcttctaataatatgtgtgccttggatatgcttttaaattgctatttttgaggactaatcccattggggatctgttctgggggtaaaacaaatcttggtacacatatcacttaccaatataagaacaactctggacagaatttaactagattattgtctgtaagacttgaattcttactgactacagtgcatgcttaagaagccatgtgtaattagattggggttcattatttaatcaaactaaaaagtcaaatttactgtggatgctgaacaaaacatccaccagcagaggaggttccatttttattatatgaattggaaactggcattttctgtggcaaacttaaaaagtaaatacagcaactagaaatgcttctaattccaaagtggttcctgtgctcttgaagcaaggggcatgtcctgaagccataaggaatgggagtgctgcatcaaagcacacattcctcagtaggcactcagtgctctcaagcccaccgcaaaggggagtgagtgatggagaaggcggaggacagaagcctcccaaggaagaaaatgaaagagtcttggggcaatgaggacggacaatgaggtgctcaaggtgtgtgcagcctcagcccctagctctacagaagcgcacaatgagaaatggtgactgaagaaccacacagacaatattccttctgctgtctattccaaggccaaacagtctcaatgcagccatgatctgatgtattcacatgatcagctatagcactcaataaacacaacacacatggaaataacacccaaattgtctaagtttatctgttattaaaaatagccttcagataatatacaaaaaaacaaaaagtctggtaacagttgaaagtcctgtatgcaggaatctttagtgaagtttgtaaactgagttttgcttcaatgtgtaaaatgcaatgcagataaaacaaacctttgttattcaacataaaggtggcaagaggagggagaaacaggccaaaataaaatgttctcaactcacttaaaaccatgcatttatttcttccaatgtgtctttttcatgtccttcttgtgtttatttatttatttatttatttatttatttatttatttatttgagacagagtctcgctctgtcgcccaggctggagtgcagtggtgtgatctcagctcactgcaagctccgcctcccaggttcacgccattctcctgcctcagcctcccgagtagctgggactacaggcgcccgccaccatgcccggctaattttttgtatttttagtagagacggggtttcaccgggttagccaggatggtctcaatctcctgacctcgtgatctgcccgcctcggcctcccaaagtgctgggattacaggcatgagtcactgcgcctggccaattgtgtttatttctaaagctgatgacaaaatgagtggtattacattatttacaaaggctctggacagccacaaactcctccaaaggaaataaaagtaaataaataaaagataaaaatgggttgaaaattccttttgagagaattgcattttggtggaggagagagtataagtagattggattaaaataaaactgacctgcataatttgcatattgtcattatttttaaaagatataaagattatgatatattatgtgttatgtgtattacacatacttatttatatgtgtatgtgtatatgcatgtacacatgtgtttgtgtatgtgtgtttatatatgtacccatatgtatacataaaatatagctggttatgtaactgtatgatctaaaagggaggtttgcaaaaaaaaaggctccaaaatatctgattctgtcccagaacctgctttttttccctgattgctttaggtgtaaatatcaaattctggaataggataatacccagaagggaaaagaaagacagcttccaaaattatttcatattgtcaacagaagctgtcatcaacgatgtaaaaattcatacaggtttcatcaagaaaaattaaagatatgcaactttaagtaacagctcttctgatttattcaacttaatgaaaagaagggcaatctggctcagtaaattaaaaagtgttctaatttactgtggggttaatgactgctgttttagggaatcgaaaatcctttttccaaattttgttcactcttgttagcttattctgattagataaatgacaagggaaaatgtatagcagcttatcaaatcacttgattaaacttgcaatgataccggctccttcacaacccttgatgctatagccccactgctcagatatgctaaatgtggtacctcttactcctgatttatgctctcacgagctgtatcacttaggacaatcacacattcattcgggcatacagattccagcagtttctggaaacaaccgtcacaacaacaaatattcttcaacctccaaattaaaagtagaaacattttatatcttgtgctctactgatagtttaaaatcttgcatagtaaacacttctgcccatgaattctctggctgttcacaacatatggctgtgagtcattcccaccttcttgcttcatgggcagcattttacatgctggtagctacttccatgagcttctgtgactccaaaattgtccttaagaaaaatagctgctggtctaccccgttagagttttcctgtgtgtttgtcagttttcatcacatatcaccatcatcctcaaaggaaaagggagagcaagtacataaaaattccaaggcaaaatagtttcaaaatcatactcgttacaggctgtacagtgaccacctctcagtcccactgctagacctactactcttttctctaatctttggccatattctaaatgtgttccacattcaagtcaatgcctgagtcctaagacatagaaataagcaactgctcaatagaaaaaccaaaaacaaaacaaaaaaactcatgcccaattgtggggcagacatctactgtgattgttctctgaaagttatagcactgaaaactggaattaatagaatcacttctaaagagataaggctacccattacacctaaacaggctagaatattcatctggcagtacttgttaaacttcgctttagacattcatgtgttatgggtagctattgagaacatgccttatgaattcaagtaactgctattacataacgcaagtggaaaacttaagaaaggacctgatgagttaacctgtactgaaagggccagtttattcattcagcaagtgatccctgagcatctagtgtgtgtctggatgtatggtagatgctggggatatgtttttgatagaacttccatgaagggctccattttcttaaggtatattttgctcaaaaaacaagtgaataaaaaatactttgctggaagaatgaatgttgctatctataattattataaataccatggcagagggcctagtagtttaaaagtgatttcacatgtataatttaatatgcgaaccctgtaaggcagaaaggtcatgcttgtatattcagttccctcatgttacagaagaggaaactgaggcttgcaggtttccttgctatagttcacggggtggtaaactacgacccaccatctgcttcagtaaataaaattttattggcacatgaccaggaccttttgttgagatattgcctgcggctgcttccctctactacagcacagttgagtaggtgtgttgacagagacaatgttgaaagcatttgctatctgatactttacagagaataaaacatctattgctatagaatatacaggcaagaagggatagttgtcttttcacttcaggttttttttctcgcacactgtaaaattcagggatgctcgatggggcagggcaaattagaactgatttctgaggggtgagaaagaagtaaatgtgctttgaacaataatttcttatttgcaaacatatctgcattgctttcatgagatagcctacagacagcaatgcccaacaatgctcttgattagcaattcctaaaatagaagggagagggaaagagacaaagagatatccacttccttagacacaggtgagaatcttccaattacggtgggaagaagagacagatgagattttttaatcaaagaaagacaagtaaaaatacaattctaaaagagaggttgagaaacctgccatactaacctctactaagcattgattcttggtgcattgctttcttggtttttgcatgtgtgaaggatgattaaaaatgatgactccagatatctacttttgagaaggctctaaagggttaacagttgaccatctataaacaccatacagaaaatttttcctagaggactaacatgttgtttcaaaaattaaacagacagtgcaaaaaaatctaaaaagtgactgaagaataagagcgtctatttcagaataactagaaattgatatccaggtttccatccagccaaatctagctggtggcaaggccagctaccactgtttgctatgacagtgacagagctgcatttccatgtaaaaagtctaagccacgaggaaatagaagcctaaggaccacagtatcaacctcatataaaagcacagttacatggagtattccacaattctctttcccacacaagtgtcaataatgaaaggaaaaatgacccatatccgcatggactagggtaatacaacagtgcattttcacgttcctgtaatagtatatacttaatcttaaccaaaaggccaagaagcgatcttgtaatactacacagtcaaaatattacttgaattccaactcagatgaaagaaacaatgcaaaatcctacagcttttcttttcttttttttttcagacagagtttcactcttgttgcccaagctggagtgccatggcatgatctctgctcactgcaacctctgcctcctgggttcaagcaattctcctgcttcagcctcccgagtagctggaattacaggcatgcgccaccatgcccggctaattttttgtatttttagtagaaacagggtttcaccacgttagccaggctggtctcgaactcctgatctcaggtgatccgcccgcctcagcctcccaaagtgctagaattacaggcgtgagccactgtgcccagccaaccctacagcttttcttctgatctgcatgtgccagttctggagatgattttattctgatattttagtcacctgccaatgctaattctatctcttaaaacaaatgagttaagaattcctcttgaaaattttcattcttattccaaattgacaagaatctgtgaaaacatggcctaaatgtgtgaacattcctgtggatttattctaccactggaaagagttcatatgtagtaaagaaaaatcattagtcaaaaatataggactaaacttcaatttatttccattcattcactgacaaatctattaatgagtatgtactataaggtatcaaaatagtcataagatgaagccagagaaagctacagaactttttaaaataatattttttaaaaagcagttttctttctttcttttttttttttaaacagggtttcactctgttgcccaggctggagtacggtggtgtgatcatagctcactgtagcctcaacctccccaggctcaggtgatcctcccacctcggcctccaaagtagctgggactataggcacatgccactatgcctggctaatttttgtttttttttttttgtagagacagggttttgccatgtttcccaagttaaaaagaaaaagcaattttcaaagacatcattccactttaaatcactggtagagggttttgaaaggactcatactggtatttgctgtggttgaaattaatcttaagtcttattaaggtatgattcttctaagcgattaataaaaacattttttaatgcacatattggatccacaaatatatcttaataaaatccagtaatacccgcaatgtagaaatgaggaggtctgtgtatttaacaaaagtcacaagtggagagactagactctgcccctgttggctgagtcccactttctctgcctttcctgactcagtgccacaaatataagtaacgctaagtccctttttccccttctgccacctccactttcgtcacttcagaaaaacaactaaagacaacaaatacatcaaaacctgagctgtatgaaaacatgaaaatctagaaaataagaggtgtattcagcacaactgaaatgtttatgtaatttaagtcacataaaaagcttatacccacattaaaacactgcatttaaagcaacattcacgcttccctgaaaatggaaaggaaagattctagaaaacaactcggcatggaagccctattagaatgtgggaggtgatcaggcttaaagagagttagtgttaagcagagaatggcacttctaaattgtccctttctggtgttataaacaatgcaaggccgctgtggctctctgtcaatcatgtgcatgaggcccccttattgtggactccattaaacaacagaggaaaactgaatgctttcaggagacataaggttcaactctacaagtaattattggtgtgcctcctatgcacagacaccacatgatcagcaagacactgtcctgggacattgtccagggtcaaggggcttgggtgggtcgctttccatcttcctcacagttctgggcctgtgcgttccctgctgtttaattgtggctgtcactctatgtccatgtccaaagtacttaatcacatcatggaaagttcactagaaactgattcctcattcatgcccttttaaacattgctagtcttcctgtcacacacccacaacatggcgctgcggctggacaggaagaaaacaaggaacgcattgtttgaaaagaactaaagggcaaagcagagtaagaggcatagcaaagatagaaacattaaggactatcttggggaagttgaccccttccaagctcagtgacttcagtgaagtagactgatgtctttacatctcaatttcctcacatgtaaaattggaagtaagaatccctacagcagatagcactggattctggtgtatacaataataacaaaagttttaggctgggcacggtggctcacgcctgtaatcccagcactttcggaagccaaggcgggtggatcacgaggtcaggagatagagaccatcccggctaacacggtgaaaccccatctctactaaaaacacaaaaaattagccgggcttggtggcatgcacctgtagtcccagctactcaggaggctgaggcaggagaatggcgtgaacccgggaggtggagcttgcagtgagctgagatcgtgccactgcactccagcctgggtgacagagtgagactccatctcaaaaaaaaaaaaaaagttttacttcttttttctggtaacaggaatatcgagggcaggctggtaaggtagactcctcaaatcatttaggacctgggtatttccagctcactatttggccatcttcagggtgtgatccttgacctcatgatgaacaagagctgctggagctccagtaatcacatctaagttctgggcaacaggaaaaatggaaagatatacaactttccttgtactgtaagtcccacagttattcggctcacatgtcattgcccaacaatgaaataaatggccacacctaactgcaagggaagctgggatgtataacctagctgcacagccacaggttcagataaaaattgggattctgttactaagaaagaagaagaaagtgtatattggaagagaacctggagcctctaccacctgcctctccttctaagatagaaacactcttaatttgtaagtgagagactggcgtaatagggacatagaggaaaaatattctaatctcctaagtggcaaagtaattttacttgtcaattcaacattaagtatttcaaatgacagcatctgaatatgtggaattttaccactcactctcaacccattaccttctgctctatcaaaacatacattctccatattacctgaagcctattatgatttgcactagagagaaaagaaaaaattccaaagctcagcaaagctcaaggaaagacactgatgaggaccgatgagatcagaacagagacactgcctcgatcctattagccaaagggtttgtaaaactcagttcttttgttgagagaccatcaattccttgagcacaggcctggtgctgggccctcaaggtgagtgggtgaatgaatgaatgaaagatggttaaagcactttgtatgtactcttttattaataaataaatatatattacatatatataaaataaatgtaatttattcatcctgaatatatgcttgatctctgatatatgctaaatagatactttattagatatatgctaaatacttttattataaaatatatatctctgatatgtatgaaatatctactctatttgattataaaacatatctctggcatgtgttaaataggtactatatttgattaaaaaatacatatctctggtacgtgttaagcagatactctgattataaaatacatatctctggtatgtgctaaacagataccctatttgattataaaatacatatctctggtatgtgttagatacctactctatttaattataaatagatatctactctatttagatatctagtagttagatatctactctatttaattataaaatatatatctctggaatgtgttaaataggtataatatttgattaaaagatacatatctctagtaattgttagataactgattataaaatacatatctctggtgtatgtgctaaacagatactctatttgattacaaaatatatatctctgctatgtgttaaatagctattccatttgattataagatgcgtatttctggtatgtgttaaatagatactgcatttaattacaaaatgcatatctctggtatgtgctaaacagatactctatttgattataaaatacatatctctggtgtctgtaaaatagctactgtattaattataaaatgcatgtttccagtatacgttaaataaacacattaaaccaaatactatatttggttataaaatacgtatctgtgacatatgtgaaatagacactatatttgagaataaaatgctcatgttgaacctgtgtccatgcaatggaggagctgccttgggtcgaatggtgaatactcaaaacaaactctgtgtagatcacagaaggaagctgggtcacagtcagcgcagacttcaggtggaagcccatgtctaaatttccctaaaagaactggcatcctgtcttaagtgccagctccaagtgaggagcactctcctcaaacaaaatgggttttggccttgcagtgatcaacgtgtctgggtaagtagagagccttggaggggagtgggtcgtcccctagcagaggggctgaggacaggctggaaggaacctatgccgcattgtctgggggaggacaaggtgtggagccctaaagccttttctcaccctgacggtggtacaactctgcttagaaggggctgtgagtatggactttactaggtggaaaaaaaatcgttcactgctaacaacaacagaatatatatatatgatgaaaataagagcatcacagtcaatcattcccattcacaagatcttgatgataagttatcactagccctgtatattctttccctcttaaagagaaacaaagctatttaggaggaaaaaaacataaactgatttgaagccactagaataattataaaattggatgtttcaaaagaaacatattaatatagggaggagggtaattcctcagttataacaagcttacctgccctttgtattccactagcttcagtcctgcataaatgggcacaaaactgctggctaggaggacctagatggataaaataaagaagcagctcatgattacaggcatgaacattcagacaatacagttgatgtagtattgactagcaaaatctcaataaataagccccacagacttcaagtgcagcactgcacgtaattacataaaagataacactttatatcggaaaagactctaaacagataggtacaagttgacatactctgaatcaatcaacttcacctaggtaaaaatcagcattttaatagtagacacacaagttactacaaaatgaaatttaaggtaagtctaagttcctgagtatgtaaaggttacagataaattatatgtaatgttccatcatatactgtaaaaatcatgttacagttgcactcctgctttctggaggaacaaagccctccgattatgacaggagagattagtccgcagctcagagatgttctcatttatgtcaccaggatttgcaaagggaatggcatattttatgttccaatgacgtggtcaggatatgtaatggaaccctggcaagcagtgacatcaattatgctttatctcccatttaaacagttgaaaaagattgtcatttaggaaattaccattccatacatcatgggaagttgggctctgatagcttttctgaaatgtaaatgttttattttgccgtgtagtttccaaatcactagtgttctatttgaaaacatacagcattagatactgaatattttttaagctataatctttcaactgataagtgaaagactctggctgtttgttgtcaaagatttcatgagttttttttcatcatacattattcagaaatggattatggctcaaatgctgacttgcagatcatccacttacaattatttagaactcagaaggcatttcctccaaaaatcaatgttataggtatggtttttgggtcagctctcaaaagcctatttattctgaactgcaactaaattacagactcagtcaccagcataacaatttccataggaaaatcctcttttgagctgtgacccgacacagctggaatccactcttgccatgtttatttctgcaccaggtacagggaacttccatagctttcttatgcagtggttcttccttggacatgtctcctgtttcctcattaccaaaaaacccactgaaaggagagggacttgtgtctctcctggtatgtccagcccttggcagagttagtactcaacaaacatctgttgggtatctctctcccttctctgtgatgggaatggacccaacactcctccacctacctcaatagtggcactaaagaaggttgcccagtgctgttggtggcatgttggttgcaaaggcacaggcctggttgtaacagctcctatagcaacaggctcctgacgagtgcccacagaagcttctggggcctcaggtttcagcagtggcaaattcaagggtaacagcacaacacaaggactccagcaggaaagaaggtaagaaatagccaagtgtgaaagggttctattgcaccatgctggtgctaggtgccagaatcagttatataatttctgggtcctgtccaaaataagataaatgcagggccccctgttcagaaagtatggagaatattaagatgttgacagcagagcattaaaccaatggtgaggccctttggatagtggagccacgtgcaaatgcacaggtcatacattcatgaagtagaccttgcctcaaatatagtgtctcatttaattatttctcgaccctgtctcaaaaagataaagttgctcaaaggtctctctgctaatacgtggttgagactgtccccagaatcaatttaatataaaatgtatatttttaccagagccaacatacacgtcagatttctcacaatgggtctttttttcatcttttggtcaatttcatgcacatctatctcaatcgcttgtttattgaaatattgaaagcatgctaatttgcagcactgtttcccaaaggaaagcatgcacttctatttattttttatgtgcttgtttatttatttattacaaggcataataataacctcacgcaaggtctgccaaccttctacaaaatgtcaatgtggacatgcccgcactgtgacattcttctcaaaatctcaactttaaatggcccgcataatgcaatactgtgacattagagcaatcatgtctctttcacaaagaggcaaagcaggagtgagtagcaccttgggtgatttggtgaagatcgcttaataaatcaataggagagagaggacagaaagcaggcatcttcaactccaaccctctcagtccaccggtagcaatgacatcattggcttcagagaaaggttgtttacggttaaggtaactgcattcaccctaactaaacctgaccttatcatcaattggctatgcttttaaaaaaataatcacagaccctaggtatgtttcgcaagcacaatgtagctatttaatgaagttattcagcaaatgcaacactgcaaagcaataactagagcaatttgtagatagcgtacatattgtgaaattacagtacttagaggtctttaaagaaccaaagacaatacataaatataatgatttatttcactattctgcagagagacatgtggactgcaaaaaaatcactaaccttagaattatgttttttttttcttttcccccgtgtcaaagtataatgtagagttcacaagttaatgcttgcaactattttgagatatttggatgaaaaatgctatccaattactttcctacagataataacagtaagaatcctcctaaatgatatgaaaagtgcaatgaactggaaaatacttgtcacttctccaaatcaatgtatttgtttttgtcatagctgactctccctttatatggactgatgatttgtatatcaaaccaagtttagttgggaaattagctttagatagttaagagctaagcagcttttcttatttgtagtcagcttactgccattttattgcaggcaaatagaatttcctaagaaaggagataaagactgacattctaaggtcatgtaataaaatattatgcctaaacatgtgcttttagtgtatctcacctcacaatattcccagtgaaattcacctcgccaatgaacctcaacacgtctacagcacttgttctcaactggaggtgattttacccgctagggacatttagcaatgtgtctgtcataacctggggtggagggtgggggggggggtgtgtcctgctagcatctactgaacacagaccagggatgctgctcaaattcctacaaaggacagacagctgtcacaatacataactatctgggtaataatctgggcccttactgccaggagtgcagtgtttgtggttgagaacgctgatgtggaaagcaggggtatacttttcacaccctatcacttggtacagcactttaaatgttggacatatgtgaaaccactgatttgtgttcttactaaacacacaatgataaaaatgagagctagtgtcttcctgtagcaactgtataaaacatcgccaggtgcgcattcccgacacgttctgattgactctcttcattttgcattttacagaaaagaggtatttagaaaattatgtggcctagcttccttagggattaaattctcagcaagtttcatttatgcctaaagtttactgtggactttaatgagaattaactgtttatacagaacttgctgctgtagttcaaattcaaagacagattcaaatttatcttcctcagtttttccaagataatgaccaatcttaaattcagtttttatttcaccttcacaaggctaaatgtgagaggatcttgttaagagcattctcacacatgcaaagaaattcaggacatcactgcaacagagacagggcagaattttctcaagacggccagggacactatggtgcaggaaaggcttcctgggtacctctaccctagagcattcacacgtgtcaaaagaccctttcggaaaacacttgtgcatcagtcttaaacatgaagaattcaatgatttgtaccaattcagggaagtagtggaactctacgacgccattgcactgttaatttatgcatcatttcagctcagccttggaagttgcatatgactttcttttaacctaggggctcacctccctagttaggctttgctgaaggctaacattaaaatgtgtttggatttcctagttgcatgcatgcttctaaagaaaaagagcccacaataaaatctggaactcgaaatgaatgagttggtatgcaaaatgcacacacttgacactcgggggatactgtgtagagcggcacaccaggagaggaatcaggaaggaatcatgctaaataatgaacagtatgaagggatggatgtctggagagtggaggcacttgaaggtgaccatgcacatctggtgtgtacttaagagctgatgaaatactttcatacatacttcatttgaccttgttctgaaggtctccatcttaaagatgaagaaaccaaggctccaagaagttgagactcgccaagggtcccagagcccaccaacaacagggttaggtggatgtgtaccacccctccatgactcttttcaattccctaaattatctgcatttgcaggaactgatctcagcttggtgttgatctgctggcgacccacagacataaagggtcatccttgggggtaacatttttctgggtgtggcacctggaaataaatctctcagacgggaaataaagacatgattttggaggggggcctcctggggctctggttaactctataaaggggtctcccctctgcaggctgccttcaagtagttgagcagacatcatctgtgtttccctttgtcagtacagttactataaaggaggaggggaatggttggcaccaataaattctgaacaaaggaatgccttaaggcctgcacctgtcttataacagtttataaagtagaaaagactgagttaaatcctcatgaacgtaagattcaaaattctgtggaaattcaaccccaaataaaatgaatagttggaccacacagtccacaagggtttcaagaaaacaatcaactagcattgcagctatcaaatgagtgatttttccatgctactaaaggtgaagctcattaagataaattaagtatgaatcatcacacaaaattatttattttaaaaaagaaggcttataatgatgagctgtaaaatcagatgcctaaaggtagcaagaactcagtagcaaccatttcctgaagtattacagatatcggttagcacattgttcatgaagacaggtaataagcaaggggttaaagaataacactgataagaaaaagtaatcctattcagcctgaagaaaagaaagttgtgatttaatatggctttaaaatttcatgacagattcatacaagggtgctgagcaggggtgtgtgtgggttattatgttattcgttcattatttatgaaatattagctccattcagcatgcataaagggctttatcatttaaaacacactttcacatgctttatcttatttattctgtacagtaacactcattagtattactgtgtgaattactccatttcagagatgagaaaactgagactcaaaagtaatcagtccaagaggacaacgtcaggaaacgacaggcctagacatgatcaccgggacactcataaaacaagtaatcattcttgaggagattcaaaaacacgtcaaaatacacacacagacacaaacacacaagcacacactctcacatattctaagctacaggtttctagttggattttcaggtacataggcactctgtaacaaacagcatcagtcagctagtggataatgaaaaactaggcattttttaaaaaattcaactattaagtagcagaataaatgagttaatgataaaaacagaaaatacaacatggagcaaagtttaaagaaggtgaaaatcaccagtgtttagtatttcatgctctcccatgctcttttactctaacttgagttttaatcaacctctctctttctctctgtctcccatcccctcccatctacagaatatccagatactgggaagtagacctgtattagttcattttcacactgctgataaagacatacccgagactgggtaaattataaagaaaaagaggtttaatggcctcacaattccatgtggctggggaggcctcacaatcgtggtggaaggtgaaaggcacgttttacatggcagcaggcaagagagagaatgagagagaagcaaaagcagaaaccccttataaaaccatcagatgttgtgagacttattcactaccaggagaacagaatgggatggggaaaaccatccccataattcaattatctcccactgggtccctcccacaatacatgggaattatgggaactacaattcaaggtgagatttgggtggggacacaggcaaaccatatcaagaccccaggctgtatgttcagagcgaggtgtgccaagccctgggagacccacagctacccatcatcgagctgcttcaatgcatggcttcagagcctcctgtctccacctaaggggagtggggtgaccttcaggcagcctccccagtcccaaccaaaaaggtcggaagcaccatcctcccatggcaccacctcagacaacattctcccaccagccacttctttcaccggaacatatatacttgatcatgtccctacctggcagggggtttactttacttcctcttcacacttcttcctttgctacatcatccctagtcttcccgcactctcactcttttcccctaaatgcttcatgagtattccaggcataggtttcacagtttgataatcaccatctgctatcaaggaactattcatccttcctttttagttctgaaaaatgttaaaacatcctcctaaacacgtggaatgtttcttgtagaacctagaataaatgtcaattattccatattctccttacaaagtattacacatttgtgtcaacaatttctcttctgttcaatgaactcaagtaattacacaaattctctgaatagttattatccaaaacaaaggaactagaaaaacgtcatgttttcttaacagcaatagtttgctattgccgttataacaaattactacaaatttaaccccttcaaacaagacacatgtattgtcacacagtctgagggtccaaagtctggtatgggtcccactggggaaaatccaggtgtcggcagggctgcatctctttctggaggctctgggggagaatgtgtctccttgctcagtcaggtgttaggagaatccagttccataggttaaagggcagatgcccccttttctttgctggctgtcagtggggacctgctttccgagaagcctctgtgcttccctggcatgtggttgctacatctccaaaccagccatgacacagaatccagaaaaggtgtccacttttcaagattcatgtacttagtttgggtccacttggataatatgggatcatcctcctatctcagacctttaatttaatcacatctacagaatcccttttgccaggtaaggttatatctggacaggttctggggattagggtaaggacagttttgggtgtcattcttctctctgccacataaaagggatggatagggaggatgagcattttatccagtgtggggtatatatagttagggaagaatgctagacacatgaaccacagtcacagctgggccccagccagctatgtgattttgcccaggtcatacagtatggagggcccagcttctttcttttcttttattttaaatcgagccagtgtaacagatgcaaccttggttcatatccattcgtttcacgcatattacggagtgcctacacaatggctggcagtgtggcaggtactgggctgcggcagtgagcaaaccagagaaacccctgcctcttggagcttacattctggtgaaggaggatggacaatgaaagctgaacaggacagcagtaaaagaggtagcatgctaaagagtgatatgtaaatcaggagggatgtggggagatcaggggctgagagttctgtcattgtagacagaaaaaccagggatggaccccgtgagagagatctggggcagaatccccctcattttatgtcacaagagcacacagtctgttcctaggtaaacaagaggatgcatgtctgcccaccgcaagccttatctgtctgtattggacattgatggcttaggaccacttagcatgggttgcccagctcttcccttgacactgtcaagtctacataatattgtaataagattatagaataatgtctttttataagatagactcttgtaagtgagagaatgacgtaatagggatatcgagggaaaatattctaatctattaagtggcaaagtaattttacttgtcaattcaacatttcattaagtatttcaaatgacagcatccgaatatatggaatcttaccacttactctcaacccattaccttctgctttcgaaaacatacattctccatattacctgaagcttgttatgatttgcactagagggaaaaacaagaaaaaattccaagagaagtacaccctttccaccctacaaatattcagtgcattaccacagcaggcacattggtatttggaaatcaaccagctgaagtatttcccagagatgatgaattctcaaccaaccaactttcaaatgtgtttggatagaaagacatcagaacaaaatggaagaaacaaaatggaacattagattgaaaagttaggagacctgggtaccagaattagctcccactgccacgcaggataatcttgggtacataggtacgtacatcacataaaatctttccattcacttctctgttaaaaacataaaagggatcaggtgtggtggttcatgcctgtaattccagcactttggggggctgaggtgggcagatcatttgaggtcagtagttcaagactggcctggccaacacagtgaaaccctgtctctactaaaaatacaaaaattaggtggacatggtggtacgtgcctgtaatcctagctactcaggaggctgaggcaggagaattgcttgaatctaggaggcagaggttgcaatgagccaagattgcaccactgcactccagcctaggcaaacgagcgagactccatctcaaaacaaaaacaaaaacataaaagggtcacaataacacctaccctacttgatttacagaaggacttgaaggactgaataagagagtacatgttaaaaaccctacatacactccaaagtattagccacataaatttcaggaattattattgctactaaactgcatcagcgacttgcttcacataatcaacgtgagatctgaacattgcaggaaaacactgaacaagtacagggagcatttggatcacagtgcatcataaggcggcctcaggagggatcctggcgaatactttcatcaaacaagtaatttactgagcactcaaccatctatcgggcctggtaagagacacaggatctaaagaacgtggtaatgctcattactttatatgaagtattgaaatcagcacttgctgatttcttcaaataggaaacatggctttgttaccttaatgaggtcctccctggaggaaaaagtggagactaagtgattttctctggttttggcgttggtgatggatacgtgcagtcggttctgggccagctcgtgagcgctgggaggaagaatcgactccatcccacttctaaagaagaaaaagcaatctgaattactcacctttaattattgaactccctgtaaatattttacaagagagaatgctgagcttgccaaagtttgtacagagagtcgtcaacattctgtcttcatgtacttttgggcaaaatgtactctgtataccttagtcgggccatgaagtcataaccgggcgttactgccccgaaagactgccttctgatttcttcggcaaacttgtaggtaaattggttacattcctaaaaaaagaaaattaagaagtgaccctaggtgttgtaaagaaaacaatcattccacttctaaaacttgggattctatagacccaacagcaaatgtagggtgtcatgttattaaaggtgtgcaaattccccacctggccggggcctcacccaccactctcaggccctttgcaaggtatacactctcaagaatcctaatctttttttgttttttcctttgtaaagcaccttaaatggcctttgccccatctgaaaaatccttgaaggctcaatctgaattttaattgagcacattcttcaaaaggtttcctcagcgcaattaaccttctctcccacccctattttgtggtctcagcagcagtttgattacaaccgtgcaacaaagctgattacaaatgacagcaccagtgacagaaataggagtagtgacgtctatggtttgcacagactgaatcagagtcttcggagattcatcttgggcactggtattttataaagtctttcagggatgctcatgtctaccctggactgggatccacagaggtgacactgtcagttcatcttcacatcaccctgcagggtgggtataaccatcccacttgacagacaagaaaacggaggattggagagttcaagtgtctatcccaatatctcattaaaaatgagtctcagagccagaatttacatctaagtctattttgtattaaataatgaattaatttggcaaccaactgggcaccaggtacttggctaggcactgggacttggagaggacaagatacaaagaccctgtgctcatgagagtcataagtgcctccaagagcaggtcatagagggctataagagcccccacaagggtgtgtttggctctcatttagtgcaaaaaataaataacaacaggtaaactgttttgagaatatgaggacatcaagtctcaaattcaggtaaatcattcaatgtcttaacattgcagaatttcagttaagtggctatattattgcagcagtctctcctctccccacaaagatgtccacattctagtccctggaacctgtgactaggagaccttctatgttaaaagggactttgtagatccagttaaggaccttgagatgaggagataatcctggatgacctgggtaggcccaatatcatcacaaggtttcttgtaagggaaggagggaggtaggagaggcagagttggagagatttgaagatgctgtgcttatggctttagaaatcaaggaaggggtcaggagccaaggagtctgggcaccctccagaaactggaaaaggtaaggaaatggattctcccctggagcctctggagagagtgagcatggacattttgattttagctcagtgagacccttttagacttaagaccgccagagctggaagatgataaacacatgctgttttaagccactacgctgaaggtcctttgtcaaatcagcaacgggaaatgaatacagtgtgtgtcaacctccaacctcatgggttgccaaaggtttccctccaatttgacacccaggctgggacttaaatataaacaggagttgggcagaggacgaaggtgaaagcagaggatagtaaaaacaacagcaagaacaattctgagaggggcacagagctgaaatgtgtccctatggcgagccacaagtagggctaagtcacatggggccttgtgatacatgctgagaaacctgggtcacattgtcctaagtccacagacagcccctgccccgggggtaatgaggtgatcagatgtgcctttgggtgacatcactctaagcgctatgaggtaggtggattgtagggagcttgaattgatataggctgtgggaagctcctgggtgagaaatgggggtagccccaccaaatgtatgttcattctactgagctagactgcccatctagcctatttctttgtactaatattagttatattcaatactctccatagcccggaccagactgtaaacttattaaagatggacttattcatctttgagttccccactgagtctagcaccatggcttcctcgcaaattgtgagggctgaggaaagtcttgcagcattgagctcttccacatcaatgtctaaatttgcctaccacttaaaatatgcccagtatcaggtgctcctcttaattattcatgcataagctcagaagattaattacacacgtatttgtcacaacagtaaaaagcttgaggaacttatatcatcagcgagaaccgagcgaacacgaatctgagtaggtagaaacatttgctaaaaaaaactcaaggctatcctacaagtggattatttcagatgctaaaaataaaggaactaaaataaccttaagtcaaagggttactttggctgaaaaattattttgaagaagaacaaatgaggatgccctaaggaaactaagaaaattattttctaccttcccatgggagcaccagataaagacacacaccttttcatcataccagcaccatcagacaacacaacccagtctctcatttagtgcaaaaaataaataacaacaggtaaactgatctgagaatatgatgacatcaagtctccaattcaggtaaattattcaatgtcttaacatggcagaattttagttaagtataaatggctgtactagtgcagtatttccaaatcaggttaattctaaatcatacaatacattttttaatttgctgataattggaaaccaagtctacataactccaaagcttaggatttgccacagctcaagaaaagactgcagtaaaaaggaagaagtgacaccctgaaagccctctgcttcaaaaacgaaacacagttatgggaaggaggtagcttgtaattcaaagcttatgaatctgctagtttagggggaattttccgacctcatttataccttgcatggcttaaggttctggtcctgtttaatctctgcagtttttaaatcacttttctagttccctgtaaatcaaccatataaagacaggaagataggtggatttctgaatgattggcctcaaatctagcttccctttgataagcagctcacaaaagatctgaaatgagattctgatgtttaacattgcatagttttggaattttaaatgtgactgaaattcattcttgggtatgagggtgttaaattgttatttcattattgttcaaagctgctagagtacgtaatgattaacaaatataatattctccaactacggaatccagctctcacagtcagcaaatgattgatcactgtctggatagcagaaaacagattttaaaacatagattgcattaaataaagtacttaatgaataattatttgtattacttctggataaattgcttggaactcagagcttcctcttactgtgagaattaaaaaagaattaaattcctataccattccacttaatagaaactgcatgcccacattttaatttatgtatctatttctaagtagcagtgaggtaagacttgttgcccacatgttcaaggccttgaaaacaggccccatgctcttctcatgatcatagaaagaagaaatatcctttgcttgaaaggaacagagctggaatcttaaggataaataaaaactcaagagtaatataagtcattttatttccttatttcactatcacccaaaataatcttttccacaaccagagcacagatccctaataattacatcttaagagaaaagtcctaatcctttctgtttccaagcaaacgattatttctctgcagtgttaacttagtagagtcaatgctggtgtttgcctttgggtcttaatttcttgatgaggaacacagcctaagttactacttaattacctctattttttctggtgctgttagcagaacagaagcaaccaacgatcccgcagacgccccagcgaaggctttgacatccttcacaagttttttgccatgtctgcaaagtgcagatgctgcccccaagtggtaaatgcccagaaatccacacgctgcaaatgataggttgatgtgcttcattctagctgtagcactggcaatacaaaaaacaaaaatgctgtaagttggaatagtttatcccacatactgtgtagtcttatgttgatcatcgttccaaggctttcttctaacatcattctctgttttaagcacagtggtttcaattaattctaattaaacacaagaatctttcaaggaaaccctttctttccctcctcaccttgacccaagtcttatacattaaaacaaaacaaaacaaaaacattccacatttattcggtacatagattatgaatctacgatttaattacttggcaggaaacagacgtataaattccagttgacaagggcatttggtcttttctcttgaccctttgaaacgttttgcgggtgggggcggcactaccattatgaaacagaaaattattagagaccgtatcaaattccaaatgaacaatacatttgttcttggtaagtgtatcagaagatttcaaatacagttccctactccccttcccaatttctattgtgagcacccatgcttttatgaacgccaatacaattactcagtaacgcaataagcaatcactcaacaatgcaatacatttctttgccaagtatctcaacacaaactgaggtcatgcctggtgaaggcaatttaaggctctatgaaatgtcagccacgccactttatacttggaacacatctaaatacaaaattacatgttttcctatgcctcagtgcgcacaatttgcccaagtgaatgaaattgtgcctccacaaggctgtccattctgaaggtctcagggtttccttgggggcccaagggccccattcagggaccccaagatgaggcacattacagggcctcgaatttagggacctaagaccgcctgttcctgatgcacccggccaggccctgtgagggcaggtggctcggccgccgcaggctgcgctggcgtccgcgtaggctgagtcccagtcatcgatccggggtcaagccccagttttgattccacttctgcaaatggggacgggaagggggttgggtgtgtagcaaccaggcggccaggcccagccagcacaggctcagtgccctcccgcggcttggaggccggcagggccggggtggtccccgcatcagtcccgcaggagcacacccttgctgggccccagggctccgtaccaatgcagccccgggacacttccgtgttgaacgagtccctttaaccagatggcggggccgggccgtcactcaacgccattccgccaccaaggccgcgctacgctctccgcgagccggcccaggaaagtcctgcggcaggggttggtaccgcctcccgcgcaggtatgtgacgtcatcgcgccgacgaaggcgcccgctaggccccgcctgctctatttaaacttctggactcaacctggccgctagaccggagcgtcctccagcgcaggcaaggattcctcgtttagagtcatgttatcttcgagtacctagagagacattttaacccacaccctagagaggcgttgtaatccttacgtgtcttttaacgctacttggcccttacctgcgagcaactgacctttaataatcctcattttctgtgccccggaagtgccttaccctcttcgcgtct

SEQ ID NO: 449 - DNA, 28977 bp, Homo sapiens; identical to SEQ ID NO: 448
  source 1..28977: mol_type = genomic DNA

SEQ ID NO: 450 - DNA, 97 bp, Homo sapiens
  source 1..97: mol_type = genomic DNA
aatctatcactgctttttaggataagcttgacttttgttcaaataaaaatgcaaaaggaaagtgtatcctaaaaggcaatgacagtttaatgtgttt

SEQ ID NO: 451 - DNA, 126059 bp, Homo sapiens
  source 1..126059: mol_type = genomic DNA
ctatgccctagggctagtggaagacttaagatggcggcgtttgcacggagtgcaatcactgcgtccttacgggggttgcaaggcgtccgaagtatgagtccactaacaaaagtccagaaactcgccagttaatagtattgtggtgagtgatgagcctcacgttggctagagaagtggccgttagcgaggctacacactttgggatcgcgtggcctgagtcgggggagtaaccggcctgtattccatttttctctctccagtctcttcaaaatatcggagaataatttctttctcgctgatcgcctaacttctactgacgaagcttggaagttgcagaaggtagctcctaggagggatatatgggtcgttctttcctttttccttatttaaatgggtttttattgacaccatgtcgcgccaaaatggattccatctcctcagagctttcctaggaacagcctaacctcttgggcctaactttattttttttttgttctgcctttcatgtccagacttattagttttaattaatttgtttgtaacgtattcattatgcactagattaaacaatttttttctgtgcccactataccccaaatgtggagttttgggcaaaaacttaacatttgttcttgaagcatctcagaggtgtgtgtgtgtgtgtgtaatctttgggggacttacattgccaggttgattactcactaagaaaagagctagatttcctgttttcaaatctgttggcgaaattaagtttatgttaagcatagcatgtttactatatatatggggaagacagttaagagtgacatctaatatgttgttaaatgcttatgtgattaaagtaaatttcatgcattaccgcggagtatgaattgctgcaaccttttagaaaagaatctggcaatatttagggaaataaaaaatacagatatcacttgaacaaaaactggaattcaaaagtctgacttttaagaatctatcctacagaaataaaagtaccagtatataatgacgcatgaacaaggatacttttgtactattttgttcttgtgacaactggaaacaacctgtgtatccatcaataggagaatgtttgagtaaattttggtacataaatattatgaaatattttgacttttgacctagagaatcttatgatggatggttatgtgagaaaagtaagttgcagaatagtctagtatgagtccttttttttttttgatggggtgatgaaggaatgcaagattaacttctttatcttttggaggagacgttaaatatattatgaaatacttaagacatatacagatatacaaggaataatacaatgaacctctcttctcaccacccaacgtaaaaaaaaaatcaaacattaacgtgacagttgaagttctctgtgtacccatccctgattgcatctctctcttctctcatccccagaggtaaccattattttaaacttagtgatttttaccatgcatttcttaaacttctgtgacatagcaacttctagcatggattattttttgtaaatattgaagatgaatttttaaaaaaagtcaatgaaagaagaaagcaagtgtctatctgactttttttttttttttttttttgagatgaagtcttgcttgttgccccggctagagcgtagtggcgcaatcttggctcactgcaaccttcaccaccccagttcaagcgattctcctgcctcagcctcccgagtagctgggattgcaggcgcctgccactgtgcccggctaattttaatttaattttaatttattttatatatatatagagagagagagagggagagagacagacagacatggagtcttgctctgtcacccaggcaggagtgtagtggctcgatctcggttcactgtaacttccgcctcctgggttcaagcgattctcatgcctcagcatccagagtagccgagattacaggcacaccttgccacgcctggctaatttttgtatttttagtagagacgggtttccctatattggccaggctggtctccaacccctgacctctggtaatctgcctgcctcggcctcccaaagtattgggattacaggcgtgagccactgtgcccagccttatctgactattactgtaacagtggccaatcaaaattccttcttttctttttttttttccttgagcctagaaatttcttaattgaggggagaatctagcaagcagttgagtcaaagggtgtagattatactacagtggtaaagaaagtaagcagctggcagtgaaagcaatctcaagcaaataatgaatgttccatgaacaagatgcctgaattgaaaaacagaacaaaaccaactaaccaaacaaaaaacaatccgtggatcctaactcaaatccaaggtgatttgagcctgcacttgtaattagacaaaatctatgaacttcagttgccttggaggcatctgagggaaatgaggttgcatgtagatgaatcagttgtttctggcatcatgttagtgtgattacatttagctgctgtgtgcaaaacattttagcaatcatttaggtccaggacgtggaatttattagtgcaacaaccctgtaaacagtggttagaacattaataattttattttatttatgttttatttattttttgagacggatttttgctcttgttgcccaggttggagtgcaatggcgcgatctcggctgactgcaacctccacctcctggattcaagctattctcctgcctcagcctgccgagtagctgggattacaggcatgtgccaccgcacccagctaattttgtattttttagtagagatggggtttctccatgttggtcaggctggtcttgaactcctgacctcaggtgatccgcccacctcagcctcccaaagtgctgggattacaggcgtgagccaccgcgcccggccagaacattagttttaaacttcctaacccttgggagaaggcaaaacacttgatgaaatctacataaagactaaaacattttaccaattttgcattgtttgtttgaaattgcattgacgactggtatgttaattttgtatatatttttatgagaacaatgttggacatcatttaatttttttaggtttttttaattgattattgattggttcatttgcaggaactgactattagtaatcaaggatacaaattgttaagagaatatgttacagagaaaaacttgacaagctagacttagatttttgtcgttaaagataatttgtgggatatgatttttataaggagttgcattaaatagaatgtcttacacagatttaagaggttaataattataaaattaagatgagttcttataaaatattcttgaggtataataaaattatacttgtggagtatatctttgaataacatttaaaagcaaactaatactttccaggtaaaataattatcaacataactttttaaaaataattcatagtacttcaggttatttctatgtttgacacattaacttaaaagaaaaaaggaaaatggtgattagttaatgccatacacactggacagaaaagaaacttagctcttatggattcctctccatattttgcagcagggtaaatgtaagttttcttacgtagctagatactgtgttccagtgctgttgatgttgtactgttttagcaatgaagagattgatatgggctgattgggggttagggaaagtgaagcagcagaaccagaacagagtggacatttaaagggtgctaataagtaaataattatgtgaagtagcatactggtcgaaatgcataactcaaagataatcgggaagcgtattttcttttcttttcttttttttttttgagatggagtctcgctctgtcgcccaggctggagtgcagtggcacgatcttggttcactgtaagctccgcctcccaggttcacgccattctcctgcctcagcctcccaagtagctgggactacaggcgcctgccaccatgcccagctaatttttttgtatttttagtagagacggggttttaccgtgttagccaggatggtctcgacctcctgacctcgtgatctgcccgcctcggcctcccaaagtgctgggattacaggcttgagccaccgcgcccggccgggaagcatgttttctgaaacataacctaagaaagtataaatgctgccttgtgcctacaatcctggtgacaagagcaagacttcgtctcaaaaaaaaaaaaaagtataaaagctccttaaaggatgtttcaaaataatgaataatattaatttctatattgtatattcacaaatgttctttctagaataattatttgcttaatggggtgcatgtttagttggtgagaaatgaattaataggttagtgatttattatctgttgggaaaaattttagacattcacatgaaagtagagagaataacataaatgaatttccatatatggatcacttagatttagcaaccgttatgattttgccttacttgccttttcccccaaaatactgtaaagtaaattacagttatcatgacattttcttctaaataagtcaatataaacatataataaacaaggacctttttctatatagtcacaatgccatcactatacatagtaggattaacagtaattccgtaattttttttttgtttttgagatgaagtcttgctcttgtcacccaggctggagtgcaatggtgtgatctcggctcactgcaacctcgacctcccgggttcaagtgattctcctgcctcagcctcccgagtagctgggattacaggggcctgccaccatgcccggctaatttttgtatttttggtagagatggggtttcaccatgttagccaggctggtctggaactcctaatctcaggtgatccgtctgcctcggcctcccaaagtgctgggattacaggcgtgagccaccgcgcccggccattccttaatgtttaacacccagtgcatattcagattttcccagttgtccgcaggatgtcttttatagctgctttcttcaaaccaggatctattcggagaccacacattgcatttgatttttatgtcttttgagccttttaaaatttagagcagttccctataaccccttcttttgtttgttttatgaaattggcttgttgaacttcacaaaacacgagttggggtcatgccaactgtaccgttagtgattagtttacatatagggaaaataatttgtgaatgttggtccattcactctgccagctataccatggcagcatttccagtatcaggaaagcaaaccaggggatctaaaactgagcattaaaaactctcccctatccagtgaaagagataagaatgccagttgtgagaaaattgaaggggaaacggagaatgtcagtgttaaagatatttgaactttttttttttatccatttgaaaggtattttttttgggtgaactatttgttaatattcttggtcctgtaaaaaaaaaattggtgtttggactttttcttattgtagacactcttcataaattaaggaaattcgcctttttttgttataatattgcagactttttttttttttgagatggagtcttgctctgtcgccaggctggagtgcagtggcacgatcttggctcactgcaacctccgcctcccaggttcaagcgattctcctgcctcagcctcccgcgtagctgggactacaggcgtgtggcaccatgcccagctaatttttgtatttttagtagagatggggttttaccatgttggccaggatggtctcgatctcttgaccttttgatccgcccgccttggcctccgaaagtggtgggattacaggcatgagccactgcacccggcctgcagatatttttttcagttagctacttttcttttcactttatagtatttttttacttaattgtggcacaatacacattagtgttttagccattttaaagtatacaatttagtggcatttcatacattcacagtgttgtgcatccatcactgctgtctagttccaacagattttaatcacttctaaaagaaaccctgtactcattccctttgccctctatcccatggctactaatttgctttctgtttatggatttgcctgttctgaatattgtatacaagtgggatcatatatagtagacccttgaggaatgggggggttagggtcaccaacccctcatacagtcaaatctgcataaaatttttaattccaccaaaacttaactaatagcctactgttgactggaagccttaccaataacatagtcaattaacacatactttctatggtaatttattatctactatattcttgcaattagctagagaagaaaatgttattaaaaatcagaaggaagagagagtatatttacgattcattaaatgtaagtggatcatcatgaaggtcttcatcctttttgtcttcatgttgagtaggctgaggaagaggaggggttggtcttgctgtctagggagtggtagaggtggaaaagatggaggaggcaggagaggcagacatacctggtgtaacttttactgaaaaaaaatacataaaagtggacccacgcagttcaaaaccatgttcaggggtcaactgtaatatgtgatctcttgtgtctgacttctttcatttagcataacatcttcaacattcatccatactgtagcatataatttgtacttaattcctttttatgattgaataatctatatatgaatgtaccaccttttgttcatcagttgatgaatgtatttacatgcatttaaataaaatttttttttttgggttttttttttgagacggattctcacccaggctggagtgcagtggcacgatctcggctcactgcgacctccgcctcccaggttcaagcgattcttctgcctcagcctcccgagtagctgggattacaggcacacgccaccatgcccggctaattttttttgtatttttagtagagacggggttttaccatgttggtcaggctggtctggaactcctgacctcgtgatccgccctcctcggcctcgcaaagtgctgggattatagtcgttagccaccgcacacagccaagaaaatgtatttaaagaaaatatggggctgggcatggtggctcacacctatacttccagcagtgtaggaggccgaggccggcagaacggttaagcccaggagttcgagactaacctgggcagcatgatgaaaccccatctctccaaaaaatacaaaaattagctgggtataatggcctgcacctgtagtcccagctacttgggaggctgaagtgggaggatcgcttgagcctgggaggtagaggttgcagtgaactgaaatcacgccactgcactccagcctgggcaactgggtgagggtctgtctcaaaaaaagaaaaaagtaagacaatatggtataaattggggatggtgaagggacataaagaaaagttagtttctaaactggacttgaattaatgttgacagccgtagaatgtaataagtaatgtatatatataatgtgaagcaaccactaaaaatgccatgcatatatgcaaaaactctagagaggaatcagaattttataaaatgttcagctaactcacagaaaggcagataaaaacagacaaatagaaaactaagaacaaaggaaaaataaatcgcagacttaaaccctaacatatgaacaattacattagatttaaatcgtttaaatgtaccatttaaaagataagagattttcagagtggcaatgacgtaactgtatgtgttaatatgagacttcaaatatgactatataggctgggcatggtagctcacacctgtaatcctggcactttgggaggccgaggtgggtggatcacctgaggtcaggagttcaagaccagcatggccaacatggcaaaaccccatttctactagaaatacaaaaaattagccaggcgtggtggcacacacctgtagtcccagatactcgagaggctgaggtaggagaatcacttgaacccgggaggcggaggttgcagggagccgagatcgtgccactgcactccagcctgggagagagagtgagactccatctcaaaaagcaaacaaaaaacccccccaaatatgactgtataagcagattgaaagtaaaaggatgggcaaagatataccatgcaaactttaatcaaatgaaagcagtactggctatgttagataaagtaggcttcagacaaattactatagacaaaagagggatgttttataatgaaattcaccaagaagacatggcagttctaaagcacctgtatcaaacaatagagctacaaaatatgtgaagcaaaaactgctagaactgaaagtagaaatagacaggtccataattatagttggagagttcagcagccttctcacaacaactggcagaacaattagaaaatcagcaagtacacagttcaacaatgtaataaaccaacaagatctaattgccatttatagaatgctcaacaactgtagaattattacattttgaatatattatatgttatatattttatatatatatattttatatatatatatatattttgagacaagagtctcgctcttgtcacccaggctagagtgcagtggcgcgatctcggctcactgcaacctctgcctcctgggttcaagcgattctcctgcctcagcctcccaaggagctgggattacaggtgcccgctaccacgcctggctaatttttgtatttttagtagagacggggtttcaccatgttgtccaggctggtctcgaactcctgaccttgggtgatcctcccgcctcagcatcccaaagtgctgggattacaggcgtgagccaacgtgcctggctgaccccaaatacttttaacaaagtattaacacattgattccagcaatatatgaaaagaaattgatagaccacgaccaagttggaatttttatagttatataagattggttcagcaattgaaaatcaatcttatggatatgtaagattggttcagcatttgaaaatcagtcaatataatgtactatatcagcagtctgaaaaacaatcataattgattatattgatgcagaaaaaaacatatgacagagtcaaatacctattcttgataatgattttcagaaaatgaggaataagtatctataaaaaaactgtagctgatattatacataatggtgaaaaactgactcttacccctaagatcaggaaaaagcaaaggatgtccattcttatcttccttattcaacatagtaatagaaattcaagccactgtagtgaggtaagaacaagaaataaaagatatcccaattggaaagaaagacatttgtccctatatgcagatggcatgattgtctatgtagaaaatctcaaggaatctaaaaaacaacccccaaatttctagaactaatgagttagtaacaccacaggctaaaagatctacacacaaaaatgaatgaatcacgttgcttttttttttttttgagatggagtctcgttctgttgccaggctggagtgcagtggcctgatctcggctcactgcaatctcggctcactgcaatttctgcctcccgggttcaagtgattcccctgcctcagcctcctgagtagctgggaatacaggcatgcaccaccatgcccggctaattttttgtgttttagtaaagatggggtttcaccatgttggccaggctggtctcgatctcctgacctcatgatctgcccgccttagcctcccaaagtgctgggattacaggtatgagccactgcgcccggaatgaatcacatttctatatactagcaatttaatatgtggaaacggaaattatatacaaagtaccatttacaagcactgcaaagaaacacaacatttagacataagtaaacatgtacaggacttgtattttgtaaattacaaaatgctggtgaaagaaactcaggaagtcctatataattgaaaagacttatcatgttcatgacttgggaaactcaacatagtaatgatgtcaattctccacaaattgataggtttaatggaatttccatttaaatcctagtatgtttttgtagatatagaaaagcttattttaaaatgtatgtggaaaggcacaggccttaaaatagctaaaaccatcttgaaaaatagtacattggtagaatcattaacttgacattaatgcctactatattcctatattaagacagtgttgtattggtggaggatagacacataaatcagtgtaacataattgagaactgagaaatagacatatacaattaggcccgactgaattttgtcaaacgtggaatagcagttcagtaatgaaagaaagcctttttaacaatggtgcttgaccaattgtccatctgtaggcaaaaagatgaacctgagtctcatatctaatacaaaaatgtactcaaaatgaattagagacttaaatgtaaaacttaaaactataaaacttttagaagaaaacataggaggaaatcttcagtttgtgctaggcaaggagttcttactcttaatatgcttaaaaggatgatctgtaaaaggaaaaattgatgaattaaattttattgaagttagaaactcttgttctgctaaagactctgttaagagaatgaagagaggctacagagtaggataatttatttgtaaaccacatatcttgcaaattaattgtatttagaatacataaactctggaaactcagtaaaaaagcaaccagtccaattagaacatgagcaaaagacatgaagagattatttcatggaagaagatacacagatggcaaataaaataaaaggatgtttaacattattaaccattttggaaatgcacattaaaatcacaacagaaatcactgtacacttatcaaatagtcataacaccaagtattggttaggatgaagagaatatggattacttatccactgctgattggaatgtaaaatggcatagcccctctgggaaactgtttggtagtttcttattaaaataaacctgcaggccaggtggggtggctcactcctgtaatcccagcactttgggaggcagaggtgggctgatcacctggaggtcaggagtttgagaccagcctgaccaacgtgaagaaaccccgtctctactgagaatacaaaaattggctgggcgtggtggctcacgcctgtaatcccagcactttgggaggccgaggtgggcggatcatgaggtcaggagatcaagaccatcctagctaagatgaggaaaccccgtctttactaaaaatacaaaaaataagccgggcatggtggtgggcgcctgtagtcctagctactcgggaggctgaggcaggagaatggcgtgaacccgggaggcagaatttgtggtgagcagagatcgcgccactgcactccagcctgggcgacagagactctgtctcaaaacaaagcaaaaattaactgggtgtggtggtgcatgcctgtaatctcagctactcgggaggctgaggcaggagaattgcttgaacctgggaagcggatgttgcggtgagccgagattgtgccattgcactccagcctgggcaacgagcgaaactccgtctcaaaaaaacaaaaccaaaacaaaaaaccacaaacctgcaactaccatatgacccagcattttcattcttgagtgtttatcccagagaaatgaaaacttaacgttcttgcaaaaatttgtgtatgaatgttcatggcatctttgttcatgatagtaacaacacagaagtgcccagatgtcctttaatgggtgaatggctaaacaaatggtggtgcattcataacataataccacacaggaatgaaaaacaaagctgatgcacaaaacaacctggatgaattcccagagaattatgctgaatgaaaaaagccaatctctgacgtatagttacatactatattatactatttacataatattctttttttttctttttttttttgagatggagtctcactctgtcgccaaggctggagtgcagtggcacgatctcggctcactgcatcctccacctcctgggtacaagtgattctctgcctcagcctccagagtagctgggtttacaggcgccagccaccatgctcggctaatttttgttttagtgattctcctgcctcagcctcccgagtagctgggactacaggcgcgcgccaccatgcccgtttaatttttgtatttttagtagagatggggttttactatgttggccaggctggtcttgaactcctgacttcctgatctgcccaccttggcctcccaaagtgctaggattacaggcgtgagccaccgtgcccagcctgataccttgttttctacaagaatgttaggttaactgatagggaagttgtcactgagtagacatcagataatgtttttgggatagggcaataagccataaggtgggggcagatctaggggaacatctagctgaggtggtggccaatagttttcttttttttcttttttttgagaagaagtctcactcactcagcccaagctggagtgcagtggcacgatctcggctctctgcaacctccacctcccgggttcaagcgattctcctgcctcagcttcccgggtagctgggattacaggtgcccgccaccatgcccggctaatttgtgtattttcagtagagatgaggtttcactgttggcgaggctggtcttgaactcctgacctcgtgatccacccgccttggcctcccaaagtgctgggacaagcgtaaaccaccacccccggccaacagttctcaatatgtggacctttcaagggatctgtaaagtgaaagctgtttttcttaatactaagttgtttttaccgtattgacatctttactgatggtgttgaagcagtggaaaataaacattttacctgaatacaaatcaaggtagtggcaccaaattgtatcagtagtcattgtattcttcaccccacacctgtagttttttttaaaaaaagtcagtttcttttaagaatgtctttgatgagggtggggcaccgtggcttatgcctgtagtcttcgctgcttcgtaggctgaggtgggagtctgaggcgggaggattccttgagcccaggagttcgaggctaagagtgacctgtggtcgtgccactgcactccagcctaggtgacagagtaagactctctcaaaaaatgtctttgatgagcagtaaagttactagtttcattaaatatggacccttgagtacgtgtcttcttaatatggtgtgatgaaaagggaagtatgcgtgaagcagttctgcaaactgaattttaaattatcttgaggaaaatcacctgtaacattgtcagcaagctgtactgctcactttttaaaatttacaacattatacttagaagaataactaatagacaagctacagttttttacacttgggtattgaccagatatgtttttctaaataaaatgggcttatcctttcaaggaaaacaactgatagtacttgttgcctattttaaattagctttcaaacaaaatttagaatttctgtatacttgtatctacttctgtgaacttgatagcttcccagtacttaaagacttttctgttaacatcagattttaaagaaagtggtttttaaatattgcttaatgaaatatgtcaacatttgaaacatctgcattgctcagtgaaacagtattttgtaaatgatccatttaggatgttaaaaatcatgcatggctgggcatggtggctcacgcctgtaatcccagcactttgggaggctgaggcaggtgaatcacctgaggtcaggagtttgagaccagcctggccaacatggtgaaaccctggctctactaaaaatacaaacaattagccaggcgtggtggcaggcacctataatcccagctactcgggaggctgaggcaggagaattgcttgaacccgggaggtggaggttgcagtgagccgagatcacgccactgcactccagcctgggtgacagggtgagactccatctcaaaaagaaaaaaaacacaaaacaaaaaaccaaggagtatgactgccggttcatatggtaagagtatatttagttttgtgagaaaccacgaaactgtcttccaaaattgctgtactgttgatgcattcccaccagccatgaatgagagttcctgttgctccacaatctcaacagcatttggtgttaccagtgttttggattttcaccattctaataggtgtgcaatgggactgtttaatttgcaactccctaatgacatacaaagttgagcatgttttcatgttcttatttaccatctgtatatgttctctggcgagatttctgttgacatcttttgtccattttaaaaattgggctatttattgagttttaagtgctgtctgtatgttttaggtaacagtcctttatcagttatgtgttttgcagattttttttgacttatcgtttcatattttaatggtgtcttttgtggagtaatttttttttaattttaataacatttagcttgtcaatgatttcttttatggattatgcttttggtattgtatctagaaagtaattgccatacccagtgatgtctagattttctcaaatgttggagttctatttacagttttgcattttacatttaggtctggcatccattttgaattaatatttgtgaagggtgtaaagtttgtattagattcattttttggcatttggatattcagctattccaacactatttgttgctccattgtattgcctttgcttctttctcaacgattagttgactatatttatgtctctatctgggctctttattctgttccattgatccatttatccattccttcaccaatttcacactgtctggattaccatagctttttattaagtcttgaagtcaagcagtgactattctttttttttttttttttttgagactgagtctcgctctgttgcccaggctgaagtgcagtggcacaatcctggctcaccgcaacttctgcctcctggattcaggcgattctcctgcctcagcctcccaagtagctgggattacaggcacacaccaccacacccaactaatttttgtatttttagtagagacgggcttttaccatgttggccgggctggcctcgaactcctgacctcaagtgatctgcccgtcttggcctcccaaagtgctgggattacaggcgtgagccactgtgcctggcgcagtgactttattatttccccttcaatattgtgatggatattttgagtcttttggctctccatataaaattcacaatcagtttgctgatatccacaaatatgctgggagtttggaattgcatgaaatctgtagatgaagttgggaagaagtgacatcttgacagtattgtctttgtatccacaaacatagaatatctctccatttgtgtaatttttttttctttcattagacttttgtagtttttttttttcatatagatcttgtatgtattttggtagatttatacctaaatatttcatttttggggctgctagtgtatatgctattttgtttttaattccacctgttcattgctggtatattgggaagcaattcgctactgtatgtgtgtgtgtgtgtgtgtgtatatatattttgagacggagtttcactcttattgcccaggctggagtgcaatggcgcgatctcggcgccccacaacctccgcctcccaggttcaagtgattctcctgcctcagcctccctagtagctgggattacaggcatgtgccaccacgcctggctaattttgtatttttagtagagacagggtttctccatgttggtcaggctggtctcgaattcctgacctcaggtgatccccccgcctaggcctcccaaagtgctgggattacaggcatgagccaccgcgcccggccttgctactgaatatgaaccttggttttttttggttgattgttttggaatgtctacatagatgatcatgttatctgtgaacaaagacagtgtgagttcttccctcccagtgtgtgtaccttttatttcctttttttttgtcttatttcattaggtaggacttccagtacaatattggaaaggagcggtgagaggagacatgcttgccttgttcttgatcttaatggaaaggtgttcagtttcttaccttttttttttttcttttttttgagatggagtctcactcttgttatccaggctggagtgcaatggcacgatcttggctcactgcaacctctgcctcccgggttcaagcgattctcttgcctcagcctccctagtagctgggattacaggtgcctgccaccacacccagctcatttttaaatttttaatagagacagggtttcactatgttggccagacttgtctcgaactcctgacctcaggtgatccgcctgcctctgtgtcccaaagtgctgggattacaggcgtgagctactgcgcccagccagtttcttacctttaagtatgttgttagttgttaagttctttataaagttgaggaagttcccctctattccaagtttgctgagttgtttttactatgaatgggagttgggttttgtgaaatgctttttctccatccatttaaatgatcatgtggtttttcttctttagcctgctgatattatggattgcattagtagattttcaaatgttgaaccagtcttgtatacctgatataaaccccacttgttcatagtgtatattattttctccttctctgtgagttttggcaccttgtttctttcaaggtattggtctatttggtctattttaccttttttagtggttgccctagagcttgcaatatatatttacaagtccattttgaagtaacactgcattacttcattgatagtgcaagtactttttaataacaaaatagttctaattcctcttttttctcccttgtgtctttgctatcattcatttcatatgtacataaactataatcattgaatatattgttagtattcttactttgaacaaacttaactgattaattaagaataaaataataaaagtttttataatagctttacttattccttttctgatcaagaagaaattcttcttcctttctttatgtagatctgagtttctgagctgtatagttttccttttccctgaagaactttttttgaaaaacgtttctgacaagctagatctacttacaacaaattccttcaatttgtttttgtctgagaaagagtatttctcctttagttttgaaggatgattttgcaggtacagaattctaggtttttttttttcctctctctctaaaaactcttaagtatttcagtcttcttgcttgcatgttttctgagatgtcagatataattatctttactcctctatggtaaggtgtttttttctccactgggcggtttctttgaagattttttcctgtatctttgattttctgcaggctgagtaggatatgcctaggtgtagttttgtttgtttgttttggcatttatattgtttggtgttctcttagcttcctgaatttgtagtttggtgtctgacattaatttggggaaaattctccatcattattgcttcaaatactacttttccattttttctcctctgttattccagttacatgcatgttacaccttttatggttgcacggttcttcaatattctgttctttttttttttttttttgagatggggtctcactctgttgcccaggctggagtacagtggcacgatctcagttcactgcaacctctgcctcccaggttcaagcgattctctgcctcagcctcctgagtagctgggattacaggcgcctgccaccacacccagctaatttgtgtatttttagtagagacgaggttttaccatcttggccaggctggtcttgaactcctgacctcgtgatccacctgccacaacctcccaaagtggtgggattacaggcgtgagccaccgcgcctggccggttgttgttgttgttctttttttttttttagtcatttctctttgatttttagttttgagagtttttattgacatatcctcaagttcagagattcttttcctcagctgtgtccagtgtacagagtctatcaaagtcattcttcattgctgttgtagtgttttagatctttagcatttgtttttgattctttctgcatctctgcttacattacacatgtatttttgcatattgtctacttttttccttagagcccttagtatgttaatcaaatcggagttattttaaatttccagtgtgataatttcaacacccatgacatatctgtctggtactgatgcttgctatttctcttcaagcaatgttttttactttttaaaatgccttgtaattttttttttttttttgaaagccagacatgatgtattgagtaaaaggaacttcggtacacaggcctttagtgatgtggtggtaagatgtatggtaagtggaaatgttctgtatacctacgattaattcttagcctgtgctcctgggctgcgaactttgcaactgcttctcagtcttctctatcctccacttatatgggatatgatggctagagggggctgagttgggtagttcctttaccccaagagaaaggctagaggggcaggtaatgggtatttccctttctccaggtcagttaggctctaattaagtagtttgtcttgagtggaggccttgatatgaacagaatgctgttatgtatttcaaaatggttgtatgttcttcccctgctggaagtgagacaggaaaagttcccttgttcccctcgcagggcacgcgatgagggtgtggattgcttcttcagtgcctgctggctcaaaactctaggtggagcatgcagtcaggcaggctgcggggctctgaccccacggcagtgtctagggttgaattttgtttttgttttttgagatggagactcactctgttgcccaggctggagtgtagtggtgcgatctcggatcattgcaacccccgcctcccaggttcaggcgattctcctgctcagcctcccaaatagctgggattacaggcgtgtgccaccatgcctggctaatttttgtatttttagtagagacaggatttcaccatgttggtcaggctggccttgaactcctgacctcgtgatccacctgccccagcctcccaaagtgctgggattacaggcaggagccactgcacccggccctctaggagtgaatgtttacagctgaagccccagtgggcatttgttacagggtgctcttttagtttagccgtccataggtagcttgtgttagtcagcacaattaaaccccctgccttatggcaaggacagagaactttctgtatcctggggttcttgccttgttgtactggaagaattggatcacacgtgggcttgagtgcaaggttttattgagtggaagtagctccaacagatagggttgccagaagagatagggttttcccctggcgttaggctgcttggttgcccaggctctcctccgactgcccaggccaaactccacgtcattcaaccggtcatttgatggcctgccagcatctgttggtgtgctcttccactggcatcctccccttgacgtcctcttgacgtccagccgcttgtgtcttctgctgctgctgtgttcctttcaacgtccagctgcttgtgtctctgcctgctagggtcttggggttttttttgtttgattgagatggagccttgctctgtcatccaggctggagtgcagtggtgcgatctcggctcaccacaacctccacctccccagttcaagcgattctcctgtctcagcctcttgagtagctggaattacaggcacctgccactaggcctggctaatattttttcttttttgtgtgtatttttagtagagtcagggtttcaccatgttggccaggctggtcttgaactcctgacctcaggtgttccacccacctcggcctcccaaagtgctgagattacaggcgtgagccattgcgcctggcacattacttctttaagtgtggttttctttagttctctgaacatgtttgtattagcttccttgatgtctttgtctgctgtgtttgagatctgtgcttttgcgttggcgagccccagcacaagggtagtttcagtgatttgcaaggacccacaggactggcgtataattgtactcatggatatgagttattcctgtgaaaggatacaaagcaaaatcagcgaagggaaaagatgtctggggctaaagtttgttagagccaggtgcaagcctccaagtgttctcttccaagtatggtcacacaggacatacctcatttctccaggaatgcattctgagaacacatatgaagtgttgtctactagggaagctcattagaggctcagtgaccatagcttttattgggggctggtcatgcaggcaccctttgcctagcacatagcaaaattccaggcttgcggaaggaaagcaggtgttcagcacaaaccccattgtttatacagtttagccacagtgagccattcttatcagggaatagtggcaactctcttgaaatccaggttctcagatgccagctaagggccatccttgaaggcaggcctttttaagtataacagtcttgggcctcaaatgtaaactctatatcaccttctcaaggcatttttctgttacttgctttttggtttcttatatgaatctcactttttttaaaaaatacctcatactttttgctgaaacctacaaattttagataatatattgcagtgatttctggatactgctaccccctcctctactgtggggctcattggtattgtttacttctttgtttagttatttgccagaacttatagtgttttttttgttgttgttgttttttggttttttttttttttttttttgagacggagtttttgctctgttgcccaggctggagtgcaatggcacgatctcggctcacagcaacctccgcctcctgggttcaagcgattctcctgcctcatcctccagagtagctgggattagaggtgcccgccaccatgcctggctaatttctgtatttttagtagagaggaggtttcaccgtgttggccaggttggactcgaactcttgacctcaggtgatccacccgcctcagtctcccaaagtgctaggattacaggtgtgagccaccgcgcctggctgtgatgtgttttttaacctacagtgtacatcctttggtgtccctctttagtgggacagctttgggaataagcatagtcactatggaatgattggttttagcagggctgtctttcagtgtctttttctaatttctctgttaatctgtcagcctctgttatctcacctaatcattagtttgcactaatttcagactgattactctattggttttgaccatgtccaggggcataaattgcctaactatgtgatccaaatttgggcccttttatagagatagtatttgagaccaacctttgaggttggctcagatcccaggtaggctcttatttgtctttttctctgggtctctggctgtcttctagctggtgtttctatagcttgttgctctcaagtagttactaatcttctcttaatagcttaccacccaaatctctattgttattgggaacatccttaggcttttttttctccccattgtgttccaaattaagtcatttattttggggataccttcagaactctgttattgcagcctgcctttcccctcgggcaaaacctctgcattgctgctctggagctgagggcaaggaaactgtctcagttttccctgtgacgcaagcaaggtgtttggcaggggaagatggcctctggttttcctaaatgtcaccctaaggttaagtcttccctttgtgctatgtctcagagaatgtttccacattattgtttctttctcagtagtggtcctcttggtgttgctatatgacatttttagcctggtcactggttggcaggagtgtgccctatctgttgttttattaattaaggcttagttttaggcaccagtgtcctggggtctcgtggttgtgttatactcagtactcctgcctcttcctcctgctgtaattttggacccattgtgtatttctgctctttcttcatagctaattttttttttctctctatttcattctcccagggtcacagtttttacaactatcctaatggccacagtgtttgttgcccttcctcccactgagtaaggactttgttttgtagatggagtaggatctgaacagatttctttgaccttcccaaaacagattttgttcccctctcccaggtgtgtaccttgagggtagtttctcaagactgtcatcaatcttttgtgtgatctcttgaatgggttagtggagaaaatacctgaatagtctgcagacctctcaattctgtgctgccccaccctgggcttcatacttacttgccagttaacacttaccctttgccaattgaccaaccattttagttgatctcttactgatgtctggttgcatctactttcacaggtaagccgggggtgtgtctcatcattcctttggggcaccacaacttagattttggttggccccagtaagactcctgtctctgggggattcaaggaaagttgtgaacttctttcctattctcctaccctctttatttgtaagggtgaaagtgatgctctctctagctctctacctaccagaaccagatgatgttttctagtctagtctggtactgtctttcacttactgtgaagccccattatatttactgtgattttcttcatattgttggatttatatctctaatttaaaaaaatgatttggtttggaatggttttttcataatgcaatccaaagtatcatagtccccatggtttcttagtctttccctgtttctcatgaccttgacagatttaaaaagtgtactggttaggtatttggtagaatatttctcaatttggatttgtctgatatagtctcatgattaaatgatatgaattttggggaagaataccacacagatataccattctcatagcttcatatcaggatatatatgtatacatacacacacacatatacacacatatacatacatgtatacatatacgcacatatatacatatatacatatacacacgtagacatgtatacatatacacacgtagacatgtatacacatacacacgtagacatgtatacacacgtagacatgtatacacatacacacgtagacatgtatacacacacgtagacataaatgcatgcatatacacacgtagacataaatgcatgcatatacacgcgtatacatatatgcgtgcatatacgcacgtatacatatatgcgtgcatatacgcacgtatacatatatgcgtgcatatacgcacgtatacatatatgtgtgcatatacgcacgtatacctatatgtatgcatatacacatgtatacatatatacacacatatatgtatacatacatatatatatatatatatacacgattttagcattacttattactgaggatgttactcttaatcacttagttcaggttgcccggtttctccactgtaaagttactgtttttctgtttccatcctctatgctttggaagtgagttactaaatttagtccacatttaagggaagcagaattaacctccatatctggaggggtatctacctgtatatatgtatttatttttgggaaattttctctaaggaagattttttttctctcccttatttatttggtcatctgtttctatcattctggattcgtgaataattattaatttgttaattatacataatcccacatcttttttttggagctattgcttactttctggtacaaggtagtataggcttatcttgtattctccctgcaccagccttacttttagccattttaataaggagcccgggtactttttattgaaaaatacatttagaaaccatggtctgagcactgagtgcccttttagttactgaggtagcactgattctgtacctcctaaacagaaagctagaaaatatatgtatgcatagtaatgtttggatctatttaattatttttacatacacatgtatgtagctatgtgtccattaaagtaaacatgaatgtacagtgatatctgactcttatttgagattagctctcatacttgcttattttatttatatatttattttttgagaccgagtcttgctctgttgcccaggctggagtgcagtggcatgatctcggctcactgcaacctctgcctcccgggttcaagtgactcttctgcctcagcctcccaagtagctgggattacaggtgcccatcaccacacccagctaattttttttgttttttttttttttttgagacagaatcttgctccgtcgcccaggctggagtgcagtggtgcaatctcggctcactgcaacctctgcctcctgggttcaagcgattctcctgcttcagtgtcccgagtagctgggattacaggcatgcgccacgacgcaagaaaatcacttgaacacaggaggtggaagttgcagtgagccaagattgcaccactgcactccagcctgggcaactgagcaagactctgtctccaaaaaaaaaaaaaaaacaaaacagtctgggtgctgtggctcacacctgtaatcccagcgctttgggaggccgaggtgggcagatcatgaggtcaggagatcgagaccagcctggccaacgtggtgaaacctcgtctctactaaaaatacaaaaaattagccaggcatagtggtgcgcacctgtaatcccagctacttgagaggctgaggcaggagaatcgcttgtacccaggaggcggaggttgcagtgagcagagatcgcaccattgcactccagcctgggtgacagagcaagacttagtctcaaaacaacaacaacaacaacaaaacttctttctctaatagtaagaaaactgagtcctgttatctatatttacttgtttgttctactttactatacatttaaagtggttttataactgcctaagttcctgtaaaaattttatcagttagcattaatattgtacctttattacagtttctaaaaatgctcaagtgttttcacattattccttgtagatgtcatatagtttatctttttacctttaggtccatgatccattttaattaatatttgaatgagcgaggtaatatgttgtcactttttttggtatgtggtcctctagttgtttcagcaccttttgttaaagagattgcaggccatgcacagtagctcacgcctgcaatcccagcactttgggaggccgaggccggcggatcacgaagtcaggagttcgagaccagcttggccaatatggtgaaaccccgtctctactaaaaatacaaaaatcagccaagtgtggtggcaggcgcctgtagtcccagctactcgggagtctgaggcaggagaatcgcttgaactcgggaagcggaggttgaagtaagtcgagatggtgccactgcactccagcctgggcgacagagcgagacttggtctcaaaaagagcttatctttcctatattgtatggtttttgcatttgtgttgaaaataactagatttgcatggtatttttccggactgcttattcttttccattgatatttgtatttattgtttctccaataccacatggtattactaagtatttattttaagtctataaatgaggtagtatgaactttcaaccttttttatttttcatgattgttttcgctaatttctttgctttttaacttaaatttttgaataaatttggcaatagctacaagaagacgttgctgaaattttggttggtatgttattgaatctattagatgaaattggagagcatttgtacctcactgagtctcctgattcatgaacctagtatttcctatttatccagatcttttttcatttatttcatcaatgttttgtagttttcagcctataaatcctgacatattttgttagatttaacaaatgatgtaagaacttcattttgggggtgctgtgattaaaattgtgttgtttgtatttttttcatttcaaattccagttatttatagctgctgttatgtgaacatgattgatttttgtttattggccttgtgttctgcaaccttgttcaactcaccatttttgttctaaaaggttttttgtttttttttgtttttgttttttgagatggagtctcgcgctgttgcccaggctggagtgcagtggcacgatctctgctcactgcatcctccgcctcccaagttcaagcgattctccggcctcagcctcccaagtagctgggagtacaggcacccgccaccacgcccagctatttttttgtatttttagtagagacggaatctcactatgttggccaggctggtcttgaactcctgaccttgtgatctgcccccccccccccccccccgcctcccaaagtgctggattacaggcgtgaaccaccgtgcccagcctaaaaggtttttttaaatatagattatttgatattttccagacacacaattgttttctgcaagtaagagtctttttttatttcttcctttgcaatgtatgtgccctataattgtttttctggctttataggccttctaatacaatgttgaatagggcagggtgggagggcatactttactagtagttttccactctgcatgttacctgtaggtctttcatagatgccctttattaggttaagcacctccattctatttttagttttctgggagtttttattttgaaaatatgttgaatttgccaaatgcgttttcctgtattgacatgattgtgcggtcttcattaaattattgatactgaattttatttattgattgtttttaaatgttgaaccaactttgcattccttgtatgaaacccagctgattgtgatgtattattattttttttttttttgagacggaatcttgctctgtcacccaggctggagtgcagtggcactatctcgctcactgcaagctccgcctcctgggttcacgccattctcctgcctcagcctcccgagtagctgggactacaggtgcccgccaccatgcccggctaattattttttgtatttttagtgagatggggtttcaccgtgtcagccaggatggtctcgatctcctgacctcgtgatccacccgccttggcctcccaaagtgctgggattacaggcatgagccaccatgcctggcctatcatttttttatattgctggatttgatttgtaaatattttgttgacaagtttctatttatgcccattagattgacttgtagtttcctatttaaattttttttaaacactgtgtatattatatatttggggcacagtgtgatattttgatatatgtttatatcatggaatgattgaatcagcctaattaaatccattacctcacatacttaccagttttttaatggtgaaaacaattaaaatctaatctattagcaattatgaaaaatgcagtacattattatttattatactcaccattgtgtgcagtagatcaacatctcccctttccccgtccacctcacttttccagtcactggtaaccactattctactctatgtctatgagtttgactttcttagattctacatataagtgagatcttgtggtatttgtcttttggtgcctggcttttttcactcacatgatgtcctccaggtttatccatgttgtcacaaataacaggatttccttcttttttaaggctgaatagtattctgttatgtacgtatatcatattttctttattcatttatctgatgatggacatgtaagttgctcctatatcttagctattgcaaataatgatgtaatgaacacaagagtgcagatatctctttgacatactgatttcaattcctttggatatgtacccaaaagggagattgttgaattatctgtaaatttatttttagttttttgaggaacctgtactgttttccataatggctatattaattgacattcttcaccaactgcacaaggattcccttttgtacacaacctcaccaacacttaacatcttttttgtttttggtaatagccatgctaacaggtatgaggtgatacttcattgtggttttaatttgcaagtgataatgaacagtttttcatatgtccattgaccatttgtatgttttcttttgagaaatgtatgtttaggtcccttgcccatttttaaattgggttcttggttttcttgctattgaattgttggagttccatatattttgaatattagctcattatttcatatgtgatttgcaaatattttatcccagtttgtgggttgttgctttactcaattgtttcctttgctgtgtagttaactttttagtttgatgcaatcccattttaaattaaaatttttgttttagttgtctgtgcttttggaggtcatatttatgaaatctttgcacagaccaatgttgtggagcattttccctatgttttattctagtagttttacagtttctggtctaatgtctttaattcattttgagttcttttctgtatatggtatgagacaaaggtctgatttgattcttctatatgtggatatacaactttcccaacaccatttactgaagaggctgtcctttctccattgtacgttcttggtacctttgtcaaaagccactttaacgtaaatgtctgggtttatttgtaattctcatttgttgtaatgtttttctctgcttttgtgatcagggtaatgctagcctcgtaattggaatatgttttctccccttctatttaatgaactaattgtgtagaattgatattgtttcttccttgattgtttggtagaatccaccattgaaaccatgtaggcctacagtttttatctttaggaggtttataactttcaatttaacttatttactagaaatagagctattcaggttttcttggcaaattttggtagtctgtgtctttcacataatcattccatttcatgtaacttagcaaattcataggcatagaattgtattccttcattatcctcttaatgtctttggcatcattttatggtactgatgatttatatcttctctatttctgtgagcctggctagaggttgttcagttttgtcagtgttgtcaaataatcagctttttttttttttttttttgagacagagtcttgctcttgtcgcccaggctggagtgcaatggcatgatctcggctcactgcaacctccacctcctgggttcaagcgattcttctgcctcagcctccggagtagctgggattacaggcgcccgccaccacacccggctaatttttgtatttttagtagagatggggtttcgccatgttggccaggctggtctcgaactcctgacctcaggtgatccacctgccttggcctcccaaagtgctgggattacaggcatgagccaccgtgcccagcctcagcttttggttttattgatttctttcttttgtatgtttctgttttttcgttttttgttttggattcctgctctcaatgtttattattccctttcttcatcttgctttatatttactttgctcttctttctctggttcctttgagacaaactttggttactgactttagatattattttttaatgtatatattgaatgctataaacttccctgttaacactgctttgtctgcatcctatatgttttgatatattgtatttatattgttctttagttcaatccatgttttaatttctcatgagactttgtttgttacctatgtgttatttgaaagtttcttgtttcatatccaattgtttgagggaattttccagatttttttttttcatttctaatttgtatgatctcaggatgcaccttgtatttttttctatgtttaaataattaattgaggtttatttaataagccaaaacatgatctgtctttgtgaatgctacatataattgagaagaatatgtattctgttgttgcttaaagtgttctatcattatatgaagttgtttgatagtaatgttcaggccttccatatcatttgtgattttttacttgttttattaatttcttagcagtgttcaaatctcaaactaattttagatatgcctacttgttttttcatacctcatttattgtcttattcattttgaaaacctttgattaggtgcgtatacctataagattattatgtgttcttggggaaataactgtcttttcatgaggtttctctttatcctttgataatctttcctgttctgatgtctattttgtttcatattaataaatattttcaacctatttctttggttagtgttttatgctgtatctttctccacccttgtacttttaatcattgtatgcctttatagtttgtgtatgtatgtatttcacagtaagtaggtgggtggttgggtttttaggtaggtaagtaggctaaatagataggtgggttggcttgtgttttattccatgtgacagtgttcatccttttactggtggtgtttagaccattacaatttaaaaaaaaactttatttgggcaaaacttatataatttactcattttaagggtacaattaaattatttttagtaaatttagtgagttctgcaactaacaccattattccagttttgtaatgtttttaccaccccagtaacatttttcataccactttacagttaacctttgttcccatcctcacccccaggcaaatactaatctactttcatctatgttgatttgccctttctggaccttccatacaattagaatcatataacatatagtattttatgtctcagttcttttacatgggttaattattttgaggtttgtctatattattatatgtatcagcctttcatttagtttatttgtaaataatattcaattgtgtcaatatgtctcattttctttctccattaaacacttgatgggaatttaagtagtttctgtgttttggcaattatcaattatgcgtctgttgacattcatgtggaaatatttaagcggacgtgctttcatttctcttatgtaggattttttggataatatggtaatttgactttttaagaatctggcaaactcttttccaaagtgactgtactacattacattcctatcagcaatatatgagggttagtgattttctacatatttgtctacatttattactgtcttttattaaaaccatttttgtgaaagtaaaattatctcattgtggttttattgcatttccttaatgactaatggagtaggaaatatttcatgttcttattagccattcttctttggtgaaatgtgtatttaaatcttttgcataatttttaaatctggcaatagaagttgtccaaatctgtacttttgtctgttcagggtcttttgcatttttatgtgaattttagaataaacttgttaatttctgaaaaaagcctgctgttattttgatagggaatgtaatgaatctatatagattagttttgggagaattaccatcttagctataataacgcatcttttttttttttttttttcttctgagatggattcttgctctgttacccaggctggagtacagtggcacgatcttgactcactgcaaatcccacctcccgggttcaagcaattctcctgcttcagcctcccgagtagctgggattactggtgcccatcactgcacccagctcatttttttgtacttttagtggagacagggttttaccatgttggccaggctggtcttgaactcctgacctcatgatccacccgcctcggcctcccaaagtgctgggattacagacgtgagccactgcgcccagccaataacgcatcttaaacatgaaatatctccccatttattttggtcttttaaaattttcttcaacaacattgtgtagctttctttatacaaatcttgcaggtgttttgttgaattattcctaaagatttagtctttttggtgctattttgtatggaattgatttcttaatttcatttttggatcattcattgctagtatgaaaacagaacaatttattatataggttttttgtttttttttttttttttagatggagtttttgctcttgttgcccaggctggagtgcagtggtggatattggctcactgcaacctctgtcttctgggttcaagcaattctcctgccttctgagtagctaagtattacaggcgcccaccaccacgcctggctaatttttttgtatttttagtagagatgggatttcatcacgttggccaggctggtcttgaactgctgacctcaggtgatccacccacctcagccttccaaagtgctgggattacaggtgtgagccaccgcacccagcctataggtttgtattctacagccaactcttctcagaggaagtatagatagatatgtatactaacccatgtatagctacatatttatacacatttttatatgtaactatcgatttttttaagttaaatgtgagttcatactggtatttctaactaatccattaccacatggttaattctagtcatatctccttgtttgtctgtcctcactctctcactccaataggaaagagcctgtctcctaacatttaccattcatttacataattgtactatcccattatacaggtataactgtttcagaattgttgatttttacccttactggaaacaactctatcaactggagtataatgcttatgtatagcttcttttgcatttagtcttacagactccacttattaatggtgagagactggacatactgctcagatcgggaacaatgcaaagatgtcctctctcaccactcctaatacaagaaaaggaaatatagactggaagggaaaaaataaatctttatttgtagattataagattgtctacatagacgtttttagagcatctccagaaacctagaactaacaaatgggagtaagaaggacacaaggtattacagttacttttcattttctgttagttttggcatctcatatttaagtctggttttcaagattgcattcttttcagatggtatttttttctttgtttttgtatacattataatgttgagagtcaaacatataaagtagtagatactgaggtatatatatgtattttctttgcgataagcacacctttccttcatctaggctattagcgtggaggtttttgtgaaattagtcaggagttggtctgggattgaagttttgttgttaccatggttactctctgtgtatcagaaacttcaaaccctataatgataccttgtttttgtgtccttgtttggcgtgggttttcaccttttcactcttctctagagaaggcctgtggttttcagctttcccctgtgcattactttaattttatttgatgtttagtctgtggttggggcgaaaaagaggcatgttctctaatgttctaatttaaactcagtcttaagtaggcactgtgaatctgggtcttgtgggtgtggctgtcataagtctttcttttccagtcaatgcctagtatttattcccattcctcccctatggctaaagctttatgtgttccttacctccttacccagcccctgttgcttccactccagggtgtccctgcaaattgctctaaggtttttgcttcttaggcgagataggagacgggcctctggggaattttggtctgctttatattcccttccactgcttcatgatcttttctgtaaatgaagaactttttttggtggggcgtggtggttcacgcctgtaatcccatcactttgggaggccgaggcgggcggatcacctgaggtcaggagtttgagaccagcctgaccaacatggagaaaccctgtctctacttaaaatacaaaattagctgggtgtggtggtgcatgcctgtaatcccagctactcagaaggctgaggcaggagagtcacttgaacccgggaggtggaggttgcggtgagccgagatcgcgccattgcactccagcctgggcaacaagagcgaaactttttttttttttaagaaaggtagattggggcagattttcagccatagctgctactcctttcccccagatagtaccaaaggggtctttctctgtgatctctgatctttcctgtggcttcctattgataacagctgcaggtggctgcaaccccacccccatatttgaaacctgaggggattcctattctcaggccagcccacacttggcctttagcaatttattgtaatttctagttaaatctttctacctgcttttatattgattttcatggcatttgtcccagtaatcaaatgctcagattctgttttcccctgcaggcacctaccatttttttagatttctgtatttttttttttcctgtaacttcagttctctgatagggtcaagaaaatcataactttgcttttgtcaagccttttctaagtgaggtagtgatgttgtttctagtgccctatatatttgagatttgttgtctttgttatttttgtttatttctgtttcttattttttcttctgtatcatttgaacattttttagtattttattttatttatttatttttttttgagatggagtttcgctcttgtcgcccaggctggaatgcagtggtgtgatcccagctcactgcaacctccgcctcccgggttcaagcgattctcctgcctcagactcccaagtagctggggttacaggtgcccgccactatgcctggctcattatttttatgttcagtagagacggggtttcaccatgttggtcaggcttgttttgaactcctgacctcaggtgatccacctgccttggcctcccaaagtgctgggattacaggcgtgagccaccgcgcccaggctttaatattccattttaattatctttatttatttatttattttgagacagagtctcgctctgttgctcaggctggagtgcaaatggcacaatctcagctcactgcaacccccgcctcctgggttcaagcacttcttctgcctcaggctcatgagtagctgagactaactacaggtgcatgccatcacgcccagctaatttttgtattttcagtagaggcagggttttgctatgttggccagggtagtctcgaactcctgacctcaggtaatctgcctgcctcggcctcccaaagtgctgggattataggcatgagccaccgtgcccggtcttaattatcttttatacattcgaattgtctcataaatacatatctaacagtttatgtagattcagtgttttaccacttcaggtaaaacatagaagccttacatccatataaagctctttatactccctcactgattctttaagtagttgccatgtgttttacatttgcattgtgtttctgctttcaggagtcatacatattttaaagaacttaagaggagaaaaatagtcttttatatttactcagtaatttaccacttcttttttttttttttaaaccagttctttgttctctcatttttaaagatctaagctttccctgggtatcatttcccttcagactaaagaactccctttatcatttaatcagcactctgcttgaggtgaattgtcttaatttcccttcatctaggaatgtgttcatttcaccttcattcctgaaagacattttcaatcactggatatagaattgttaattgatgggatttttttcttgttgctctttaaagttatttttctactactgtccttcatcgtttctgataaaaaatttgccgtcgtttgaatcattgcttcctcagatgtaatgtgctgtttttttaatagctgctttcaaattttttcctttgtctttgattttcaacagtttatagtatttctgggtgtgtcttttcagtttatattgtttggttttgctgaagttgtttaatatgtagatttatcttttatcagattgggaagtttttggctgttatttctacaaactttttttctgcatgatttttttttctcattctgagactatgatgacatgtatattagatattgtgatattgttccataggtcctgaggtgctgtttgttctgtttcaatctattttttatttatttatttattttattattttttttgagacggagtcttgctctgtcgcccaggctggagtgcagtggcatgatctcagcttactgcaagctccgcctctcgggttcacgccattctcctgcctcagcctcccaagtagctgggagtacaggcacctgccaccatgcccagctaatttttttgtatttttagtagagacggggtttcaccatgttagccaggatggtcttgatctcctgacctcgtgatccgcccgcctcagcctcccaaagtgctgggattacaggcttgagccaccgcgcctggctcaatctattttttaattctatttttcagattgggtaatttctgttgatctgtcttcaaattctgtttcatgttcctggctgcattctgttattgagatcttcagtggatattttttattgtgaatgttgtatgttttcattaaaaaaactcaatttggttctttaagtgttattaaggtataatatcataccataaaattatctattgtaagtatacaattcacctagttttagtaaacttatggcttgaagttgtcatcataatccagtttagaacatttcattatttccaaaagtttcctcaagtcacttctgctcccatcccaggctaccgtgatatcctctgtctgtaagtttaccctttctagacatttcatgtaaatgaaatcgtacgatatttattccgttgaatctgacctccttcatttattaaaatgtttctgagatttagtcatgtggtagcattaataagtatttcattcctttttagagctgaatgttgttcagttttactaatgtcacattttgtttctccatgcagcacttgactgaaagttggattgtttcctttttttggtggtgggggggggctattatgatgaataaacattgctgtgaacattaatgtaaatgtcctagtatattttcttttctattctgtagattctttggaatagaatagctgggttgtacagcaaatatttattcagcttttaaagaaactaccaaactgatttccaatgtggatatactattttacattttcaccagcaatgtatgagttaacatttctccacatcatcacttgttattacctgattatagccattctaattggtgtgaagtagtatctcattatgattttgttttgcattttcttaaactgtatgagattgagcatcttttcatttgcttattggtcatttgtatgtctttgatgaaatatctatttaaatcttttctccatttaaagttattttcttattgcattgtaagagttctttatatgtattttgtactcaagtgttttatcagaaatatgatttacatattttttctcagtctgtagcttgtctttttattttcttaatggtgtcatttgaagtgctaaaatttttaattttcgtgaagtccattacatcagttattttctgtgtctcatttttcataagttttatactctgttgattagttttaaagtaagttttaaagttgggtagtgacagatctcctactttgttgtttttcaaaattatttcaggtgatccacattctttgcatttaaaatgagcttgcaattttctacaaaaaaagccttctgggattttgatagggattgtattgaatttatagatcaacatgatgagacgtgccttcataattatatattgcattgtcaaatccatgaacaaggattttcatatattttcatccatttatatatctacttcaatttctccatgcaatattttgcagtttttaatgtataaatctttctcttcttttgttaaatttattcttaagtattttactctttttgatgctattcagaatagagttctcttaatttcagtttattgctagtatatagatatatagttgattttaatcttgtatccgattacttccttaaactttgttatagtagttttactgtgaaattcttaggttaagaataaggatttcataatagaactacaaataggatcatttcatatgcaaataaggacaattttatttcttctccaatctcattgtctttaattttttttccttatttactgcctagaactcctagtacagcgttgactagaagtggtgagaaagctggcacagtggctcatgcaagtaatcccagcgctttgggaggccagggcgggtggatcgcttgagtccaggagttcaagactaccctgggcaacatggcgaaaccctgtctctacaaaaaaaaaatatatagtagccaggcatggtggcatgcgcctgtagtcccagctgccagggaggctgaggtgggaggattacttgagtctgggaagtcaaggctgcagtgagccatgattgtgccactgcactccagcctgggcaacagagaccccgtctcaaagaaaaacaaacaactccccccccaccacacacaaaaggagtggtgagaatgggaatctatgtcttattcccatcttctggagaaagtaaagcattaagtctttctccattaagaatgacgttagttataggtttttgttattgttgtcttataggtttcttttgttagattaagtaagttctttttcattctcacttttaggagagttttaaagccttgaatgggttttcagtttagtcaaatgctatttttatgtccatcgaggtgataatatatatattttaaatgtaatatattgaactgcattgattgaattttgagttatgaaacaggcctacattttatgataaaccctactttctcatgatataatttatccaatttgcatattgttggattagatttcctaatattttgttaagaattgttgcatttgagtcaacttaggtacccaaatggttggctagataaaatgtggtatatttatatcatgtaatactatacagccataaaaaatgaaaccatgtcctttgcagcaacatggatatagctggagacctttatcctaagcatattaatgcaggaacggaaaagcaaataccccatgttctcccttattcatgagaactaaacatgagtacacatgttcacataaatgtctaatgtgaacaatagacaccagggcctactcaagagagggtggtggaaggagggtgaagatcaaaaaactacctattgggtactatgctcactacctgggtgattaaataatttgtacaccaaaccccagtgacacagaatttacccatgtaacaaaactgcacatgtataccttgaaaccaaaataaaagttgaaaaaaaaaaaaaaaccacccatggattgttgcatttatcttcatgaggaagattggaatgtgatttccttttcttataatgtctttatgaggttttagtatcacggtgtttatggccacattaaaatgagtaggacagtaagtaatacctcttcagttttctgtaatgatttttttagaatccatattttattttattttatttttttgagacggagtcttgctttgttgcccaagctggagtgcagtggcgtgatctcggctcactgcaacctctgccgcctcgtttcaagcgattctccctgcctcagtctcccaagtagctgggattgctggtgtgcgccaccacatccagctaattttttttgtatgtttagtagagatggggtttcaccatgttggccaggctggtctggaactcctgacctcagatcatccgcccacctcgacctcccaaagtgctgggattacaggtgtgagccactgcatccggcctagaatccatattttttaatccttgaatgttttggtagaattcacttgtgaatttatcagtgaaacagcttggtctgttgttttccttatggaagttttaaaattactaattctatgtcattaatggatatatgaatattcaggttatatgtagatatatttgttgttgttgtgttgttttgttttgttttttgagatgaagtctcgttcttgtcccccaggctggagtgcaatggcgccatctcgtctcactgcaacttccgcctcccgggttcaagcgattctcctgcctcagcctcccaagtagctgggattacaggtgcctgccaccacgcccgatttttttttttttttcttttgagacattctcactctgttgcccaggctggagtgcactgtgcaatggtgtgatcgcggctcactgcaacctccacctccggggttcaagtgattcttgagtctcagcctcccaaagtacctgggactataggtgcgcaccaccacacccggctaatttttgtatttttagtagccacagtgtttcaccatgttggccaggctggtctcaaactcctaacttcaggtgatcagcccgcctcagcttcccaaagtgttgggattataggtctgagccactgtgcccagccaggttatatattttttgaacgagctttggtagtttgtatctttttttttttttttttttttggagacagggtctcactctcttgctcagactggagtgcagtggcacgatctcggctcaccagcaccctccacctggagcgatcttggcttactggcaccctccacctcccaggctcaaatgattctcctacctcagcctcccgagtacctgggattacaagtgcacaccattaccacccagctaatttttgtatttttagtagagacagagttttgctatgttgaccaggctggtcttgaactcctgacctcaaatgatctacctgcctcggcctcccaaagtgctgggattacaggtgtgagccaccgcacccggcctctatattctttggtagtttgtatcttaaggaattaaaagataaaaggtggataagaaaagattactaaggaagttatttcatcgatttttggtttggtgtttattattttcttattttctgcttgctttttgtttaatttgttctttttctagtttcttaactccaagtcactgaattgaggtttttctttttcaaattggcattttgtgctgtttttttctacatacgttttttggtgtcaccccacatattctgacattttcattttgattctgttcaatatactttctgatttccctcttgatttctttttggtcctggaatgtgctatttagtttatgtatatttagggatatttcagagatgtttctgtgactgttacctattttaattctcatatggtcaaagaatatactttgtatgaattacattttttaaaaattggttcaagattgttttatgacccagaatgtggtatgtcttggtaaatgttcagtgtcttctttaaaaaatgtgtgttctgccattgttgactgaagagttataaaatatcagctaggtcaagtaagtcatttgagttttcaagtcttttatatccttagtgatttttctatccacttctgtcatttatggagaaagatatattgaagtctttcaatctaattgtgaattagtctgtttttccttgaaattctagtaattcttgcttaatttattttgaagctctgcatagacttttaacactgttaagtctatcttaacttctttgtcattatgaaatggtcttcatccatggtagtattctttgttcagaaatctgctttgtctgcccaaggggtctttggtctgtaggaaattaacccatgaaggaaagaaaacttggaaaaataatttaaaaaatgattgttttttaaacataaatcatttttaaattattgattccaagggattgctgataataaatttgttcaggctgtgttaagacttgcatcttttttttttttttttttttttgagacagagtttcgctcttactacccaggctggagtgcaatggcgcatctcggctcactgcaacctccgcctcctgggctcaagtgattctcctgcctcagcctcctgagtagcagggattacaggcatgtgccaccacacctggctaattttgtatttttagtagagacgaggtttctccatgttggtcaggctggtctcaaacttccgacctcaggtgatccacccacctcggcctcccaaagtgctgggattacaggtgggagccaccgtgcccggccattgcatcaattttttagtaatagatgatgaaggcgagtgctaaaactgtgaagacttagaacattttaatatttctgaaaattaacttttttcagttttgaaaattacagcttctaaataaaatactgaatttttaaaaacaaaattagatttaaatatataatgtttaaagataaaaagttttatgataaaatatgccacaaacaattcgaaagatacctaacttgctttgtgtataaaaggtaaataaaggcttggctgggcatggtggctcacaggaggctgagacaacaatcacttgagcttaggagtttgagactagcctggtgggtaacatggcgaaacccaatctcgaccaaaaatacaaaaattagctgggcatggtagtgtgcgtctgtagtcccagctactcaggaggctgaggcaggaggatcccttgagcccaggaggtggaggttgctgtgagctgagatcacgccatttccagcctgggtgacagagtaaaaccctgttccaaaaaaagataaaggcttgctatttatgccatttcaaggaattagtaagaaaaatcgtagattaatgggtaaaataaatgaatagttaattcaatggcagtgcttatccaatcaataaaagacataaaaatgatactgaagtaaatgcaaatttgtagtgttagtacaagatcctttctcatctactttattgggataaaattaactggatacaactactgttggcagtgatggggaaaggttacttttatatattgcttgtgggaactgtgaattttcactttcttttttggataggtagtgctttggcctcatcagggagctcctgctttaagcacctcttcatgctttgaggccacatttgttactcagactttacaacagtggctttgagttctgccctgtttctggtacctgaggaatttcttctcatccttttggtatttcttatgtatttttattgttttgttttgttttattcagcatttctactttctgttgctttgggtgaggttttctatagcacttaagttcaccatgacgactggagcacatcacaattttttttataaccagacaagttgtcctgcaaatattaaggagactggcagatgttatcaaatataaaataactattgggattaacatctataaacccttcttgatcaaggtatttaacagtcaattatagttaaccaagaagtaaacaaaaataacactggaatagaagaaatgtgacagtgggctggtgctattcattgaatccatgtaagtattgaactagaagagcaactgagggaattaagattgcataataaaatgtttttctgaaaggtgtaggaataattattgagtgctaatcttatcatggtatggtgccaatacttactctaaagttactatgtggtaaaacattttatatatatattatatgtgtataatatatataatttatgcatataaatatattttattcaattatttttattttattaattttattttatatgtaaatatatattcatttatatacataaataaatacaaaatgttttaccctattttttattaaaaagttttttcagtggtccttttttaggtagttatatttcttgtgaaataacatttatctgaacattagtaactccttcactgtcattttgctctcattttcctgtctttatagcaagtaaaattaaatggagtaatttgaaataaattatataataaatggcattaaaataaccccattttaaaatattgaggtataatttacatacattaaaatgcatcataggtgttccatttgacaaaatagatcacattttctttactcctgaaaatttccttgtgctcctttccagtcagttctcctcttcccagtagccactttgtggtataatcccaggttcccaggttaatgaaattatttctaactgtgtttttaatacattcacatttttcttgctaaattatatgccaaaaaatgtccaataaatgttaagctttttaggatgatggcagtttgggtaattcattgctttcttatttatacttttctgtattgtgttttgttttttttttttttgagacaaggtcttgctctgtcacgcaggttggagtgcagtggcataatcatagctcactgcagcctcgacctcccaggctcaagaaatcttaccacctcagcctcccaagtagctgagattaccggcacttgctaccacatctggctaattttgtgtttttttttgtagagacagggttttgccatgtttcccaggctggtctcagggactcctgggctgaagcaatctgccagctttagcctgccaaagtgctgggattacaggtgtgagccatcatgcctggccttttttgtattatttgattttttattttaggtagtaagtcttaggttaaaaaaatcaaaacctgattattaattaaataagaaaagaatattttttaaaaaggcaaatgcttcaaagcaaaactgtcttccatcctaggaaaggtatgaaccagaaaagagcaggttcaaagagaaaaagggtatgaagtgtttcttagattagtgtttgtcataattttgagagctgatgatactaatccctgaaatagagtaaggaaaattgaaaaaaataaaagaaaaaaagagctttgtagttatatggagttggtacctttctgtttgttattatatatgaaatattgtaaatttctggcaccaccaatcataacatttaagtgtattccagagctgaatataaattattctatttttcaagttaatatatagtgttgtcagtatatgttgaatgaaattgccccttaagttttcatttacatcttatatttatctggttttactaattaatttattctgcatttttactgagtgtagcctcagtaaaaaccctaatgtgggtaggcactgaaattgttatttgaataacacatccctgtttgcagtgtgatatgaagaaggggaacagaggttcaaaaaaacagagaaagcaaatagaaaataagtaaatgggagtcttaagcaactatattgttaatgggctaaacacttcaattaaaagtcagagattatcagaatggattaaaaagcaagacccatttatatgctatcaacatgaaatttacttaaaatataaaagtacaggctgggcacggtagctcacgcctgaaatcctagcactttgggaggctgaggtgggtggatcacctgaggtcaggagttagagaccagcctggccaacatggcaaaaccccatctctactaaaaatacaaaaaatcgccaggcatggtggcgggtgcctgtaatcctagctacttgggaggctgaagcaggagaattgcttgaacccgaggggcagaggctgcagtgagccaagattgcgattgcgccactttactccagccttggcaaaagagtgaaaatccgtctcaaaaaaaaaaaaaaaaaaaaaaaagaaacccttgaaggtacagataagctgggggtggggtagtgctattaatacatacaaaatagaccataagacagagtattatcagaaataaagagggatttttcataatgttaaaagtatcaattcatcagaaagcggtagcaatcataaatttatatatgattataaacatatttttattaaaaatatataaagtggctgggcgcggtgtctcacgcctgaaatcccagcactttgggaggctgaggcgggggtggatcacctgaggtcaggagttcaagaccagcctggccaacatggcgaaacccggtctctactaaaaatacaaaagttagctgagtgtggtggtgggcgcctataatcctagctacttgggaggccaaggcaggagaattgcctgaacctgggggacggaggttgcagtgagctgagattgccccacttcacttcagcctgggcaaaatggtgaaactctatctcaaaaaaaaaaaaaaaagtatatatagcaaaaatcgacaaaattaagaggtaaaagatacttttacaattagtgctgaagatttttaccaccctactctgaccaattgatagaatttctagcaaaaaaacaaaattagtaaagacatagatgatctgaggaatactacaaaccacctcaatataattgataagtattgaacactacttccccgaattgtgaagaagatattcttatcaattgtacatcatatattcaacatagaccaaatggtggaccatgaaatatgccttgataaattttttgtgtgtgtcttgataaatttatttatttcttgagacagtctcacttgctctgtcacccaggctggagtgcaatggcgcgatcttggcttactgcaacctccgcttcctgggttcaagctattctgcatgcctcagcctcccgagtagctggtattacaggtgcatgctaccacgcctggctaatttttgtatttttagtagagacagggtttcaccatgttggccaggctggtctcaaactccagacctcaggtgatcctcccacttcagcctcccaaagtgctgggattacagatgtgagccaccatgcccagctggtaaatttaaaatgattgaaatttatatatgttctgtcaccacaatggaagtaaaattaaaatagaaattattaaaatatctaggaatgatccaaatatttggaaattagacaacacaagtttaaatgatcatgagtcaaagggaaatcacaattagaagacatttttaatcgaatggtaatgataatataatgtcaaaattcatggaatgtagctaaagcagtgcttggagggcaaattatagtttaaatgcttttattataaaggaagaaaagtctaaatgtcagtaaccaaagtttctaccttaggaagctagaacaagaacagcaaagtaaacctggagtaagtacaagtaaggaaacaatagagtaggaatcaatgatgtggaaaacagataatagagaaactttaaaaagccaaaatctggttctttggtaagatcaacaacagtaataaacccttatcttcagtgaacaagaaattgacaatgcgacatgttgtaatagtaaaggaataaagtacatagtgtggaacacagaggctgatctgaatttggttttcaaaggtggtttcagagaggtggtaaaatttgtgtttggctttcaagaattagtgtaagtttttcctgatacagattgggaaaaagaatattctgagaggaaataagagcaaaataattttatttttcaggcttttggcatatttagaaccgtatttttatttttttgagacagagtcttgctggagtccatcggtgcaatctcggctcactgtaacctctgcctactggttcaagcagttctggtgcctgagcctcccaagtagctgggattacaggcatgtgccaccactagccccagctaatttttaaatttttagtagagatggatttcttcatgttggccaggctggtctcgaactccaagtctcaagtgatccacacgccttggccccccaaagtgctaggattactggcgcgaccccacagcacctggcctagaatggtatattgactttatctgtggcatatgggttatgttaggtggagagcagtaggtgatgcaataggaaaagcagtttgagtctagagtgtacagaacctagagtaccttccttgataacttggactttattctgtgtaaaatagcaagcttagcgtctaaagtttttaaaggagttttttaaatgaaatatttcaaacagaaaatacatagaatgacatactgaacacttattaccgctaccctgctttaacaaatcttataccttactatatttgtttcagattttaagaaattaatacatcatagatacaattgaagctttgtacctttccatctcataccaccatgaagttctattctgaagtcatatatccttaccatgcatttttaaaatacttttactgtatagctatatactaataaaaaggtggcattctccatgttattaaagtttcttaaaaatgctatctatattttacttattctgcaacttgtttttctcacttattattatttttgacttatgggatattccggaagtttggactggtgtaaccacagtagttatttacggccagtgtcctttcttctttcttttttgagttaaccaggatacatttattaaatatatccaggataaatattcccaaaaacaaatatttggtaaatatggcaaacttattctttggcaaattagcttttagcatgttggactgctttccatccctattaggagtattataaggattaaatgaagtattaccaacaaaaaggtacttagcaaaattctcagtaaacattggttataatccctccaacattcagacttaagttctgcctattctctttcctcagtattctttattcctgtccatataaccattgtccttttgtaggccttcactaccttaatgtggactatagcaatagtcacttgattggtctcttggcttgttcccctccaatcttgttctctacactactgcaagggtgatctgtctaccacatagattttgaattatcatctacagtagtaaaacagttttcatggcatacaagcttcaataatttagtctagatattccgcttgatctcttttcacctcttttccatttatcttctagcaccactgcagtgcttgtagttccttaaatatgctattctttttgaaaaagcagcaaatctctgtgcagttgcctttctaactggaatatcttcccccttcttgtgttctcacaaaattcttattcatctttcaagttctagctcaaatgccacttccttgtaaaggttttcctgatttccttaagcagatttgggttacgtttctagggttctgctgctctttgtacatgcttctattataatgcttatatatattattgtagttgttttttaattttgtctgtcattctaatagactgtaatctccttgcaggaggagatctgtcttttcatcatttatataataatgactattgtacctagaatataagtcattgacatttgttgaattaaaaaaattcagaaatctatttacagccctctctactgccttcccatgacacctccattttacagatcattaagctgaagcccaatgaaatgaagctatttagtgagaactcatgcctcctaactccagatctattacttttattcttatattgtagagaatattctgtttagcatgtatatactagttatttatattataagaaacagtcttgtcagtattcttcctttcatctctagggaataggtagaagggtatagtgattttatgagatttgtgtttttttttcctgtttcaatcattcagatgcttttgttttctagcaaattcagcaaaattcaaggttttcttcatgtcattccttttctttaccctcacagaactcaggtaggattgaatgtctgatgcatttagtccagttgtcctcaaccaggggtggttttggccccctagagggcttttggcaagatgtttagaggcagttttttaaattgatacataatatttacccatatttatggggcacatgtgatattttgatacatacataccatgtgtaattggtttatctgtcacctcaaacatttatcatttctttgtattggtaacattctacatcttttagctattttgaaatatactttctgtgggtgcttcctaagcacccttacttataaccttataaccacagtacatttgtcaacctcataaatttacactgatatcatacttttgtctaaactaccttccatgttttataaaaatgttttcttaatagcatttttaacctcttcaatactggatccagtctagaagcaggtattacatttggttgtcatgtatttttagccttctgtcatctatggtgtttccacagccttgtaaaactgtagtacactatcccaaccagactattcacactgttacagtctagatacagaatggtttcatgataaggtagtgagacattttaagatatattccctgtggatttggcattcattgattacccttttccttgctcattctttaccttggttactttgcaactgtagtactcctgctagatttactagtcaggccttagcaaaatactgtaagcacaagacctcccttctcccttatttgtttagtaccatgagggactcatattcctacccttttttttttgagatggagttcgctcttgttgcccaggctggaatgcaatggcatgaccttggctcactgcaacctctgcctccccagttcaagtggttctcctgcctcagcctcccgagtagctgagattacaggtatgcgctaccacgcccggctaattttgtatttttagtagagacggggtttctccatgttggtcagactggtcttgtaggagaaatagacttcactaaaatattacagccaattagtaaaaataagacagtaaatagtaacaccttgtcctggagtgatagtagccagtattgctaccatatattactgacaatgtttaattttcaacaacaaaaataattgagagataaagagaagtaagaaaacgtgaccttatggggaagaagactggcaaaacatctcaactttgaaggcataagatgtgttactaagcagacaaatatttcaaattggccattataaatatcttaaaagaactagaggacaccatacctcaggaggcaatgatataattacaataattttgcaactagagaatataaataaataggtaagaattatagaaaagaaccatatggaaatctggagttgtaaagtataataacagaaattacaattcattagagaggtttaatactagattttaactggtagaataaacaatcattgaatttgaagatagattgatagaaatcacccagtttaaaaaatacagaataaagaagtaagtaaaatgcagtttcagagaaatggcagaagccattgagaataccaacatatgtgcagtggtagtgccagaacataaggacaacgagctgagagaaaaaatatttaaagaaataatacctgaaaattttctatattatgaaaaaaaaatccaagaagtgtaaagaatttgaagtataataattgcaaatatattcccccttagacacatcaaagtaaaattatgaaagtaaaaaaacatcttggaagcatgaagagaataatggctgatatacaaggaaactctaataatacagtaataattaaggccacagtggaggtgtatgacatattaatagtgtagaagaagtaaattcaaaattttacctgaagcacgactgacattcttaaatcaaagtaaagacattgctagataaacaaaaactgggaatgtgttcttagcagacccaccttgtaagaaaagctagtttttgagaatgaagaatactgaccccaaactgtaattgaaattcctatgaaaaatcagagtaccagtcataattatgtaataattatagaggctagtataaatgcatattttttatgtattagctggcatatatgcctatacactgtatacttataaatattcatatatgtgtattgtgtgcagtatttccatatttgtatttgtgagcttacaacatatagaaatgagatctatttaataatatcacaaagtatgtggttgagaacaaaactgttgtaataaggaaatgaatcttttttttttggagacagagtttcgctcttattgcccaggctggagtgcaatggcacgatcttggctcaccacaacctccacctctcaggttcaagcgattctcctgcctcagcctcccaagtagctgggattacaggcatgagccaccacacccggctaattttttgtatttttagtagagacaggttttctccatgttggtcaggctggtctcaaactcccaacctcaggtgatctgcctgcctgggcctcccaaagtgctgggattacaggcgtgagccaccacacctggccaggaaataattcttgatggtaactcagatccacaggggtaatataaaagaaccagaaataataagaaggataataaaatgctaaaaaaaaattttcttaccattcttctctgacctgattatataaaattatataactaagtatataattttgaggattttattgtattataataatggctgaaaagggagaagttatagagatatatagaggtataatgatttttcctttctttttttttttttttttttgagagggagtcttgctctgttgcccaggctggggtgcagtggtgtgatctcagctcactgcaatctccacctcctgggttcaagcgattctcctgtctcagcctcctgagtagctgaaattacaggcacgcaccaccaggcccagctaatttttgtatttttagtagaaaaggggtttcaccttttggccaggctgatctcgaacttctgacctcaagcaatccacccgccttggcctcccaaagtgctgggattacaggcgtgagccactgcgcccagcccatatagaggtaatatttctatattatactcatgttagtgtaaatatgaagtcgagtcctttaggatgtgtaagaaaagtcctagagagatgtcagtgacataatagaattggagctgcctcatatacactatggaatactgtgcagccataaaaaagggtgagttcatgtcctttgtagggacatggatgaagctggaaaccatcattctcagcaaactatcgcaaggacaaaaaatcaaacaccgcatgttctcactcataggtgggaattgaacaatgagaacacttggacacagggtggggaacatcacacacaggtctgtcgtggggtggggggctaggcgagggatagcattaggagatatacctaatgtaaatgacgagttagtgggtgcagcacaccaacatggcacatgtatacatatgtaacaaacctgcacattgtgcacatgtatcctagaacttaaagtataatttaaaaaaaaaaagaattggaggtacctgttttgtccctcctttcatggatacaccaagtaagtacatgcatgtggatcaattctatccaagagaaagccaaaatgtagttgaaggatgctcacacactggatgactgagaaaatatctacaacaaaatgggaaggataaactgaggtatactgatggttaaacctcaccttgagcacaggctggtataatttggaaagaatccttaactcccaccctcttcctgaggggtgacgggttgatagcacacatatagtgtcccagttcttacattctctaccagaaggcttggcccttaaatcccattatatgaggagcacaaggacttggcactagagtatttccttgaagaacagtagaatgggtggggggttgaactgcaggagcacttccaacagctgtatctcctgggatcagtataccctctagcttctcactggaaacagtttggctgcacatttctagcagcttcttgtgtttgtgtcttctatcatgcctgcacctaggagcccgtgtagcaaatgaagcataaacctcctcaagtgttaatgggagggatggcactccctacatcttccctggattgctctagtgattaatccaggtctatagtttcccttgaaagagatttgaggcctcagtgagcaaaaatggaagggtcaaaacccaccatgccttttcccagctttctccagatatgtataaccttgtaatctctccctggaaggagactgggagacagacctctcttatgctatatgtgaggaactgtacttcacctgccttcctatgtaccagtcttgttccaacaacatattggcctggagattctgtgtgaagtgagtttgtgagacttcaggaagccttaaagggagatgaatgttcttcgcaatttcttcttcagattgctccagcaataagtccaggcttccaaatccttactggcaggaggttgtgtgacttactgtgccttattgtgagattgggtacttcccatgctttcctacttggcctgctctggtgatgaattcgtttctgcagactttccctgggagtaatttgtacacatactgactgccccatattttacatccctcattcaaggtactggctcctgtatcacccagctctggagttgaaagagctcttcattcctgagtctcctgtaccactgagaataggtagttttctctcctctcctctcctctcccctcccctcccctcccctcccccccttttcttttcttttttcttttctttttttgatggagtttcactactgttgcccaggctggagtgcagtggcgcaatctcggctctctgcaaccttcacctcccgtgttcaagtgattctcctgcctcagcctcctgaatacctgagattacaagcatgcaccaccacgcccgtctaattttgtattttcactagagacggggtttctccatgttggtcaggctggtctcgaactcccgacctcaggtgatccgcccgcctcagcctcccaaagtgctgggattacaggcatgagccaccgcgtccagcaagaataggtgattttcaaacttggaaacattcagaagttatcgcctcagtttcagattgagtagtctcaaagagattacagacatctaccacaaattctctacttggtgtggtgcaaaatcagtatgatgtaaactttgtctctcagtttcttcaaaggaaagaagcaactggaacacacatataacactaacccttccagctgcattatgagggaccagtacctgtctcaaggcaaaattatgacttagttcatcctcacctctggaggccagtaaaagtgggttatagaagaacaaagaggcatctagatctttcactgggttatttggagagaaacatctcctaccgaaggccagtttaacaagactggtagaggaggttatcttatctaattcacagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatgaaaacgtgagtataaaactcgctgataaaagtaagtacatagttggctgggtgcggtggctcacgcctgtaatcctagcagtttgggaggccgaggcaggcacatcacctgaggtcaggagttcgagaccagcctggccaacatggcacaacatcgtctttactaaaaatacaaaaattagccaggcgtggtggtatgtgcctgtaatgccagctactctggaggctgaggcaggagaatcgcttgaacctgggaggtggaggttgcactgagccgagatggcaccactgcactccagcctgggtgacagagcaagactccatctcaaaacagaaaaagtacacagtcaaactgagaatatgctaatactgtaacggtggtgtgaaaacaaattatgtatttatcataaaagttaagacaaaacttaacttgtagcaacaataatttaaattatacaaattataaaatgatataaattgtgtcatcaggaacacaatgtggggttgaaagtaaaagcatagcatttgagtaattgatctaattttagttgtattaatttaaaatagtctcataagtgtaagagactgtttaaggttcatggtaaccacaacgtttgcaaaaaacccttagtagatatgcaaaatataaaaagaaagtagatatgcaaaatataaaaaggaaaacattgaatcacataaaaaaacagcaagaaaggaagagaaaagcaaagaatttgtaatcaaccagaaaacaaattgcaaaatgacagcagaaattctttacctgtcaataagtgctttgaatgtaaatagattaaattctctaatcaaagtacataaagtggatgaatggattttgaaaagtctcatctatatgttgcctacaagacagttcatttttaaggatacatataaattgaaagtgaaaggatggacagatatgccatgtaaatggaaactaacagagagcagaggcagatctcttaatatttacatcagatgaaatagaattaaagtaaaaatttttaagcagagacagggtcattatataatgataaaaagtggtctgttcatccatggggtataaaagtcataaaggtatatgcactcaacattacagcacctaaatatataaagccaatattaaaagctttgaaggaaaatataaaatctaatacaataattgatgggacttcagcacacctctttaagcaatggtgagatcattcagacagaacatcaatgagacatcagacttaaaccacaattgaaaaccaaagttgcccatatggacctaaaagacattgatgcagtcttctgttcaacagcagtggaatacacgtttttcaaaagtgcacacagaatattctccagagtaaatcatacgttaggtcacaaaagaagtcttaagaaattttaaaagattgaagtaatattgaatatcttttctgaccataatggtatgaaactagaaatcagttataggaggaattttagaatattcacaagcacatggaaattaaataacatatcaatcagtggttcaaggaagaaattaaaagttattttcagaaaaacaaaaatggaaacacaaaataccaaaacttataatatgcaagaaaagcaattcctagagggaaattttagcaataaatgtctagaagtacaaagaagaaatagctcaaacaatttaatgttatacctaagagaactaaaagaagaacgtaacaaagattatagtataaatgagactagaaaaataatagaaaataccaacaaaactgaggggatattttgataaactaaaaaaattaagcaatgaacaataaaataagtaaaaagacagtccaatagtgagtaagaaggctgaatcaataattaaaagtttctcataaaaccaggaacttatagattcccttctgaattctacagatgtttaacccttttcccgtttgccccaaactcgctggtggcccttgtggctgtagcatttaccctgagataactttgctacaaaatatcttgctttcattattttcgtattgctctagtatattgactttggaagcaaaacacatttttctatttatagcattctgtctttagtagtggtatttccatttacaaagtatagtaactctcaatcactgaaaatgtcaaattctagaaaacatagtattcctgtgtatgatgttaatattcttgaacagttattgtccaaagatgcattgattttcttcagaaatagacaattccgatgattgtgatgttctgtttagaaataactccaagaacagtttttgtattttattttcacattgaaaatcagtcagatttgcatcagcctcaaagcgcatgtttatgtaaaatatttaagtcctggcagcgagctgccctttttttttcctaaatgggaaaagagttaaagaaaagctaatatcaatccttttcatactctttataaaagttgaagaggagggaataagttccaatcacactttatgaggccaacgttaacctgataccaaagtcagatgaagacactaaaagaatacaaaattacaggccaatatccctgatgaacatagatgcagaaacccccaacaaaataccagcaaactgaattcaacaacaaatttaaaagatcattttcccatgatcacatggggagataaccttttgcatttaaggatggttaaacatacataaatcaataaatttgatagatcacattaaagtgaacatcaaaaactacatgtctcaatacttccagaaaaagaattgacaatatttaacaaccttttttttttttttttttttcggagacagagtcttgctctgtcacccaggttggagtgtggtggcactatcttggctcactgcaacctctgcctcctgggttctcctgcctcagcctcccgagcagctgggattacaggcatctgccaccatgcctagctaacttttgtatttttagttgagacagggtttcaccatgttggctaggttggtcttgaacccctaacctcaggtgatccaccctccttgacctcccaaagtgctgggattacaggcatgagccacagtccccggcccaatacttaacatctttgcatgataaaaacctgaacaagttaggtataaaaggaagatgtctcaacacattaaaggccctatatgaccggcccagagctgaaatcttaacaccgaagagttgaaggctttttctctaagatcaggaacaagacatggatgccattttttctccttctgttcagtgttgtactggaagtcatagcaagagcatttaggcaagagaaataaaagacatctaagtaggaaaagaagaaaaaacttgcctctcctgattatcttatcttatagctagaaaaccttaaagactccattaaaaaaaaaaaaactatagaactaataaaatgaattccataaaaagtgctacgtacaaaattgacaattaagtctgtagcatttctatacactaacaaacaacaatctatccaaaaaagtaatcaggaaactaatcacatttacactatttactaagtaaacaaacttatgaatgaatttaaccaagtaggttaaagatctgtatagtgaaaacattgatgaaacgaattgaagattacaaaaatagaaatttttctttgtacatggattgggaaatttatattgttataattttcatactgccaaaagaaacatacagattctgtgtaatcaatatttcaatgtcctttttatttttattttttttacagaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgtatatctatatgtgaaattgaaccattttctcatagcatatagaaaaatcaactcaaaatggattaaagcctgaaatgttgcctttgaaactgtaaaactactagtagaaaatataggggaaaagctctatgatgttgttctgggcaatgatttcttggatacatccttaaaagcatgggcagcaaaaacagccagacaactatcagggaacctgcccagatagtcacataggttcttttctattttccctaagcattggccgggttgagaaataaagggacagagtacaaaagagagaaattttaaagctgggcatcctggggagacatcacatgtcggtaggttccgtgatgccccctgagccgtaaaaccagtaagtttttattagggattttcaaaggggagggagtatacgaataggaggtgggtcacagagatcacgtgcttcacaaggtaatagaatatcacaaggcaaatggaggcagggcgagatcacaggaccacaggactgggttgaaattaaaattgctaatgaagtttcgggcaccatcgtcattgataacatcttatcaggagacagggtttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctggctcaccggcggtcagagtttaaggttatctctcttattccctgaacattgctgttatcctgttcttttttcaaggtgcctagatttcatattgtttaaacacacatgctctacaatttctgcacttaacacaattatcacagggtcctgaggcgacatacgtcctcctcggcttacgagatgacaggattaagagattaaaacaggcataggaaatcacaagggtattgattggggaagtgataagtgtccatgaaatcttcacaatttatgtttagagattgcagtaaagacaggcataagaaattataaaagtattaatttggggaactaataaatgtccatgaaatcttcacgatccacgttcttccgccatggcttcagccagtccctccgtttggggtccctgacttcccgcaacagacaacttgagttgcatcaaactaaaaagcatctgcactgcaaagggtacagttaacagaatgaagacacgggttttgagaaaccattttcaaatcatatatctgataaggggctaatatccaaaatgtattaagaaacccaagcccaatagcaagaaaacaactgtctttaaaagggggaaaaggacctcaacttaaatttttcagaggaagacatgagtggccaattgattgatacatgaaaaaaatgctcaacatctctaatcattagtgagttgcaaatcaaaactgcaagatattaccttacaccttttagaatggctattattaaaaggatgaaagacaggtgctggcaaggatgtggataaaaggaagtcccaacattctgttagtgggaatataaattagtatagccaatttaggaaactatatggtggttccttaagaaactaaaagtacaattactatatgatctagcaatctctacttaggtatatatccaaaggaattgaagcagtatgttgagatcttgcactcccttattttgaaattatttacaaagctaataaatggaaaagacttaagttttcataacagatgaatggacatagaagatgtgttgtatatacatattggaatattttttatccttggaaaagaaggaaaattgtcatttgtgacaacatggatgaatctgtagtatactatgctaagtgttgtaagacaggcacagagaggcaaatactacattatatttgtatgtggaatctaagaaaggctaactcatacaagtagaaagttggatgttatggtttccaggatgtgggtgttggagagatgggcaaaggcaagacgttggtcaaagagtaccaattttctgttaggaggaataagttttagacatatttcacagcatggtgaccattgtcactgactgtatattttaaaattgttataagtagatattaaagttgtcacaacaaaagtaggtgaagttatggatatgttaatgtgcttgatttagttattacactatgtatacatacaaaaacatcagatagttccctggaattatatacaattattacttgtcaattataaaaaaaagccctactgcaaccactaaaaaggattttcatataatagagggaaaaatcgttaaagataataatacattattttagaaaatattaacttataaaaagtagtataggagggattctgtaaaagaagatagacatagaattttaaaatgtataatggaaaatttaaatccagctgtactgatggatcaagcaatccaaaccagtctgattgaccaagtggatatttaaaaaacaatcaaactataaggtgtctgttgtaggcagtttataaaatacaaaagtgttgaaagaaataggatggaaatagaaatatccaagtagcaaccacaaaaaaactggaatgtctgcactaacatcatacaaaacaaaccaaatgaaggttaaaaatattgaaattatacaaaatatgttctatgactaaaatttaatgaaattagaaataacacagagataggaactatacatatttgtgcaaatttaaaaagttatgctgagtgtggtggctcacacctgtaatcccagcactttgggaggccggggagggtggatcacttgaagtcaggagttggagaccagcctggccaacatggtgaaaccctgtctctactaaaaatacagaaaattagccagatgtggtggtgtgcgcctgtagtcccagctactcgggtggctgaggcactagaatcacttgagcctaggaggcagaggtggcagtgagccgagatcacaccactgcactgcagcctgggcgacaaagactgtcaaaaaaaaaaaaaaaaaaaaaaagttacgtaaccaacaagtcaaaggagaatttataaggaaatcagaaaatactttgaggtgaatgaaaatacagaaacaacatatcaaattctgtgagatgtgtgaaagcaacgcttacagtgaaattaatagctatgaacattgtaatgaaatgagaagtacttcaaattactaacctaactttccaactttagaaaatacagtaaaaaaagaacaaattaaaatcaaagcagaaaggatataaagtttagtgtggaaatagagaattaaaaataattgagaaacacagcacttcgttgacttattcataaaataaagctttattaaaatgagaaatgtaaaacgtgatgttcctaatgaccttattccatacaagggattagtattttgacaaatatctttgtggaagtagacaaattcctagaaagacactgactaccacaactcattcaagaacaaagtgaagacaataaattggtaatttaaaaactctcacccctgcccctgacacacatgtaaattcccagttcaaatgtattcttttgtatattataccaaacacatgaaaattaccaattcgataaaaatgtcttaaaaacttggaagagcatgtaatattttttactggttctatgatgctattgttatctagataccaaagtgaaacatcatacacagggaaaactctgataatatcgcttatgagtggatctgtgaaatttcctagtaaattttggcaaaccaaatacagtaacatataaacaggaatgtacaccagtacccagtacagtgtatccctggaatgcaacgttatttcatcagctggaaatgattagtgcaacagactgaaggaagaaaacaacatggtcatctcaatagattgtggacggctggaagtggaggctcacgcctgtaatcctaatactcctaccaacagtgtataagcattcctttttctctgtaacttcaccagaatctgtttttttgtttgtttgtttgtttgtttttgactttgtaatagccatgggctgggctcagtgactcacgcctgtaatcctagcactgggggaggctgaggtgggcggatcacttgaggtcaggagttcgagaccagcctggccaacatggtgaaaccccatctctactaaaaatactaaaattacctgtgcatggtggcaagtgcctgtaatcccagctactcgggagtctgaggcagtagaatcacttgaacccaggaggtggaggttgcagtgagcggagattgtgccactgcacttggacctggctgacacagcaagactatgtttaaaaaaaaagagagagaaaaaaaaaatagaaggtggaaaaagtatttggtaaactaagaagtaaaccacaacctagtaaagggcatattttaagaattcacaactagaacctggtgccgtggctgtaatcccagcacttggggaagccaaagcaggattacttgaggccagaagtctgagatcagcctaggcaatataaggatactctgtatcttaaaaaaaaaaaaaaaatccagatgtgatgacacatgcctgtacgcctagctacttgggaagctgaggttcatgtttacaatgagctatgatgatgccactgtactcctgactgaacaacagagtgagaccctgtctctaaaaagcaaaacaaaacagaaaacccaaaaccctcaaaactaatgttacacttagtatttaaagaatgctttctctgtaagaagaggagcaaggacaggataaaacattcttgccagttctgttcaacagtgtactggaagtatctgtgacattaattgcattgcatatggaaggaaataaaattttttaaataggaagcagcaaaaccttttgcagatgacatggttttgtacatacacaaccccagtggatccaataaatttggattccaataacaagatcatctcagcaagtttttgtgatttaagattacaatccaaaaatcagttgtatttctatatattattaaagaagtcaaaagtgacatcattgaaacatttttatttacaatattattaaggcaaaatactgtgggataaagtgaaattcagcatgaactgtgaataacacaaaatatttgtcagaggagttgaggaatatctacatatgtggaaagacatctcatatttgtggactagaagatttaagcatcgctaggtgcggtggctcacgcctgtaatcccagcactttggtaggctgaggtgggcggatcacaaggtcgggagttcgagaccagcctggccaatatggtgaaaccccgtctctactaaaaatacaaaaaaattaggcgggtgtggtggcgcatgcctgtaatcccaatccctctaggctgaggcaggagaatctcttgatcccgggaggcggaggttgcagtgagccaagatcgggccactgcactccagcctgggcaacagagctaggctccctctcaaaaaaaaaaaaaaaaaagcatcaaaaggatagttcattaatggaaataataaattgaaaaagggaaggacatcaaagtttaatgcttttactttttcataataaccataaatagtatgaaaatacaaactatattcatggaaaatgttttgtttttattttttttgagacagaattttgctcttgtttcccaggctggagtgcaatggcacgatctcagctcaccacaacctctgcctcccgggttcaagtgattctcctgcctcaacctcccaaatagatgggattacaggcatgtgccagtacgcccgcctaatttttttgttatttctagtagagatgaggtttctccatgttggtcaggctggtctcgaattcccgacctcaggtaatctgctcgcctctgcctcccaaagtactgggattataggtgtgagccaccatgcccggccctttgttttcaaatctcatatccaacattggacttatggctagaatatttacataattctcaaaagatagtattaaaaatccaaagctttaaattagaaaatgggcaaaagtcatgaaagaacattcccctgaggatagggaaatgtcaataaggacatgatggaaattaatactatgatgagatattacagaagatttatttttctttgaggcggagtctgcctctgtcaccgaggctggagtgcagtggcatgatctcagctcactgcaacctccacctcccgggttccagcgattctcctgcctcagcctcccaagtagctgggattacaggcgcctgccaccacgcccagctaatttttttttttttttttttttttgtatttttagtagagacggggtttctccatgttggccaagctggtctcaaactcctgacctcaggtgacccacctgcctcagcctcccaaagtgctggaattaagaggtgtgagccaccacacctggcctacagcagatttatttcagtagctgaaatagttaaaacataatgattccaaaggctgagaagcatgcagaaaaaattgaatctttattgctgatgggaatataaaactgtataccacattggaaaataatttggcaatttcttttaaagctaaacacacacatacagttagttaggcttagcaattgctgtcatggcctatttcatagaaatgaaaatttatgtgtagaccaaacctgcacttgactgttcacagaaattttatttgtaatagtcagaacctggaaacaactcacatgttattcaccaggtaaacagttaaataagtctgttatttccgtattgtgtaatacaactcaaaaattaaaaggaataaactactactatacaaataagccttagatgattctcaattctgaaggaaaaacccatttcaagttgtaacataatgcttatttttatgtatcttaatgtgatgaagttaaatagtttagagaacattgttcgtattcatctgttagggatggtagaagttagggttgtatgtgattataagactagtggaagggatacgtttttaatgatggatgagttctgcattctgattcatgcagtggttacaaaaatgtatacatgtgataaaatgtcatgtaaatgtgcacatttcaccaatgacaatgtgctggttgtgatattgtacaatgttaatggaaaatatcaccactggggaaaattgagtggtatgtgtaaacggtactatatttgcagcattttgtgagtctttattttaacataatatgtaaatatgtaaagcaactagaagaatggttttaatacaggagagtaacagcttataagcaagagaaagaaaaatgataaataatgtgaacacttaccaaaggaagggtggaacagagaaataaaggacagggaaaattatctgggatgattcctaaattccaatatttggatggaactatacagaattttaatatatctggaaaataaactgaaaatattaacggatccacagatattgaagacttaaccttttttatctcattattcattaaaacaagtgaaatgttatagggaattcttcaaattgaaagaagcagctcatgcataacacaaaaacatgaatgtataaaactgactggtaaaaggtaagtaactcaaattcacagtactggtatactgtaatggtggtgtacaaataacgtatatctttattgttaaggttaatacacaaaacttttttaatgagatggctgttgctatgttgctcaggctggtctgaaacttctgggctcaagcaattttcccccctcagccttctgattagacggtattatgggcacctgccatgatgtccatctacaaaactattaataattacaacaatttgtttagccatatgtgatataaatatatgtaaggtgtgacatcaagaacataatgggtcaccaaaatctcagagtaaaaacactctggttttactcacccccatagaacctcagtaatatatccagcaccaatattatcacaagttatatcccagaactgaaatccgaggctgagacatttcctcagactacagagaagtgaaaaacttggagcagatgataaaaggcttcttctgtatttatgagactcctatgtgcctgccatcatgtgtggaaaattttatcgacattcaccagttcaacatgggataaatgtgagattttggcacacagcttcttcaccatcttggcttctcttgttgaaaagctgttaatagcttaaaacatgggaagtattgtgtgtgcttgtagaaagaaaatcccatgatggcagtgaaagacaattgggccagttgagattcacaactccagcctgaaaattttctttacgtcagacaacatagatgccaagtcagagtggctgttcagcagcactataatgtagtaggcagagttcatagttctttgcacaaatgcctatccaaccttcctgcacagccagaggattgactttgggacccctatatgggatgggcaatgctccaaatgtttgtgagagctgagtcaaatctaaaacaggcagcactcacggattaagtagtcttgacagggaactacaaataataatatctaagaaaatatactctaggaagaccaaaaaaagctagacagctgagactggaataaatatataattaattgttcaatgtgaaactgtaggcatacgtctacaagaaacagcagcaagccaataaccatgactaccctgaacagagaaagcatggagccagttgccatccctaatgagatggtaatgtttgaactctagaatcaagaattcataaatgcaattttaaggaaatgtagcaaaacccaagataatgcagaaaaggaatccaagaatgtattagaaacttgaagagattgaaataatacaccaaacaaatattgcaaatgagaaataattgtttcaactgaaataattattagaggatgtcattagcagaatggatcaagcataaaaaaacagtgatcttaaagatagggtattggagaatctgtagagattaaagaaatagaaaaggcctagagaatagctacaggatatagagaataacgtccaaacagcaaattaaataatcattggtgttcaagtggtagttttggaatagcaagggcagtaaagcttattcaatgaaataacaatacattccaaatgtagaggaaagtacttttcaggtacaacaacgttaaagaccaaatagattcagtttaattaagaataccccaaggtgtgtgtgtgtgtatatatatatatatatatatatatataatcatctcaaaaacatactacaaagagaaaggacactgaaaacagcaagagaaaagcaaataacattatatacttccaatttgtttgttaacagacttctgatcagaaattgtacataccaggagggagtgaagtgacataaagtgctaaaggaaaaaagttaaccaacaatactgtacccacaaaagatttccttgaaagattgagagataacatcgtttacaaaaagaaaaggaaacatggtgagaattcatcactagactcgtcattcaagaaatgctaagttctttatcctgaagaaaattatgctaacgtccaaagagaaaaagtttgacattacaaaactcagtggccaatgcaaatacataggcaaatgcagaataaattaatacgcttgttttgtgtaagcctcttatatccataatacgaggagtaagatgcaagtctatgaaaagtaactatagcagcatcataaaatatagccaatttaaaaatagacatgagaaagtcaaaatgtgggggaattgaattaaagcataaaattgattggctgtttatattccttatgatgaaaattattatcggtttaaaaatacttttatctatgagatactaccaaagaaagtcacttaaccacaatgggagaaggaagaaagaaataatttggaaaacgacaaaaaagtaccaatcaaaatgtcaatagtgatttcttacctatcaataataatattgataggtattatctaggatccccctaaaaagaacagagagtggctcagtggatattttaaaaaatcggctgggtgtggtggcttacgcctgtaatcccagcactttgggaggcctaggtgggcggatcacctgaggtcaggagactagcctgaccaatatgatgaaaccgcgtctctactaaaaataatacaaaaaaattagccgggcttggtggcatgcgcatgtaatctcagctactcgggaggctgagacaggagaacagcttgaacccgggaggcggaggttgcagtgagccaagatcacgccattgcacttcagcctgggcaacgagcgaaattctgtctcaaaataataacaatagtcagtcccaactatatgctgcatgtaaaaaattaacttacatatacacattgactaaaagtgaagggatgcaaaaagttttcaaatggaaaccaataaatagcagctgtatttgtatcagataacagaaaattttcacttaatatttattaggtgaaaaggtgtgaatagagacaaaaaagtattatgtagtaaatacttatgaagggtcaattcaggaagagggtataaaaatcgtaaatatgtatgcatcctgcagcagaacaccaaaatatataaagcaaactgtaagcgacctaaagcgagagaaactgcaatacagtaatagtaggggactttagtaacccttcctcaactcttgtcacctgagtacacagaggcttattccaactgggggaacgaaatagaagacagtgggataatttgcctagtaacccaggcagttctaccctggtattccccaagtccaccagtgctgtgtatgtgccaggctttaagcctggctgtgttcctggtcctagggcgccctctagtgatgaaatggttgcagtgaccacattcttagataaaacaacacaatcacatttaatttttgggacgccctgtgaagaagggcagctacgaagtagcagactacaaagattggaataaatacctaactcttaaatgcctggacactggagaacttccacaagcataagaccatccaggagacatgacatctccaaaaggactatgggatctagttttggagcgatgtagttatgttgcctctcatacaggaaactcaaaatagctaggaactatgatctaaaatatacaaaggaagtagccactgaccgaccctaatgagatggtgatgtgtgtgatgtcagggtaagaattcaggagaaacgttttgggaaaatagcaaacaccatgataatgcaggaaagcaattcagtaatttattaaatgtaacaaatactgaaacaatagataaccaaactgaaatactggaactgagaaataatgactgaatggacaaatgcaccagaaggtctcaacagcagcactgatccagcagaacaagaatcagtattattaaagacaggctatatgaaaatgcacagtgagtgcagaaagaagcaaaaagaacaaaaaagtatgaagcatgcgtacaaggtgaagaaaataatcttgaaagcacaaacctcagagttaccattcttaaagagggagagtttggagttgaaagtttagagaagtaggccgggcatggtggctcacgcctgtaatcccagcgctttgggaggccgaggtgggtggatcacctgaggtcgggagttcgagacgagcctgcccaacatggtgaaacccacgtctctactaaaaatacaaaagttagctgggcgtggtggctcacgcctgtagtcccagctacttgggaggctgaggcacgaaaattgcttgaaccagggaggcagaggttgcagtgagctatgtatgtgtatatccagatgtgattacccaggtagaagacagtaaaaaacaaaaacaagcagattcaaccaaaataaggctttgccaaggaatgtaacaatcaaatgttcagaggtagagaaaaatttaaatggtcctaaaagctgcaagaaaacaagcaaataatgtataaatgagctctgatacatccggtagtgaagagtttacaggctaggagggagtatgatgacatatttagtgctgaaggaaataacctgccaaatcagaatatcaaattcagcaaaatattcttcaaacttgaaaaataaatactttaccagacacacaacagctgaggaatttttgtcaacatcagacttgtcttaaatgctagaaagagtaattcagtctgaaaggacattaatgagcaaaaagaaaacatccgaatgtttacaactcatagaaaaaggaggtacataaatatagaataatactgtgattgtggtatgtaaacatatttttagcaggaagaagactaaaaggtaattctattaaaattataactacaaaaatattagagatagataaacataacaaagataagatcatagcatgtagggtggagattaagtgtggagttctttggttttctctttgcttgtcattccttgtgactacagataccttgtcattaatttaaaattattggttatatgatggtttttgcaagccgcatgacaacaaccatgcaaaaacctcagaaaataaaagcaaggaattaaaatatactatcagaaaaaaattagttaatggaatacagggaggaaagaagaatggacgagaggaccaactaagcaaaatttgaaagaatggaaaaggagcaaacactttcagtttcattctacaaggccagtgtttccccgataactaaaggaaaaggtctaaaaacccccaaacaacaataaaccccagaagacaaatatgtctgattcacacagatggaacaatccagaagaaaatgctagtaaactgtattcaacaacacactaaaaatataattcatacttatcaaggtggattaatcttaggaatgcatggattgttcaagctatgcaaatcaattagttttatgtcgtataacaaagtcaacaaccataatgttgtaatggatgtccaaaaagtattttataaattaaatattttattaaaaattatctcaaaattgggtatagagttaagatatctcaacagactggcagttgaacttacactgtccttgtgagcaaggaaaactgacaagcatactgctagatttggaagacattaaaaatgcccatgttcagcactttagttcaccatgttactgggagttctagtcagagcaagtataaaagagaaacaaataagggcattcatattagaaagggagaattataaatatcccaacagatacaaataaaatatataggaagaaacttaaccaatcaagtaaaatgtatctacaaggaaaactatgagtcattgatagaaattgaagaggacactagtaaatgaaaagatactgcatgttcatttagcgggagaagttatattgttaaaaacccatactacatatagcaatctatagtttcaaaatgccagtgttattttttcacagaaataggaacaagacgaagaatagacacagtaatcctgagccaaaagaacaaagctggagtcatcacattacctgacttaaaattatatgacaacgtaacactaaccaaaaccgaatgtgacttgcatacatatacatacaccaatgtaacatctacaaaccagaaatccatgtattgaaactaaacttggcctatcagagagctccaacagcccaggctccacaggttgagtgagtgctgccagcacaaatgtatttataggtgtttgtaatcccgctcctgctgggccatcactcgtgcaatcgtgtgcatgaacaacggtaacctcgccccttgtttgttgttactggtgcgaatgggcaccagcaactccacacctaccattctgccccaagtgcaaatgtgcacatgggtggcagcaactagcctcctctagggcctcatatttgcagccagtggcatgagttctagcatggacgatgttaaaccctactcttccagtgtccctccccatctgacacatgtacactcttccatgctgttgaggctactggcacgagcaagtgagcctggatcccactgccaccaacccaatgaaatagtatggctaccaccccctatttgaaaactgtgggcagcgtaacaggaacacatccgcccctccagttcggcatgtttctaaccttgagggaccagagaacacagcgtcctttcttgaccctgcttccccagagttagagcatgcagcccaggaatcctgaggtgagccttggccccctaaaatcttccagaaatgaagccagtcaactgaacccactttacacctcaatcaaaacccaagggcattgaagaagattaaagaaaaacatcatacaaagcacagcatcttcaaagatggaaagaatattagtccacatacatgagaaagaagtattgcaagaactctggcagtttgaaaagccatagtgtcttctaacttccaaagggccacactagctttctgggagaggttcttaaccaggctgagatgggttaaatgacacagggtaaagaatatgggtatgaatgaagatcattgagattcaggagaaagttgaaacctaatctaaggaatttaaggaacacaataaaacaatacagatgttgaaaactgaaatggccattttaaaatctggtagagctgaaaagcacactacataattacataatgtaattgggagtattaacagcatagatgaagctaaggagaatctcagctctaagactatttagttgaattagctgtcagacaaatattttaaaaaatttaaaaactaaacaaaatctctatgaaatatggcattcaaatctatgagtcactgacattcctgaaagaggcaaagaaagcaagcaactttttagtttattgtccatcagtttttctgcaaccttgctagagaggccaaaattcaaattcaggaaattctgagaacactgcaaaatactgtcccccagacagttatcagattgaaatgaaagaaaatgtccaaaacaactatagagaagggccgggtaaactacaaagggaagcccatcaggctaacggcatacctttcagcagaatccctagaagccagaagatatggatacctatattcggcgtttttaatatgaagtgattccaaccagtaatttcatattcagccaaattaagctttataggtgaaggagaaataagatcctttacaggcaaggaagtgccaaggcatttcattaccaccagacctgccttaccagaggtccttaactgagtgctcaatatgaaaaggaatgaccattattggccaccaaaaaaacacatttaagtacacagaccactgacactataaaccaaatgcacaattaaccagcaaccagctaatagtaatacagaatcaaatataaacatatcagtgttacgtttgaaattaaatagactactgtcctaataaatgataaaaagaggcaagttggataaaaaagaccgaactgtatgctgtcttcctgaaacccatttcagaagtaatggcacccattgactcaaggtaaagggatggagaaaattctaccaagcaaacagaaaaaaggaggagggacagattgctattctaacttcatagaaaatagactttaaaacagcaattgtcaataaggacagagaaagatataatcatgaagagttcaactcaacaagagctaactatatatgcactgaacacaggatcatgcgcgttcataaaagaagttcctacagacctatgaagagacttagataagcagacaataagagtgggaaacttcactaccccattgacactattagatcactgaggctgaaagctaagagatattttagtcctgtacttgacacttgaccaaatggacctatcagacatccatattaatgtccacccaaaaccaccaagtacacattcttctcatctgcacatggcacatactctatagttgactacacagtgggccataaaacaatcctcaccaaattcaaataacagcaaaatcatactaaacagatctttggaccagagcacaataaaaatagaaatcaacacgaagattactcaacactatacaattacatggaaattaagcaacttgatccttaattatgttggcataaataatgaagttaaagcagaaatggacaagttcaatatctcaatttaacaagctaatataacaaacagaggaattagaaaacgagtacactaattccaaagctagcagcagacaagaaataactaaccagttttgaaattgaatcagtaataaaaaccctaccaaccctacctggacctgatggatttatggctgaatacaaccagatatgtaagaaagagctggtgaaattcctagttaagctattccaaaatatcaaggaggaaggactcctcccttaatcattttatgaagccagcatgatcctgataccaaaacttggcagagacacaacacaaacttgagacaaatatccttgatgaacttaaaaggaaaaattctcaagaaaataccagcaaacctaatccacttgcatatcagaaagcaaattccccatgattaaggaggctatatttgtgtgatgcaaggttggtacaacatacagaacttacgaaaaaaatgtgatttatcacataagcagagctaaaaccatgttcatctctatagatgcagaaactatttatttaacattacttcatgttatgaaccctcaacaaattaggcattgaagaaacatatctcaaaataatgacccatctgttacaaactcacagccaacctcataatcaactggcaaaagttggaagcattccttttatgaccagagcaagtcaaggatgctcagtgtcaccacacctattcaacatactactggaagttctagctagagcaatcagttaatagaaaaggcatccaaataggaaaagaagtaaaactatctctgcagacaacatgattttatacatagaaaacctcaaagccccaaagctcctagattagatacaaaacttcaacaaagtttcagtataaaaagtcagtctgtaacttagcatttctatacagcaccaacatcaaagctcagaattgaatcaggaaggcaaacccattcacaatagccacaaaaagcataaatcacccaggaacacatttaaccaggaaggtgaaagatcactataaggagaattacaaaacactactgaaggaaatcatagatgacacaaataggaagaaatgacattgttaaaatggccataatccccaaagcaatttatacattaattgctattcaaactaccaatgacattctttgcagaattaatacaacctttaaaaattcatatggagtgaaaaagtcctaatagccaaggcaattctagacaaaaaacaaacttggaagcataacattacctgaatttgaaagtattctacaagattacagtaaccataacagcatggtaccggtataaaagtagacatggaggccaatggagcagaatatagaacacaaagctgtacaccaacagtcatctgcttctcaacaaagttgacaaaacaagcaatgaagacaggacttcctgttcaataaatggtgctggcataactgactacgtatatattcaaggttgacactggaccgcttccttacattacatataatgactcaatatagattaagggcttaaatgtaaaatataataccataaaaatgctaaaatataacttaggaaataccatgctgaacataggttctgaaaaatatttatgatgaagactccaaatgcaattacagcaaaaacaaaaattgacaaatagaacctagttaaactatagagattctgcacagcaagagaatctatcaatggtgaacacaatgtacagaatgggagaaatatctgcaaattatgcatctgacaaagttctaatatccagaatttataagctacttaaattcatggggagaaaaccacattgaaaatatgaaaaagtacatagacattttttcaaaggaagacatgcatacagctaggagtcatatgacaaaatgctgaacatcactaatctatagagaaatgctaattaaaaccacaatgcaattctgtcttacaccaaccagaatggctgttactaaaaagtcaaaaatagtacgttgtcgaatctacagataaaagggaatgcttatggattgctcgttgaattgtaaattatttcatccattgtggatagcagcttggtgattttgccaataacaagaacatcaaacagaaataccatttgatgcaggaatcccattattggttttataccaaaaggagtatagattttaggaccataaagacacatgaatgtgcatgtcaattggagcactcttcataatagtgaagatatgaagtgaagcttaacacccactgatggctgaccatatgaagaaaacatacatgtacaccatggtacactacaacatcataaaaaagaatgaaattatgtcctttgcaccaacatggttgaactattttgaaaatacgtggcagcaatgtcaaatcatcagaagaaaaggaaccatatgattttgtaaatgggcaaatagagtaaccatttctccaaagaatacacaaacatgaccaagaagtaactgaaaaaaaaccacaagtcaaaaccacaatgtgagattctctcactgcagttcaaatagctgttatcaaaaggacaaataatgctgtcaagcaagaaggcaaaagggatctctgataacactgttgggggagtcttgctctgtattccaggctggagtgcagtggcatgatctcggttcactgcaacttttgccttccagattcaagcaattttcctgccccagcctcccaagtagctgggattataggcatatgccaccacacctagctaatttttgtatttttagtagaggcagagtttcaccatgttggccaggctggtctccaactcctgacctcaggtgatccacccgccttggcctcccaaagtgccgggattacaggtgtgagccaccacgcccagccaatattcacggttttctaaaacaattagttgataaaactaccatactattcagcatttcttccatgggctacatccaaaagaagggatgtaaatatattgaagagatagctgcactgatatgtttatggcagtatttacaatcactaggatatagaatcaccctgtgtgtccatcagttgatgaatggataaagaaagtgtggtatgtatacacaatagaatgaatattcagtcatacttaagaatgacatcctgtcacttgcaactacatgtatggaacagtaggacataataagtaaaataagccaggcatggaaagactgtgtattctcactcatttgtggtaggtacaaagaacctatggatttagagggtggaatgacggttatcagtaatgggttgatgtgttaggaaaaggaaataaggagggtatggttaaggagtacaaaatgccatttgaaagtaggaataagatctgttttgcgggagaacaataggacagctatagtaaataattattgtatatttgaaagtaattacaagagtagaagttgattgttcctaacacagagaaatgatgaatgctcgagggaatgtatatctccattaccttgttttgattgttgcacatgacacatttgtattgcaatatcatgtgtcccatatatatgtacatatatacaactatcatgtcccaataatatttaagcatatgtgatttttataaacaagtgaactagttaggggtagataaatctaaaataaaaacaagcataaatctatatataacaagtctacagctaatataatgaacaattgaaattccttcctctaatatctggaacaggataggatgcccactttcaccacttttattccatataacattctatccagagctattaggcaagtgaaagaaataatgggcatccaaatgaagagaagttaaataatattgctgcaggattctaaggagcaatacagaaatttttagcatttacatttgccaacagtgaaaaatctgaaaaagaactcaagaaagcaatctcatttggaatctctacaaaaaaatcaaatagtcaaactttgaagtcatgaaacatccctacaaggtattgagggaaccggcccccaatatttcaatgtaggttcttttctatttttcctaagtgttggccggtctgagaaataaagggtaagagtacaaaagagagaaattttaaagctgggtgtctggggaagacatcacatgtcagcaggttctgtgatgccccgagccacaaaaccagcaagtttttattagcgattttcaaaggggagagagtgtacgaatagggtgtggatcacagagatcacatgcttcaaaggcaataaaatatcacaaggcaaatgggcagggcaaggtcacaaggccagggtgaaactagaattgctgatgaagtttcatgtcccactgtgcatgcattgtcattgataaacatcttaacaggaaacagagttcaagagcagagaaccagtctgactagaatttgccaggctggaatttcctaatcctagcaagcctgggggtgctgcaggagaccagggcatgtttcatccccatctacaactgcataaggcagacactcccagagcggccattttagaggcctccccctgggaatgcattcttttcccagggctgttaattattaatattccttactggggaaagaattcagcgatatttctcttacccattttcggcaataagagaaatatgactctgtcctgcctggctcccaggcagtcaaacctaatggttatctcccttgttccccgaacatcgctgttatcctgtcctttttttcaaggtgcccagatttcatgttgttcaaacacacatgctttacaaacaacgtgtgcagttaacacaatcatcacagggtcctgaggcgacatacatcctcagcttacgaagacaacaggattaagagattaaagacaggcataggagattataagagtattgattggggaagtgataaatgtccatgaaatcttcacaatttatatttagagattgcagtaaagacaggcgtaagaaattataaaagtattaatttgggaacaaacaaatgtccatgaaatctttacaatttatgttcttctgccatggcttcagcaggtccctccatttggggtccctgacttcccgcaacaaaaaggaaaacattgataatggaaactgaataggacacaatgaaatgggaaattattcataattaaaatatcattactgcctaaagcagtctgcagattcattctttttgtatcaaaaatcaatgatattcctcatagaaatagaaaaagaattcataaaattcatgagaccacaggagatactgagtatcaaaagtaatcctgaggaaaagcaaagatgaagacatcatactacttcaaaagatactacaatgtcattgtaaacacaatgtgatgatattggcatgatatacacgtagatcagtgggatgaaatcaagaacccagtgataaatacagacatttacaaaaaattcatttttaaaaatcaccataaatatatgttgtggaaaggatagtgctttcaatgaaagttgctgggaaaacttggtaatcatatgcagaagaatgaatcttaccatatgtaaaaataaaattaatatgggttaagtgcttatgtctgaaactataaaaagtggtagataaaatctttgtataaatgcttctggatatttgtctaggcaaagatattttggtaagctctgaaaagcagaggcaacaaaagcaaaaatagacataagttcatacatctagctaaaatgcttttgcacaatagaggtaacaaaatagtgaaaccaaaattataatgggaaaaaacctgataactatgttttttacagcgatgagaatatatattcatatcatcagaaggcaagcaaataatctgattttaaaggatagattaaaagaaggcataagttgccaacaggtatatgtaaaatttttcatcatcactaatcatcatggaagtgcaatttcaagccacaatggaatgttgtgcaattaaaacaaatatctaaaagacaacagatggtgttgagcatgcatacaattggttatgctcatgtactgtttctgagaatgtaaatttgtatagccattcttgaaaacagtattgtgttgtctcataaaacaaatgatgtaaccactatactgtgtcaattccactactcagtatttatcacaatgaaaggtatcagtatattaggaggatattttcatccatctccttattgcagctctattcacaatagcttttgaattaacctgaaagttcatcaagggatgcatggaaaatggcaatattatatatatgcactattgaaaattgttaattaaaaggaacaaaatcatatcactttcagtaatatgactggaattggaggtcattatggtaagtgaaagaagccaagcacaaaaaaataaacactgcgtgttctcatgtatatgttaaaatataaaatagttgatctgcttggtgcgcagagttgattgctggttactgaatgatcttctattcaaggggggaagacaacaattttgactaatgagtacaaaaacaagtagaataaataagtcctaatatttgatagtacagtaaggtgacaacagtaaacagtatttcatgttattgtttaaggttgctgaaataatagaggaattataatgttcctaacataaaaagagactaatgtttggggtgatgcatgtttcaactaccctagttcaattactactgactgtattcatgtatcaaaataccacatgtaccctctaaaatgtacaacttttatgtatccaggtgaatattcaaaattcagagattagtgtgaaaatgttaccgcttatttttccatcaaaattgttattaaaatagcttatcaggtgtttttgttgtctcatggaaccaccaaatatctatagtagatacacaaaaaataaaaagtaagacattttacaacaccacaagattaaaaaataattacaagatagtgggagaataaaaaaatgaaggaaggatctagtaataaacaagaaagcaatttacaaacatttctttaaatattaacaatattttgaatctaaatggaataaattcttcattaaaaatagagtagcagaatggatattataaaatactgcctataagacactcacttcacttgtaaggacacatggactgaaagtaatgggatgaaaaactattgtatagaaatcgaaagcaaacgagtatcagtagctaaacttattccatcaaactatacatgaagccagaaaccataaaatttgggaaataagtttattacataatggtaaaaggggttaattcagcaagaggttatagtaattgtaaatacatatatacccaaaacagaagtgctcaatcatataaaacaaatataataacttctgagtggacagatagattgccatacaataataataggggacttaagtactgaagtttcagcaatgggcagatcatctggatctgacttacactacatctggcttacactacactttatgccaaataaagcaaactgacgtatacagaatacttcgtctaacagcggcacaatctacattcttctctgcagaagatggatctttgcgtaggccttatgttacgaatcaagactagttttacatttaataatacagaaattataccacatttttaagcacattgcatgaacctaggaactattagtagaatgaacattagaatgttcacaaacacatagaaattaaacaatatgcttttgaataatgaatgggtgaatcattaaatccaaatggaagttaaaaaatattttgacaaatgaaagatgaaacacaaaacaccaatatttgtgataccagaaaagtacttaaaaaataaccttatgttacacctgaagcaactattaatataatgggaagaacaaacagtccaaattttacagaaggaagcatataataaagagcagcgtagaataaatgaaaaaatttgtactcatacaacgtacgcaaatccagtcatgagaaagaatatctgaagagaccaataacaagtaaattgtatccataataaaaatctcctatcaaatatatgcccatagtgcttcactggtaatttctgtcaaacctaattccactttatattaagaggattacttgccatgttcaaatgggatttgtccctctgaggcaaggatgttttaaatagtcttataaaggaggagggacaccgccatttgatcatctcaatagatttaaaaataaaacagttttatagaatttgatataataaaagctgtcaaccaattaggcatagaaggaatgtatctttataccatataggcagtaaatgaaatacccacaactaacatcataatcaatgaagaaaacatgaaatattttcttcggaggtaaagaagccaattatgcccactctcagcacctcattcaacctagttcgggatgttctagccagtacagttaggcaagagaaggaaattaaaggcattcagatcggaaaagagggaggcaaactgggtctgtgtggagatgacctgaacttatgtgtagaaaatacactctcctggccgggcgcggtggttcacgcctgtaatcccagcactttgggaggccaaggcgggtggatcatgaggtcaggagatcgagaccatcctggctaacacggtgaaaccccgtctctactaaaagaaaaacaaaaaaataaattagctgggggtggtggcgggcgcttgtagtcccagctactcaggaggctgaggcaggagaatgacatgaacctgggaggcggagcttgcagtgagccaagatcgtgccactgcactccagcctgggtgacagagcaagactctgtctcaaaaaaaaaaaaaaaaagaaagaaagaaagaaaatacactctccccttaaaaccttttggaagtgataaagaaattcagtaaaattgcataatacaaaacagccatacaaaaacctgtagcatttctatatcccaccagtgggtaatttcaaaaagaaaacaagaaatgagtctcattgacaatagcttacaaaagtaccgaggaagagatctgaacaagccaaagatttctgtaatgaaaactctttaaaaaataattcattttgtaataaaagcattgaaggaagaaattgacgacacaaatgagtagaaatatattttatatttatgtgttagaataatttatatcttaaaatatatatactactcaaagcaatctattgatctgtgcatccctattaaatttctgatgttatgttagttttgtctataaacagaagaaaataattctgaaattgtatggagcaacaaaaatcttaaatgaaaaaatattaaagaaaatgaggagatccagggtaattgaagtatctggctttaatatagactacaaaattatagtaaccagaacagcattgtctggcataagacagacacagacacaactggaacagagtagaaaggaaataaactaaagctcctaaacataactgattcttcacaaagttgccaggagcacacttcagggaaaataaaacatttaccgtgtaaatggtactgggaaaatttgataattacatgcaaaagaattagattagaagtctacatctaaaaatacacaaaaattaactcccaattgaataaagaattaaatgtaaaattggaaactatgaaacttcttgaagaaaatgggggaaatgattcatgatattttgctgggcaaggatttagaaatgagacctgaacttttcagggaataaaaggaaaaataaccaaatgagagtatatcaaagtttaaagcttttgcacagcgaaagagtattaaaagagtgaggagtcatcgcttctcggcctttgtggaagtcagtgtggcaattcctcagggatctagaactagaaataccatttgacccagccatcccattactgggtatatacccaaaggactataaatcatgctgctataaagatacatgcacatgtatgtttattgtggcactattcacaatagcaaagacttggaaccaacccaaatgtccaacaatgatagactggattaagaaaatgtggcatatatacaccatggaatactatgcagccataaaaaaggatgagttcatgtcctttgtagggacatggatgaaattggaaatcatcattctcagtaaactatcgcaaggacaaaaaaccaaacactgcatgttctcactcataggtgggaattgaacaatgagaacacatggacacaggaaggggaacatcacactctggggactgttgtggggtggggggaggggggagggatagcattgggaggtatacctaatgctaaatgacgagttaatgggcgcagcacaccagcatggcacatgtatacatatgtaactaacctgcacattgtgcacatgtaccctaaaacttaaagtataataataataaaaaataaaagagtgaggagtcaatttacagtattggagaaaatatttgcaaacagtatatgtgacaaagagttaagaagatataaccaacgtaattcaatagcaagaaaaaagtaatatgaattttaaaaaattggcaaaaattgctggctgcttcactcctggaaccttcactaaccagatccaggcagccttccgggagccatggcttgtggttactgaccccagggctgaccaccagcctctcacggaggcatcttatgttaaccaacttaccattgctctgtgtaacacagattctcctctgtgatacgtggacattgccatcccatgcaacaacaagggagctcactcagtgggtttgatgtggtggatgctggctcgggaagttctgcgcatgcgtggcaccatttcccgtgaacacccgtgggagttcatgcctgatctctacttctacagagatcctgaagagattgcaaaagaagagcaggctgctgctgaaaagtgaccaaggaggaatcctgtaatttgcaataacatgaataaattttgaagacagcattttaactgtaataagctagatactgaatgactaatgctgtattatcttactcaaatggatactaagaaaataaaaatttgatatcctaaggtcagagagtagaactgtggttacaatagacaggggaggggcctttgatttggccattaggtacaaagtgacaattagagaagactagtaaattattctgttctttcacacactatcatgactatggttaaatgtaaaatactgtatatttcaaaagagttagaatagacacttttcaatgttttcaccactaagaaatgataactgcatgtgattggattaatatgcaacctaaatacatacgaaaacatcacactaaattcaataaatatatgcaattataattttgagataatgaaaaagaaaaattaaaaaattatgacaagcagaggccaatatctatgatgaacatagacacacaaatgctctacaacaaactagcaacctgaattcaacactgcattaaacattttatttttcataatcaagcggtattcatcccagtgatgcaaaaatgattgtatatatggaaattaatgttatgcattacactaagagaacaaaggattaaaaccatatgatcatctcagtcaatatcataaaagcatttgagaatatttataattttttcatggtaacaactcaaacatttaggcaaagaattgggtctccctattccctgagacagaaccacactgaaaataggacaaacagtaaccctgaaatggcctctaacaatgattgaacttagtgaggaaggaatgttgaaggctgagtggctgaaatctaggccactagtgcaataaatcccatgattttaaaacctagagctaacatgttattcagaggggaaaacataaaagcttttcctcaaataaaaaacacatcacaaatgcccaatctcatcacttgcattcaacatagtactggaagttttcaccacagcaataaggcaagaaaataaaaagcatttaacttggaaagagttattatttatttatttatttattttttaaacatgacatgatcatatgtacagaaaactcttaagaatttcaccaaaaacaagtctacaaaaggaattaaatatcactggaggagacaaatgcaacaaaaacaaattagtaatatttctataatgaaacagcaagctatctgacacaaatcaagaaaacaatcccatttacaatatctaacaaaaaataaaatatttagaattaaattacccaaggaattttaatgcctacacaccaaatattaaaaatttttacttttattgcatgtggctttattatgtttctcagatatcatggtgggttttttttttaaacccacccatgtggcaaccctccatccagcaagtcagttggtgccattttttccagcagcattgtgttgactttgtgtctctataccacattttgttaattttccacttttctttatcattgttaggtatagtaagtgaactttcttcagaattcttattaccatttttattatgatattgaactatgaatctcacttaggtaaaatcatgaacttaatcagcaaatgtgttctgactgcttttctgatgagttgttacctcatcttctttctccacctagggcctccctattgcctgagacagaaacatactgaatataggagacacagtaatcctgaaatggcctctagttgtttaagtggtaggaagacttgcactttcttcaccttatatcaaaatctcaaaatgattaaacttagtgaggaaggcacatggcaggctgagtggctgaagtctaggcctcttgcaccaaatagcaaagttgtggaagcaaaggaaaagttcttgaaaaaaattaaaagtgttacttcactaaacacatatatattgagaaagccaaacagccttattgctgatatggagaacattttagtgattcatatagaatatcaaacaagttataacataccatcaagccaacgcctaatccagagcaaggccctatgtcttttcaattatctggaaatggagtgccggtggattttttttctttattgttatactttaagttctagggtacatgtgcacaacatgcaggtttgttacatatgtatacatgtgccatgttggtgtgctgcacccattaactcgtcatttacattaggtatatctcctaatgctatctctccccctccccccaccccacaacaggccccagtgtgtgatgttccccttcctgtgtccatgtgttctcattgttcaattcccacctatgagtgagaacatgcagtgtttgtttttttgtccttgtgatagtttgctgagagtaatggtttccagcttcatccatgtccctacaaaggacatgaactcatccttttttatggctgcatagtattccatggtgtatatgtgccacattttcttaatccagtctatcactgatggacatttggattggttccaagtctttgctattgtgaatagtgccacaataaacatacgtgtgcatgtgtctttatagcagcatgatttataatcctttgggtacatacccagtaatgggattgctgggtcaaatggtatttctagttctagatccctgaggaattgccacactgtcttccacaatggttgaactagtttacagtcccaccaacagtgtaaaagtgttcctatttctccacatcctctccagcacctgttgtttcctgactttttaatgattgccattctaactggtgtgagatggtatcccattgtggttttgatttgcatttctctgatggccagtgatgatgagcattttttcatatgtctgttggctgcataaaagtcttctttagagaagtgtctgttcatatcctttgccactttttgatggggttgtttttttcttgtaaattggtttgagttctttgtagattctgggtattagccctttgtcagatgagtagattgcaaaaattttctcccattctgtaggttgcctgttcactctgatggtagtttcctttgctgtgcaggagctctttagtttaattagatcccatctgtcaattttggcttttgttgccattgcttttggtgttttagacatgaagtcattgcccatgcctatgtcctgcatggtatttcctaggatttcttctagggtttttatggctttaggtctaacatttaagtctttaatccatcttgaattaatttttgtataaggtgtaaggaaggcatccagtttcagctttctacatatggctagccagttttcccagcaccatttattaaatagggaatcctttccccattgctcgttttttgtcaggtttgtcaaagatcagatggttgtagatgtgtggtattatttctgagggctccaatctgttccattggtctatatctctgttttggtaccagtaccatgctgttttggttactgtggccttgtagtatagtttgaagtcaggtagcgtgatgcctccagctttgttcttttggcttaggattgacttggcaatgtgggcccttttttggttccatatgaacgttaaagtagttttttccaattctgtgaagaaagtcattggtagcttgatggggatggcattgaatctataaattaccttgggcagtatggccattttcaggatattgattcttcccatccatttgcatgaaatgttcttccatttgtttgtatcctcttttcttttgctgagcagtggtttgtagttcttcttgaagaggtccttcacatcccttgtaagttggattcctaggtattttattctctttgaagcaattgtgaatgggagttcactcatgatttggctctgtctctgttattggtgtataagaatgcttgtgatttttgcacattgattttgtatcctgagactttgctgaagatgcttatcagcttgaggagattttgggctgagacaatggggttttctagatatacaatcatgtcatctgcaaacagggacaatttgacttcctcttttcctaatagaataccctttatttctttctcctgcctgattgccctggccagaacttccaacactatgttgaataggagtggtgagagagggcatccctgtcttgtgccagttttcaaagggaatgcttccagtttttgcccattcagtatgatatttcctgtgggtttgtcataaatagctcttattattttgagatacatcccatcaatacctaatttattgagagtttttagcatgaagcgttgttgaattttgtcaaaggccttttctgcatctattgagataatcatatggtttttgtcgttggttctgtttatatgctggattacgtttactgatttgcgtatgttgaaccagccttgcatcccagggatgaagcccacttgattatggtggataagctttttgatgtgctgctggattccgtttgccaatattttattgaggatttttgcatcgatgttcatcagggatattggtctaaaattctctttttttgttgtgtctctgccaggctttggcatcaggatgatgccggcctcataaaatgagttaaggaggattccctctttttctattgattggaataatttcagagggaatggtacaagctccgccttgtacctctggtagaattcggctgtgaatccatctggtcctggactttttttggttggtcagctattaattattgcctcaatttcagagcctgttattggtgtattcagagattcaacttcttcctggtttagtcttgggagggtatatgtgttgaggaatttatccatttcttctagattttctagtttatttgtgtagaggtgtttatagtattctctgatggcagtttgtatttctgtgggatcggtggtgatatcccctttatcattttttattgcatctatttgattcttctctcttttcttttcttctttattacttttgctagtggtctatccattttgttgatcttttcaaaaaaccacgtcctggattcattgattttttgaagggttttttgtgtctctatctccttcagttctgctctgatcttagttatttcttgccttctgctagcttttgaatgtgtttgctcttgcttctctagttcttttatttgtgatgttagggtgtcaattttagatctttcctgccttctctcgtgggcatttagtgctataaatttccctctacacactgctttcaatgtgtcccagagattctggtatgttgtgtctttgttctccttggtttcaaagaacatctttatttctgccttcattttgttgtgtacccagtagtcattcaggagcaggttgttcagtttccatgtagttgaacagatttgagtaagtttcttaatcctgagttctaatttgattgcactgtggtctgagagacagtttgttataatttctgttgttttacatttgctgaggagtgctttacttccaattatgtggtcgatttaggaaggtgtgatgtggtgctgagaagaatgtatattctgttgatttggggtggagagttctgtagatgtctattaggtccgcttggtgcagagctgagttcaattcctggatatcctttttaactttctgtctcgttgatctgtctaatgttgacagtggggtgttaaagtctcccattattattgtgtgggagtctaagtctctttgtaggtctctaaggacttgcttcatgaatctgggtgctccggtattgggtgcatatatatttaggatagttagctcttcttgttgaattgatccctttaccattatgtaatggccttctttgtctcttttgatctttgttgatttaaagtctgttttatcagagactaggattgcaacccctgcctttttttgttttccatttgcttggtagattttcctccatccctttattttgagcctatgtgtgtctctgcacttgagatgggttttctgaatacagcacactgatgggtcttgactgtttatccaatttgccagtctgtgccttttaattgggagcatttagcccattttcatttaaggttaatattattatgtgtgaattggatactgtcattatgatgttaactggttattttgctcgttagttgatgcagtttcttcctagcctcgatggtctttacaattcggcttgtttttgcagtggctggtaccggttgttcctttccatgtttagtgcttccttcaggagctcttttagggcaggcctggtggtgacaaaatctctaagcatttgcttgtctgtaaaggattttatttctccttcacttatgaagcttagtttggctggatatgaaattctgggttgaaaattcttttctttaagaatgttgaatattgacctccactctcttttggcttgtagagtttctgccgagagatccactgttagtctgatgggcttccctttgtgggtaacccgacctttctctctggctgccctaagactttttccttcatttcaactttggtgagtctgacaattatgtgtcttggagttgctcttcttgaggagtatctttgtggcattctctgtatttcctgaatttgaatgttggcctgccttcctaggttggggaagttctcctggataatatcctgcagagtgttttccaacttggttccattctccccgtcactttcaggtacaccaatcagacgtagatttggtcttttcacatagtcctatatttcttggaggctttcttcatttctttttattcttttttctctaaatttctcatttcatttcattcatttgatcttcaatccctgataccctttcttccagttgatgaaatcggttactgaagcttgtgcattcgtcacgtagttctcgtgccatggttttcagctccatcaggtcctttaaggacttctctacactggttattctagttagccattcatctaatcttttttcaaggtttttaactttttcgtgatgggttcgaacttcctcctgtatctcagagaagtttgattttctgaagccttcttctctctattcgtcaaggtcattctccctccagctttgttccactgctggtgaggaggtgcattcctttcgaggaggagaggtgctctgatttttagaattttcagtttttctgctctgttatttccccatctttgtggttttatctacctttggtctttgatgatggtgacgtacagatggggttttggtgtgcatgtcctttctgtttgttagttttccttctaacagtcaggacactcagctgcaggtctgttggagtttgccggaggtccactccagaccctgtttgcctggatatcagcagcagaggctgcagaacagcgaatattgctgaacagcaaatgttgctgcctgatcattcctctggaagtttcatctcagaggggtacctggccgtgtgaggtgtcagtctgcccctactgggggggtgcctcccagttaggctactccgggctcagggacctacttgaggagtcagtctgtccattttcagatttcaaactctgtgctgggagaaccaccactctcttcatagctgtcagacagggacattttaagtcttcagacgtttctgctgccttttgttcggctatgccctgcccccagaggtggagtctacagaggcaggcaggcctccttgagctgcggtgggctccacccagttcgagcttcccagccactttgtttacctactcaagcctcagcaatggtgggtgcccctcccccagcctcactgccgccttgcagttcgatctcagactgctgtgctaggaatgagtgaggctctgtgggcatgggaccctctgagccaggtgtaggatataatctcctggtgttccgtttcctaagaccattggaaaagcacagtattagggtgggagtgacccgattttccaggtgctgtctgtcacagctttgcttggctaggaaagggaattccctgaccccttgcacttcgtgggtgaggcaatgcctcgccctgcttcggctcatgctcggggcactgcacccactttcctgcacccagtgtccgacaagccacagtgagatgaacctggtaccttagttggaaatgcagaaatcacccatcttctgcatcgctcatgctgggagctgtagactggagctgttcctattcggccatcttctttttttgtttgtttgtttttttgtttttttttttttttattttgaattggttcatggttccacaggctatacaggaagcatccctgggcatgcctcaggaaattttcagtcatggtagaaagggaagcaagcacatcttacatggctggagcaggaggaagagagtgaagtgggaggtgctacacacttttaaacaatcagatctcgtgagaactcactatcatgagaacagctagtgggaaatgtgcttccatgatccaattacctcccagcaggcccctcccgcaacattggggattacaatttgacatgatatttgggtggaaacacaaatccaaaccacatcgccaactcaaattaacttctgtctatggtataaggtaggagacaacattgttattttccatactgatgtctagttgttcaacaccatttgttaaaaagactttcttttcccattggattgctttggcacctttgtctgtatgttaattaaccatacaaggatggatctattttggtttctgttcttcttttttttaatactgtaagttctggggtgcatgtgcagaatgtgcaggtttgttacataggtatacatgtgccatggtggtttgctgcacctatcaacttgtcatctacattaggtatttctcttaatgctatcccacctctagtgccccacctccccaacaggccccagtgtgtgatgttccactccctgtgtccatgtgttctcattgttcaactcccatttatgagtgagaacatgcagtgtttggttttctgttcttgttagtttgctaagaatgatggtttctagcctcatccatgtccctgcaaaggacatgaattcatccttttttatggctgcatagtattccatggtagatatgtgcaacaatttttttatccaatctatcattgatgggcatttgggttggctccaagtctttgctattgtgaatagtgccacaatgaacatatgtgtgcatgtgtctttatagtagaatgacttacaatcctttgggtatatactcagtaatgggattgcttggtcaaatggtatttctaattctagatccttgaggaatcaccacactatcttccataatggttgaactaatttacactcccaccaacagtgtaaaagtgttcctatttctccacagcctctccagcatctgttgtttcccgactttttaatgatcgccattctaactggcgtgagaaggtatctcattgtggttttgatttgcatttccctaatgacaagtgatgatgagctttttttcatgtttgttggctgtgtaaatgtcttcttttgagaagtgcctgttcatatcctttgcccactttttgatgggcttgttcctttttttcttgtaaatttgtttaagttctttgtggatcctggatattagccctttgtcagatggatagattgcaaaaattttctcccattctgtgggttgcctgttcactctgatgatagtttcttttgctgtgcagaagctctttagtttaattagatcctatttgtcaattttggcttttgttgctttagtcctgaagtctttgcccatgcctatgtcctgaatggtattgcctaggttttcttctagggattttagggttttaggtcttccgtttcagtctttaatccatattgagttaatttttgtataaggtgtaaggaaagggtccagtttcagttttctgcatatggctagccagctttcccaacaccatttatgaaatatggaatcctttccccattgcttgtttttgtcaagtttgtcaaagatcagatggttgtagatgtgtggttatttctgaggcctcttttctgttccattggtctatatctctgttttggtaccagtaccatgctgttttggttactgtagacttgcagtatagtttaaagtcaggaagtgtgatgtctccagctttattctttttttttaggattgtcttggctatatgggctcttttctgctgccatatgaaatttaaagtaattttttctaattctgtgaagaaagtacatggtagcttgatggggataacattgaatctataaattactttggtcagtatggccattttcacaatattgattcttcttatccaggagcatggaatgtttttccatttatttgtgtcctctcttatttccttgagcagtggtttgtagttctctttgaagatgtccttcacctccctggtaagttgtattcctaggtatgttattctttttgtagcaactgtgaatgggagttcactcatgatttggctctctgcttgtctgttattggtttgtaggaatgattgtgatttttgcacattgattatgtatcctgagacttcgctgaagttgcttatcagcttaaggagattttgggctgatacaatggggttttctaaatatacagtcatgtcatctgcagagagaatgtgacgtcctttcttcctatttgaatatcatttatttctttctcttgccttatttccctggccagaacttccagtactatgttgaattggagttgtgagagagggcatccttttcttgtgctggttttcaaagggtatgcttccagtttttgctcattcagtaagatattggctgttggtttgtcataaatagctcttattattttgagatagggtccaccaatacctaatttattgagagtttttagcatgaagcggtgttgaattttgttgaaggccttttctgcatctattgaggtaatcatgtggtctttgtcattgcttctgtttatgtgatgcattatgcttattgatttgcctatgttgaaccagacttgcatcccagggataaagctgacttgatcatggtagataagctttttgatgtgctgctgtattcggtttgccagtattttattgaggattttcgcattgatgttcatcagggatattggcctgaaattttctttttttgttgtgtctctgccaggttttggtatcaggaagatgctggcctcataaaatgagttagggaggagtctctctttttctattgtttggaatagtttcagaaggaatggcaccagcttctctttgtacctctggtagaattcggctgtgaatccgtctgttcctggactttttatggttggtaggctattactgcctgaatttcaaaacttgttattggtctattcagggattcgacttcttcctggtttagacttgggagggtgcatgtgtccaggaatttatccatttctactggattttctagtttatttgcatagaggtgtttatagtattatctgatagtaacttgtattcctgtgggatcagcggtgatatcattttatcactttttattgcatctatttgattcttctctcttatcttgtttattagtttggctagcagtctatttattttgttgatcttttcaaaacaacagctcctggattcactgatttttttgaagttttttcctgtctctatctccttcagttctgctctgattttagttatttcttgtcttctggtagctgttgaatttgtttgctcttgcttctctagttttttaaattgtaattttagggtgtcaattttagatctttcctgctttctcttgttggcatttagtgctataaatttccctcttaacactgctttagctgtgtcccagagattctggtacgttgtgtctttgttctcattggtttctaagaatatctttatttttctgccttaatttcattactcacccagtagtcattcaggagcagtttgttcagtttccatgtagttttgtggttttgagtgagtttcttaatcctgagttctaatttgattgcactgtggtctgagagactgttatgatttgcattcttttgtatttgctgaggagtgttttacttccagttatgtggtcaattttagaataagtgccatgtggtgctgagaaaaatgtatattctgttgatttttggttgagggttctgtagatgtctatcagttctgcttggtccagagctgagttcaagtcctgaatattcttgttaattttctgtctcgttgatctgtctaatattgacagtggggtgtgaaagtctctcactattgtgtgggaatctaagtctctttgtaggtctctaggaatttgctttatgaatctgggtgctcctgtattgagtgcatatatatttaggagttacctcttcctgctgcattgatccctttaccattatgtaatgcccttttttgtcttttttgatctttgttggcttaaagtcttttttatcagggactgggattgcaacccctgccttttttttttttttttgctttccatttgcttggtaaatattcctccatccctttattttgagcctatgtgcatctttgcatgagatgggtctcctgaatacagcacaccgatgggtcttgactgtttatccaatttgccagtctgtgtcttttaattggggtatttagcctgtttatatttaaggttattattgtgtgtgaatttgatcctctcattatgatgctagctggttattttgcacattagttgacgcagtttcttcatagtgtcgatggcctttagaatttggtatgtttttgcagtggctggtacccgttgttcctttttatgtgtagtgcttttttcaggagttcttgtaaggcagtcctggtggtgacaaaatctcagaatttgcttctctaaatgattttatttcttcacttatgaagcttagtttggctggatatgaaattctgagttgaaaattctttttttacagaatgttgaatattggcccccactctcttctagcttgtagagtttctgcagagagatttgctgttagtctgatgggcttccctttgtgggtaagtcaaactttctctctggctgcccttaacattttttccttcatttcaaccttgctgaatctgacaattatgtgtcttggagttgcccttctcaaagagtatctttgcggtgtcctgtgtatttccccaatttgaatgttggtctgtcttgctaggttgggggaattctcctggataatatcctgaagagtgttttccaaattggttccattctccacgtcacttttagggaccccaatcaatcatagatttgggcttttcacatagtcccatatttcttggaggctttgttcgtgccttttcattctttttttctctaatcttgtcttctcactttatttcattaagttgaccttcaatctctgatatcctttctactgcttgaaacagaatctgtctgcagaaactctacaatcaattcatctattgacacctgtgtatgcttcatgaagttttcgtgctgtgtttttttagctccatcaggtcatttatgttcttctctaaactggttattctagttagcaattcctctaaccttttctcaaagttcttagtttaattgcattgtgttagaacatgctcctttagcttagaggagtttattacccacgttctgaagcctacttctgtcagtttgttaaactcattctccatccagttttgttcccttgctggcgaggagttgtgatcctttggaggagaagaggtgttctggtttttggaattttcagccttttgcactggtttttcctcatcatcatggatttatctacctttggtctttgatgttggtgaccttcggatggggtttttgtatggaagtcctttttgttgatgttgatgctattcctttctgtttgttagttttccttctaacagtcatgccactcagctgcaggtctgctgcagtttgctggaggtccactccagaccctatttgcctgggtatcaccagtggaagctgcagaaccacaaagattgctgcctgtttcttcctttggaagcttcatcccagaggggcacctgccagatgccagctggagctctcttgtatgaggtgtctgttaacccctgctgggaggtgtctcctagtcaggaggcacaggggtcagggacccacttgaggaggccatctttcccttagcagagctcgagcactgtgctgggagattttctgctattttcagagctggtaggtgggaacgtttaagtctgctgaagctgcacccacagatgcccctttcccctggtgctctgtcccagggagttgggagttttttctataaacccctgactggggctgctgcctttctttcagagatgccctgctcagagaggaggaatctagagaggcagtctggctacagtttttgccgagctgtggtgggctctgcccagttcgaacttcctggcagctttgtttacactgacagcggaaaactgcctaaccaagcctcagtatcagcagacgcctctacccccacgaagctggggtgggatccactgagctacaccacttggctccctggcttcagccccctttctagggggagtcaacagttctgtctcgctggtgttccaggcgccactggggtatgaaaagaaactgcagctatctcggtgtctgcccaaacagccaccaaattttgtgcttgaagcccagggccctggtagcataggcacctgagggaatctcctgatctgtgggttgcaaagagcgtgggaaaagcatagtatctgggctggactgcaccatttttcatggcacagtccctcacagcttcccttggctagggaagggagttccttgaccccttgcgtttcctgggtgaggcaacactccaccctgctcagctggcccttcgtgagctgcacccactgtctaaccaattccgatgagatgagctgggtacctcagttggaaatgcagaaatcaccttccttctgtgatgagctcgctgggatcttcagaccacagctgttattattcagccatcttgcctgccacccccttaagctttttattattttcccatttctcaggttgtccactgaattttttatcttgtttcttgcagcaataaagagccacaatgttgaatttacctaattgtttgccaccaactaattgtttttgacaattagttaggtgagaagcatttttgtagcgatccaaattaagtcaggtgactctggggacagcaaaactgccagtttaccatgctgtgatactgagtgttgggggatggggtggtgaatgggaacagttgtaaattaaaatgccaagggccaggccgggcgcggtggctcatgcctgtaatcccagcactttgggaggctgaggtgggcggatcacaaggtcaggagatcgcgaccaccctccccaacatggtgaaaccctgtctctactaaaaatacaaaaattagctgggcgtggtggcacctgcctgtaatcccagctacttgggaggctgaggcaggagaatcgcttgaaccagggagccgggggctgcagtgagctgagatcacgccactgtaccacagcctggccacagagcaagactctgtcttgggccaggtgcagtggctcacgcctgtaatcccagcactttgggaggccaaggcgggaggatcacgaggtcaggagatcaagaccatactgactaacatggtgaaaacctgtctctactaaaaatacaaaacttagccaggcgtggtggcgggcacctgtaatcctagctactcaggaggctgaggcaggagaatcacttgaacctgggaggcagaggttgcagtgagccgagattgcgccactgcactccagcctgggcgacagagctagaccccatctcaaaaaaaaaaaaaaaatacaaaagttagccaagtgtggtagcacacacctgtagtcccagctacttggggggctgagatgagaggatcacctgagcctagatgtcaaggcgacggcgagccatgattgcgccactgcactccaacctgggtgacagagtaagactctgtctcaaaccaaaaataaaaagaaaatttgagaaaaataattcttgaggcctatttaatcacttcctagaaaaaattattgacatcactcccagagtcccaggagagcaacactaaatgcaacttagttaaaaatttttctgtcatagccatatacactatattctaaatacacacacataagcacattagatacatattcacacacaataggtagaaacacatacagaggaaaaaaaatatatatatatatatatcctatgtctttcctagacagccctttctgactaaaaaagtatacttttgtgccaatcagagaaaatttcagtcacctaaaaacctcataaatggagaaaatctgttcatagtaaaacagcagtctgaagctctgtggggtaattatggcctccagggctctaccaagtaaagaaagctgtggctgtagctttcatacttgggaggctgaggcaggagaatggcatgaacctgggaggtggagcttgcagtgagtcgagatggtgccactgcactccagcctggatgacagagcgagactctgtctcaaaaaaaaagaaaagaaaagaaaatactctgtctcaaaaataaataaataaataaataaaataagcaagacttacagtgaaaaaaccatacagattggaaaggaaggaaaaatactgtctctattcacagatgacatgactatttatgtaaaatattcccaaagaatatacaaaaatttctattaaaattaatgaatttagcaagattgcaggattaaaggccaatgtacaaaaattagttgtaaaggaggccaggctctctcacaaaatctaatgatacgtgccacatccaaggttctgaagagcaaacagaccacaggtttacctccactacatctcatcagaacaacgcttgctggcatgggaagccagcccagccaccccacccctgcctgagctcttgggctactagcagctctgcatttccctgggacagagctcccagaggtaaaagacaggcccctcatttttgccacattgcagctcccacccctactgcccttaggcttggcagagagcaaaatgcttaaagactattgcaggcctccagcacaacatagcttccttacagaaaagaagccatatggttttccacatgggcccctgcctctgctacttgtcactggtcaggatctcccaatctgggaccccagcacagccaccctggccccacctgaactctatcccagcatttccctgggattgagctcctagaggtaaaggacaggcctgccatttttgctgctttgcagctcttacccctactgccctcaggcataacaggaagtaaagagcttaagaatgatcatgggcctccagcacagcacaattgccttatggaaaggtaaccaggctgctttccatatgagtccctgcccctgccattcctcactggtcagggtgtcttgacctgggcccccagtaaagctgccctgcccctgcctgaacacttgttggtggtggctgtctgtttctttgaggagaaaatcccagagtcaacccacagcccctctaccattgcagctacagcagtaccgcccttcctgtcctcaagctgggaaagaaacaaaggacctgttcacttcactggcacctccagtatgctgcagctgccatatggcgaggggtcaaatttctcttccctgtgagcccccaccacctacttttcaccaggagggccccccagcaagggactgcaatgcaaccactccacccttggctgaacatttccattggcagtggctctgcatttctctggggtgcaactcccagaggcaactgaaagcccctctgctactgccacagcagtggtactgcccttgctgcccttggattggggaaggtgtcaagaccctgagggttctactcatacctacaccacaatatagctgccctatgaagaagaagccagtctgtcttccactcaagccacacacccactgtgttcatcaccaggcatggccccctggcttggacctgcaacacagctgccccacacctggctgattgatccagtcagcagtgagtctgcatttctctgggttggcacctcaagaaacaagtgaacatttttctgccattgtcattgtcaaggccccaccactgctgcccccaaatggaaaggaaacagaaagcctgagcatgccccgtggctgtggtgtgcagcctgatggtgccaaggtgagatctgaagccagcaatgaagtgggataggagccaacactctcagagcacttagaagaagcatggctgcaactgtgaaggaatacaggggagctgtgtggctgagcaagagcctacctactacccatcacacttaagcaccatctacaaggtcgcagcccaaacttcaacaccaaaaattctttcctaatatatccgccctgcaaaatcaaggtgaaaaattcagtcacaaataaagaccctgaacaaagccttgactctctgaaaacatataaaaatgtcatcaactgactatacccaagttatcccacatttatagaagcgtaagccctcacagatgaggaagaaccagcccaagaacctttgaaactctaaaagccagagtgtctccttaccaccaaatgactgcactagtttcccagcaatagtacgtaactaggcttaaatggctgaaatgacagacataaaattcagaatctggatggcaataaagaccatcaaaatttggagaaagttgaaacccattctaaggaatctaaggaatacagtaaaataattcaatacatgaaagacaaaatagacattttatgaaatgaaccgtactgacctgattgatagagctgaaaaacttactacaaaaatttcatgacacaatggggagaattaactgcagaatagatcaagctgaggactctcagagctcaaagaccggttcttcaaattaactgagtcaggcaaaaataagaaaaaaaaacttaaaaaatgaacaaaatctccaagaaatatggaattatgtatagagaccaaacctatgactctttggcatctctaaaagagagggagagagagcaagcaaatgggaaaacatatttgaggatatcatccatgaaaagtttcccaaccttgctagagaggtcaacattcaaattcaagaaattcaggtggcctctgcaatatactatacaagacaaccatccccgacacatagtgatcaaactcaccaaggtcaatgccaaagaataaatattaaaggcaactagagagaaggggcaggtcacctaaaaagggaacctcatcaggctaacagtgaacatttcagcagaaatcctacattctagaagagattggggacctatattgagcatccttcaagaaaagaaatccgggccgggcatggtggctcaagcctgtaatcccagcactttgggaggccgaggtgggcagatcacgaggtcaggagatcgagaccagcctggctaacacagtgaaaccccgtctctactaaaaaaatacaaaaaaattagctgggcatggtggcaggcgcctgtagtcccagctactcgggaggctgaggcaggagaatggtgtgaacccaggaggcagaggttgcagtgagccaagatcaggccactgcactccagcctgggcgacagagcaagactccgtctcaaaaaaaaaaaaaaaaagaaaagaaaagaaatccaactaagaatttcatatccagccaaactaagctttttaagcaaaggagaaataaaatccttcccagccaagcaaacgctaagggaatttgtgatcaacaggcctgccttacaaaaggtccttaatgtagtgctaaacatagaaagaaaagaccattactaaccaccaccaaaacacactcaagtgcatagaccatcaacactataaaccaaatacacaatcaagtctacctaacagccagctaacaacataatgacaggatcgaatctacacattatcaatattgaccttgaatataaatgggttaaacatccgcacttaaaaggcacagagtggaaagttagataaagaagcaagacccaactgtatgctgtattcaagatacccatcttacacaaaaggatatttataggctgaaagtaaggggatgagaaaggtctatcaggcaaatggaaaacaaaaaagggcagaggttgctgttcttatatcaggcaaaactgacattaaatgaacaatgatcaaaaaggacaaagaagggcattacataattataaaaagttcaattcaacaagaagatgtaactaaatatatatgcacccaacactgcagcatccagattgattaaacaagttcttagagacttacaaagagacttagataaccacttaataatagtgggatacttcaacaccccattgacaatagtggacagatcatcaagggacaatactaacaaggatattccagacctaaatttgatgcttgatcaaatggacctaacagacatctacagaacactgcacccaacaaaattagaatatacattcttttcatctgtacatggcacatactctaaaattgaccacttgctcagccataaggcaattgctaagaaatttttttaaaaagccgaaatcatatcaaccatactgttagaccacagtgcaataaaaatagaaatcaaaaccaagaagttctttcaaaccatacaattacatggaaattaagcagtatgctcctgaatgacttttgggtaaacaatgaaatgaaggcaggaatcaagacatttttgaagctaatgacaacaaagatacaacataccataatctctgggaccaagctaaagcagtgttaagaggaaagtttatagtgctaaacacccacatcaaaaggttagaaagatctcaaaataacaacctaacatcacacctagaggaactagaaaaataaaaacaaaccaatcccaaagctagaagaagacatggaataaccaaaatcagagctgagctgaatgaaatagagatgagaaaaaccacacacacaaaaaatcaatgaactaaaccttggttctttaaaagactaaataagattggtagactactagctaaactaataaagaaaaaaagatgataaagataaatgaaaaacgggacattaccactgactccacagaaatacaaaaatccctcagagattattacaacacctctccacatatgaactagaaaacctagaagaaatggataaattctcagacacatacaacatcccaacattgaacgaggaagaaattgaaatcatgaccagacaaataatgagttctgaaattgaatcagaaataaaaagtctaccaaccagaagatgccctagaccagactgattcacaggtgaattcttccagatgtataaataagagctggtgctgatcttactgaaaatatttcaaaaaattgaggagaagggactcctccttaacatattccatgagactagtatcattctgataccaaaagttggcagagaacagtgaaaaaaaaattcataccaatacccctgatgaacacagatgcaaaatctattaacaaaatgcaaacaaaccaaatccagcagcacatcaaaaagctaatccactatgctcaagtcaaatctattcctgcaatgcaagattggttcaacatatgcaagtcaataattgtgatttgtcacataaacaactaacaacaaaaaccacatgatcatctcaaaagatgcagaaaagcgttttgataaaattcaacatcacttcatgttaaaaaccttcaacaaactatgcatcaaaagtacatacctcaaaataataagagccatctctatgataaacccacagccaacatcatactaaatgggcaaaagctggaagcattcccattgagaaccagaacaagataaggatgcccactctcaccactcctatttaacataatactggaagtcctagccagagcgatcaggcaaaagaaagaaataaaaggcatccaaatgggaagtgagaaagtaaaactatctcccttcacagatgatatgataccatacctgcaaaaccccatagtctctgcccaaagcctcccagatatgataagcaatttcagcaaagtttcaggatacaaaatcaatgtgcaaaaatcagtagtgctttagacacccataatgtctaagctgagagccaaatctagaatgcaatcctgctcacaatctccacaaaaataaaatacctaggaagacagctaaaaagggaggcaaaaaatctctacaagaattaccaaacagtactgaaggaaatcaaagacacaaaaacatggaaaaacattccatgctcacagataggaaaaaatcaatgttgttaaaatgttcatactgcataaagcaatttacagattcaatactattcatatcaaactaccaatgatatttatcaaagaattataaaaatacattctaaaattcatttggaaccaaaaatgagctcaactagcaaaaccaattctactctgatttgtatgggtgtcgatctctgtgtttatcttccttgcagttcgttgatcctattagatgtatgtagacgaatgttttcaccgaatttgggaggatttcagccattatttaaattaaatagtttttctgctcattttcttctttctggtagttccattatgtatacgttagtgcacttaatggtggcccatctttctttgagtttcttttcatttttgtttatgtttttcactctgctctgcagattgcataatctctattaatctatttccaagttcactgattctttcttctggcaaatcaaatctactcttgagttgctcttgctcctcacccactgttggaacatacatatcttgaagaactccccatttcccaatggccctctgaggcatgctgccctcttctctcaaatatctgtaagtaataaaaactgcttcttatttcatatatcctttttttttgtgctgcctcttctgtgtctcacctgaccatcacacctgaatctaattctcctcctagttagagctttcctagagagtggctatcttggtaggaataaactggacacagatcagagaagagccacaagggcatcttccagtataaacatgtttcttatcagaaggacacctgatcatggtcaagtgggttggacacttaggcattaggctgtcctccaggataaagaggtatcccataaaaggtacattgtaaacatccaggacaacctcccctggagtcttgtcagcgcagagcaaggatttgtggccactctccagagagagaccccaagaccaaattttatatatatatgtgtgtgtgtgtgtgtgtgtgtgtgtgtatgtgtgtgtatatatatatacgtgtatatatatagcaattgatgcatcaagcagagtggtcatgaccatgagggatacaacaaaatgcctttagactgcttttggcctgttagctggccctctcacctggctaacaccatttgagaaggctccatggcttgctgatgtgtgtctgtgctgctgcatcctactgcttattgtctttattaagtaccgccaaaactcccctccctaaattgagtgcgtcctagaaagttggagttctctccaagaaccaacaatcacctgccttagtacagcaagagaggcaaccatgatcgctatcactctcctgaatgggaactactagtcacagttaagttgactgtattctgaaggccttgcccagattcgaatggcttattactgagaggttaaagggagtaacctgtgctaaggggctgtcaggaagatactgggccagtgtaagccttagcagatggcaagaggaagatatactctgactacccactgaattggtgaggcagtatctggggctagactttccagtatgacaagaggggtgcctacttcactggggagatgacagcatctcactggcagcagtggcactgtgatctacaatcgatatgtttctgtcttctcttccttctgtcactcttgatccccttaccctatgtgttaccctattggtttaaccccattgtgtgtgatgacaaagaacttaatgattcaaattaaaaggccagaacatttctttgccaactctcccatgatctctgaggaggttagcaaactattaaagaaatagggcttggggccttgccaagtgatcctgccactgttgcactagtggaggctgatccaaatccagatgatgttgatcgggatgccttggagagcaaggcagctacctacaacaggaccaatgaaaaccacaaatggaggccactggtcacaacaggagccacttggaaccaccaggagcttgttaggcaaacatccaaaaagagagagaaaagagaatgtttttagtcacctagaaatacaagccattctaaagattttacttaaaagaaaagaatggtggaggctcattgtcctgttgtgggaggttgtcccagggaaagggacctggagacaccaggtcccttcctcctccctgtattcctctaataaaccagatacagaaactatgaaccacagtgtcaggaggctaaaaacctaaaacaaaacaaaacacaataaggaaaaaatactgctgctttcagtggcttcaagttgaaggaaaaaaacaaagaggaacttcaactttaagaattgaggaaaatcagctctagcaagcaaaatactagccctagattacttatcgatttataaataaacccctaataaaaggggataaaagatacataataaattatatatacatatattttgatatcaatgtatgataaattgtgtatatgtgtatatatgatatgtaactaaaagcaaaattccacaccttgattcaattaaaaattcaaaatttatataacaaaaaggtttaggcaaggcatggtggcttacacctgtaatcccagcacattgggaggccaaggtgggaggattgaagccagcctgagcaacataagcaagatctcatctctacaaaaaatttaaaaattagctgggagtggtggcccgtgcctgtagtcccagctatttgggaggctgacacgggaggattgcttgagtccaggagtctgaggctgcagtgagttaggatcatgccactgcactccagcctgggtaacagagtgagaccctgtctaaaaaaaaaaatgtttaaaaagggtgctgattggtttttgtgcctctacaacatagattataacttaactttaacaactggtagaatggaccaaaattgaaaaaaatctatggatttaatcaatactagggctcaaattatacctgggcacctcaataaatttaaacattgtgccccctatattcttaaaatggtaactaaatataatagagaaaaatagatatgccttaatttgttgccttgcctaaatttctcatagtcatagtacccaatgctgtaacatataccatattggaattaaatgctctgacacaacaaataatgaattaaagtcaaagcaaatctttggctgttaaaaactggcttgatggaatgggattccatgaacacccagttaaaagacttcatatggcccaatgtaagctaaaatgagggctgcaaagcttaaaacttattacatgaaacccaactaataaagaagtgattattctcaatgcttctccatttagcagaccattttgacatttgattgctcttaaatctgaaataaataaatttaaaaaggggttctcaagatggcttactaccaccttaatgatgtggtcccaatcatcaaggctccctacccaatatgtgaaattattaatattaatgattctattctgtcaacaatcagtaaatattttgttcttatagattggctaatatgttctgtttaatgcctgtttcaacagtctctcagctgcagtttgcttccacctccgaaagggacacaatacaccttttctaggttactgatggggtaccacaatagctttttttttttttttttttgagacagggtctcactctgttgcccaggctggagtgtgatggtgcgatctcagctcactgcaacctccgcttcctgcgttgaagcgattctcatgtctcagcctctgagtagccgggattacaggtgtgtgccaccacacccagctaatttttgtatttttagtagagatggggtttcaccatgttggccaggctggtctcgaacccctgacctcagatgatccacccgtcttggcctcccaaaatgctgggattacaggcgtgagccaccgcgcccagcccacaatagcttttttatcacatgcaatctttggagataagaccctgatggcatgtatctttctccaggaataaaggtctgatattacatgaatgacatcctctttcaaggagattcatgtgacacactcactaagtacatataagtccagtatgttttttacttataaattaaaattgaccatcactcctattagtgctttcaaaaaacctcattcacgacaactttttcacgccttctggagtctgtggatcactcctgatggccattagttgctccagggcttctaatgcaacatattgcccctcttggccttgtgctatgcaccattaaaacaacaaatacctgcctacatactgggcacatttggaaatagaagatctcatagaccttgagcctgtgaccctccatacccagctgctcattatgctttgggtcatggaagcagcacgccacaagctcagcctggctatgaaggaagacctcgttaaaacagggtggagccaaacttgggtggagcccatcttaggatagggcccaagaaacaacacacttagccaaacctcaggcagtcatcttagcattggatgccctgatcaacaaatggtcctgaccaggaatagctcacacctgtaatccaagtgctttgggggacagaggtgaaaggatcacttgaggccaagaattcaagagaagtctgggcaacatagtgagaccctgtctctacaaaaataataaaaataaaaaaaattagccaggcatggtgctgcataccagtagtcctagctactcaggagactgagacagagatcacttgagcccaggagttcgaggttacaatgagctatgatcatgccattgtactccagcctgggcaacagagggagactctgtctcaaaaaaaaaaaaaattaaaaacagaattactatatgatccagtaattccacttctcagtatatattccaaggaagtgaaggcagggactcaagcagatatttgcacacccatgttcatagcagcattattcacaatacacaaaagatggtggcaacccagtgtacattaattgattaataaataaacaagatgttgtatataaatacaatggaatattattcagccttaaagagggagaaaattttgacacatggatgaaacttgaggacattaggctaagtgaaatatatcaataataaaaagataaatactgtatacagttatatgaggtacctagagtaaattcatagaaacaaaaagtagaggggtggtttctagaggctgaaaggagggagaaatgggagtcttgtttaatgagtatagtgtttcaattttgcaaaagattggttgtaccacaatgaaaatgtacttacaactactgaactggaaacttaaaaatggttttaagatagtaagttttatattatgtatattttaccacaatttaaaaaacctaattaataaagaggtgattatctccactgcttcttgatttgatagccaaattttcttgttcttaacaagaaaattaaaaatatatttatttggcatagatacatagatacaaaaatacacctgatggcatctcaggatggattattacaacctgtggtctcatccattaaggcccccatacgaaatacccaatattacgaaaattactgactctatccaatcaacaactgataaatattttgctattacgtatttggctaatatgttctgttcagtgcctatttcaacagcatctcaccacagtttgccttcatctccaaaggaacacaatactcttcttcaggctacccatggggtacctaaacagctttgccattgcacacaatctttgcagatgagagcctaactactttcaccttttaccaggatcacaggtataacatcatcctccaaggagattcatttgatacattcatttagaatctacaagtccaacatcttttaatcctttttgagttctgatggcaacgcattcctcatttacaaatagaaataggctgctccacaagggaagtgtctgagttagttttgtaggatctttctacagggaagggttacatcagggcatgtataggagaggtttttctagtgtttgtgcagtggctcaacatgcttcttcatacattgtatgtagcattagcattttaaatcacccttgggcatgatttttcgcattaaaaatgaggaagagttaactataggttggaatttaagtatatctgcacatgcaggtactccagggaagtctctagccccctgaaacagaaacttgcgataattatttcttgggtcttttgttactgactggttgagggtcacataagctagatcttgagtgagaggtttttatcctttttctccagaccatattaaaacaggaaaccaaccagcctgcctgtctcaagaaggaaggtaccaggctctttttaacaacgagctctggtgggaaataatcgaacaagaacttactcacacccaagggagataacccacacaccacccactaagcctcacctctaacattgaggatcaaatttcaccatgcgattaggatgggacaaacttccgaactatagcagtctcatatataatgtgtttttaagtacatggaggttacatatatacgaaatctaggagaggttactactatctgtacctctctaaaaattaatggagatcattattttccccagaaggacctgtcacgtatcagtcaactccttgactccctagagaggggaccactcactctactgtgccctctccttctccacctccagcgttacatcctgcccttcttctccaatcactaccacagcaatcaccctttccccttggtcacacaaaaataccactaatatctacatatactttactaacttatcagttcgtaacctgcctgcagcaacataactgtttgactcttcactttgactcaagaaatacaccaagatattactgtttatatatacgtatatatgtgtgtgtgtatctatatctgtcatacacacatttatatgtgtatatgtgatatatatccacatacgtatgtatatataaatatatatatatcatacatatatataaactttaacacactttacaactccaacaagatattgttagagatctcagaaatttcagatctactttttttggttaatgccatataaatgagaaacttaatcatggtccagcctataaagactcttatatttaatacttctacttgcattcctttcttttgattcccattataaaatgttttctaggccatttgggaaaacatatgtcctaatgtatagtctctatcatcatcccaatatgtttttaatatgatatcaaagtatcacagggccaattgtattcaattgtattaaccatgtctttaattttctatattctgatgctttgacatcttgaggcagtgctgaccttggaaggattgctcctcccaggattagccaatttctagagacagtaaacaactggattatgaaagtgtctttcatatgcaaaccaaccactccagagtccatatcctccatcacctcctttattggcttctcaggcacaggaccactatttacctgcccaaatcacccccgggtcgggtatcagacaactaggaaaagcccctaagctgtagagcctgctaaaattattcaaactagctaattctaaacctgcttactttaacttgcctattccttccctcagaaaccacaataaaggctctcgcccacattcttccctcaccctctgcctcctgactgacactggtgctttcctgggtgaaccctgacggtgtggcatgcctcttcttgtgatctgtgagtataacagtcttttcaatggcagagatttcctgatttgttggtcttacctacttaaataataataaaagccatattttaaaacactaccccaaacagacaaaagctctgtggggtaatttatttgggaactgatcccaagagtagaaatgaagtatataggagtattttaaaaaggaaggaaagccagtacaaggaataattccaaattttagttaccatgcaactgataacaggtatatgatcttggggaccttctgagttgcattatgaaatatatctcagaactgtctagttgaaggacataagagggaaggatttagccaacacctcccattcccttattagtcaagataatcccatgtaacctaattctgccacacatcctatttgcacatgtctgactgcccactggtctgtaatttgcccagtgatttggcatcagagaagcccctgtgcaagaagcaagatatacactgcactgggccagtgcaaggccttgtcagattatgcttgcatagaactggtcaccacagcagtgactcgattaagagaagacatgatttgacatgcacacaagctgtacccaaagcaccttacaggtacttgttttgcattttgttaatatatctcttaagcctctttaactctctaagttccccctcgttctcttattttttttattctttgcaaattatttgttgaagaaatatagtcaattattgtttagacttttccagagtctggattttgctgattgagtttcaatgatgtcatttaacatgttcccctggctctatgtttcttacaaaatataagctaggcagggtgacacacacctgtagtccaagctactcaggatgcaaaggcaaaaaaatttctttagaccaggagttcaaggctgcagtatgctatgatcacacctgtgaacagtcactgtgctccagcctgggaaacacaatgagaccccacccataaaaaaaatttaaaagtacagatgctttgtttaacttgaggtacagtttgtataggaggtcaaaataaatgcttctctctttacctttttgaaaatcagctttccaaacaattgttctctatcatcttccaaaggacatttattaatttgcgagggctgtcataacaaagtaccacagactgggtagctttaaacaacagaaatttattttctcacagttatggaggctagaaggctgaagtcaagttgtcagcagagttagttcctcctgaggggccaccagggaagaattttcaggtttagagatggccatcttcaccctgtgccttcacactgtcttcactctgttcctcaaaactctaccagcacctacatattactcaattcaaaaggcacttctatatttttaaagcagcaccccacatttcagcaccaaaatcttatataaatgtcatctaaatcagatatgagtgacttgaggtatgattcaacctgaggcaaaattcctctccatctgaaaacctgtaaaaccagacaggttatctgctttaaaaatacaatagtagaacagacataggatagaaattcctatttcaaggagaaaaaatgagaaaaaaaaggatcatggattgcaagtaaattcaaatcagaacagggaaaattccattagattttaaggctcaagaataaatttctttggctcagtgttctgtcctctgagcccacccaggtggtggccaagccttctcagctctggaaagcagccctactcacctcagccctagaaaacagacccacaccctctggcactcacaagcagatgcctggctagatgaaatctggaggatatagccacattccctaggcctatgcctctgggcccaagggagaagtaagccctgctgacctctgatctacctttgggttattcttctcttttcttgaaggataagacatgtttacagctggatagcgctattggcccattttgtagaattccagaagtccaacagccttccttcattttatcccgtctctgtccccttcagtccaagctagcagcatttctgctggtacaaaattctcaaaacccttttgggcctcctgtgcaattcaaagggggtacaaaatcagatgagagtcgttgacatatatttcctagacaactgcctgtctattcctggattctgctgagctgttcattggatctatgaattgcacatgtaatatctttagtaaattgttttccagccatatccttgatgttctctccagaacacattttctaagttttgcaatatgaataggatgagaatttcccaaatcttcaagtctggttcctttttacttaacaattcattcctcaaattaattctcttctctcacattttactataaagcagcaaaaagaagccaggtcaggtctttgacacttggcttagaaatctcctcagctaaatatccattcatcacttacaaattctactttccaccaaacactagaacacaatttgtccaagttctttgctactttataacaagaataacctttcctcccgtttccaataacatgttcctcatttctgtttgagaccgcaccagaagaaccttaaacattcatatttttaccatatgatgttcatgatgatatatatattccataagatgacagaagctttctgtctttacagctcttctcttttctttctgagccttcaccaaaatcattttaatgttcatatttctaccaatagtcacttcaaaggaatcaaggcttctactaacatgcttctcattttattttaattaccttttcaaaaatcctaactttaattattgtcacattcaggttttgagggttaggacttcaacatttggactcttttttggagacagagtttcagtatgttgctcaggctagtgtgtagtggctattcacaggcatgattataactcactacagccttgaacctctggactttatcctcctgcttcagccttttgagtagctgggactataggcatgtaccactgagccaaacttcaacatgtgaatgtttttgggagacacaattcaaccaacaggaacattactttttttgcaaatatcaatatgaaatctctgtgtgagacatattttatgcttacagttcattgcagttatgatttttattgatgctcagattgtcccatatttggcctgtgagattttcatcaaattgacttctgagtctctttgacatgacccaatggtctttgatatatatatatatatattttttttttgagatggagtcttaactctgtcgccaggctggagtgcagtggtgcaatctcagctcactacaacctccgcctcctgagttcaagcgattctcctgccccagcctcccgagtagctaggattacaggtacttgccaccatgcccggctaatttttgtacttttagtagagatggggtttctccatgttggccaggctggtctcgaactcctgacctcaagtgatctgcctgccttggcctcccagagtgctgggattacaggcatgagccaccacgccccgcctgacactttccttgtattataaaaaaaaaaaaaacttgtggggggagatttcctttccttttctccgaaaggggaagaaattgaaactgagtggcccatgatggaaagaggggaagtccaggggtgcagaaggcccctgggtgaaggcagaggctaacatggggttcgtagctatgggtggccatcagcctgaccaactttgtgctgtctgtcatcactatcatcatctgcttcacctgctcctgctgctgcctgtacaagatgtgccgccgaacacgtccggttgtcaccagcatcacgttcaccactgtggtgcacgccccttacactcagcctccaagtgtgccgcccagctaccctggatcgagctaccagggctactaccccatgctcccccagccagggatgacagcagcaccctacccaacacagtacccaccaccttactcggcccagcccatgggcccgccggcctaccaggagacgctggctggaggagcaaccgcgccataccccacgagccagcctccttacaacccggcctacatatatgccccgaaggcggctcccggagcgtgccccggcctctccggctgccactagattatgttgtgtgtgtgtgtgagtggtgtgcaagcacggttccttacgccccgtgcgtgctgtgtgtgtcctgcctgtatatgtggcttcctttgatgctgacgaggtggggaacgttccttgccagagtgggctgggaccagactttcttctcttcctcacctgaaattatgcttcctaaaatctcaagccaaactcaaagaatggggtggggagcaccctgtgaggtggcccctgagaggtggggggctctccatggcacatctggagttcttttccagcttaccctagggtgaccaagtgtggcctgtcacaccaggatggtgcagctttctgtgagtatgatacagatgtgtcctggttttggcaacgtagccagctgctgctcaggggcatggtttgtccccagagttgggggtaccctttgcagagccagagacatgatgcaggtgaagcttgggatctgaccaagttgggctttgatcctttgggcagatgtcccattgcttcctggagcctgtgtcatgccgactggggatcaggcagcctcctgatgccagaacacctcaggcagagccctgcttacctgatagctgtctacctggactgttcctgtccctacatcctccctaggaccacctggagggccacacacacagcctagctacccacagggagctctcctgcccttgctggccctgcccttcccacaggtgaacagggcgctctgtccaccagcacactcaggtctcttccctgcagtgttttcattttattttaaccaaacattttgcctgttttctgttttaaaatgtgatagttgatgtgagactgaaacccctgggttgtggagggaaattggccaggagaagagggaaaacctggcaactgtgagtccctgcttcccctgacaccagcctcatggaatatgcaactcctgtaccccagtccagtgtgttctggcagcagggacacctgggccaaggggccatctggaccaaaggtggggtgtggggtcctggatggcagacatgaatacctcggtattccctgtctctcagttattgtttcaccagagctgtctcagcttcgtatctgttgtgtttctgagagtctagagtctgcacccttgtttataataaatgcaatagtttggaaaaaaattgtgggcacatagtagaggtatgtatttattgggtacatgagatgtgatacaggcatacaatgtgaaataagcacataatgaagaatgaaatatccatcccctcaagcatttatcctttgagttacaaacaatccaatcacactctttaagttgttttaaaatgtacaattaagttattattgactatagtcaccctgttgtgctatcaaatagtagttcttattcattctttctgattattacttgtacccatagaacatccccactgcccccacatgcccccactacccttcccagcctctgataaccattcctctactctttatctccatgagttcaattgttttgatttttagatcccacaagtaaatgagaacatgaaatgtttgtttttctgtgcctggcttatttcacttaatgtaatgatctacagttccatccatgttgttgcaaatgactggatctcattcttttttatggctgaatagtactccattgtgtatatgtaccacacgttctttacccattcatctgttgatgaacacttacgttgcttccaaatcttagctcttgtaaacactgctgcaacaaacataggcacacagatatctctttgatatactgattttctttcttttgggtatataccaagcactgggatttctggatcatatagtagttcaatattttttgtcttcttaggaacctgaaaactgttctccatagaggttgtactaatttacattcccaccaaacagtgtacacatcctagccagcatttgttattacttgacttttgcatataagccattttaactgggtgagatgatctcattgtagttttgatttgcatttctctaatgatcaatgatgttgagcacattttcatatgcctctttgcaatacgtatgtcttctcttgagaaatgcctattcaaatattttgcccatttttgactggaattactagattttctccagtagagttctttgagctccttataaatcctggttatgaatcccttgtcagatgggtagtttgcaaatattttctcccattctttggggtgtctattcacttggttgatagtatcttttgctgtgtagaagcttttaaacttgacgtaatcccatttgtccatttttgctttggttgcttgtgcttgtggagtaaagactgtgttttcccgagtgcatattcttggcacctttgtcacaaatgggttcactgtttgtgtgtggatttgtttctgggttgtctgtactgttccattggtctgtgtgtctgcttttatgccagtaccatgctgttttggttacaacagctctgtagtattatttaaagtcaggtaatgtgattcctccagttttgttctttttgcttaggatagctttggctattctgggtctttgtggttctgtatacattttaggatcatatttctgtgaagaatgtcattggtatttttatagggattgcactgaatctgtagattgctttgggtagtatggacattttaacaatattgattcttccaatccatgaacatggaatattttttcatttttggtgatctcatcaatttcattcatcagtgttttatagttttcattatagagatatttaacttctttggttaattcctaggtatttaattttatgtgtggctattgtaaatgagattactttttaatatctttttcagattgttcactgttggcatatagaaacactactgatgcctcagagatgaccatgatggtgttctggtgtcaggagaatagcaatgcctgggagtccaccaccaccataatctcctgtgatcccacggagctgcagtcagaagggagcaatgacaagaaataagtgctgagcagttgtcatatggtgctggaagacatgctacttttccctgagggcggaagacagcctgatgacggtggtacaatcaatgacatctctgtgctgggagtgacctgcttgggggcccaggctgatcatttcacacagacacccctggatcctggaagccaagtcctggtctgggtagactgggagtggaggtttgaccacatgcagcagcattaaaggcagcatctcatcacagcagttgctgattatctgtttgagttaaagacaacatcatgggagttagggaaatttcggagtgtgatgctggaaagcccctctgtgaatgcagagaaaataaccgccactgaaaagagtgtcaataaaaatatcagagatcagctgctcaacaaagtatgagaactgagcctgaatgatcctgaggcggagcaggtgagaggctggggcctgccagatgatcatgctgggcccattggaattgttaccatcaagggtgttgattccaacatgtgctgtgggatccccatgagcaatctccgtgactttccagtcattaagattaggcaccgagaagaggaaaaggaataaaatcaaactgatatttctggctgggaaccagatgctgaaatggatgaagagaagtcatgaaactgaaagagcactgaatcactctgcttaagtgtggagcagaggatcacatggaagcagtgaaaaagctccagaatgtagccaggcatggtggctactgcctgtaatcccagcactttgggaggccgaggcgggcagatcacgaggtcaggagatcgagaccatcctggctaacacggtgaaaccccgtctctactaaaaatataaaaaattagctgggcgtgtggcgggcgcctgtagtcctagctacttgggaggctgaggcaggagaatggcgtgaacccaggaggtggaacttgcagtgagctgagatcacgccactgcactccagcctgggcgacagagcgagactctgtctctaaataaataaataaataaataaataaataaataaataaataa

SEQ ID NO: 452 - DNA, 306671 bp, Homo sapiens
  source 1..306671: mol_type = genomic DNA
agagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggagaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggtttgtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcaggggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtgttctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctggggggcagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgataacattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgcttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccagtaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgcacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtttgaactttccgtgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgcctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaagctatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcctcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctggaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccatttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaaacaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatctcccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcgagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccactcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatcttccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgagccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaaataagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaagctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgctttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtaactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttagtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccatagttgaaaaagaacgcctcccccatcaaaaattttatctggtctaaaatgtatgaagtaaaagcagcttagtctaagtagagagaggcttaaattggaaagttttggaaaattaatcctgtcagaaactgtaattatccccatttcatagatgagatagctaaagtccaagtgctttttcatacagcagtttcaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgatcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaactcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctactaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagacttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggcttcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttctttctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggaaaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaagaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaaagcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaacaggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcgactccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaaaaaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacataaatgattcattaacacgtattttatatgctatatctattatatactgtattcttacaataaagtgagctagagaaaagaaaatgtcattaagaaaatcataaagaagagaaaatatatttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcattttcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaattgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctggctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagagaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatctggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggatgtccacacagaaaccccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacaatattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaaaagcaggggttgcagtcctagtctctgataaaacaaactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaactctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcagtgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcaggccaatatccctgatgaacatcgatgcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacaagcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacagaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagcattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgatcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacaagtgggagttgaacaatgagaacacatggacacagaaaggggaacatcacacgctggggcctttcagggtctggggcactaggggagggatagcattaggagaaatacataatgtagatgatgagttgatgagtgcagcaaatcaccatggcacgtgtatacctatgtaacaaacctgcacgttctgctcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttagaagttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttattgcacatttgagcccccagaatcagagtcgtgcttcacactacctatcataacaaatggcatggaggggttctttatgttacaggttactgagttggatatttaaatagcacattcggaagtgttctgagttatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataaataagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacgatattgattcttcctatccatgagtatggaatgtttttccatttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctttggggctgagactatggaattttctagatataggatcatgtcatctgccaacagggatagtttgacttcctctcttcctatttggatgccctttatttatttctcttgcctgattgccctggccagaacttccaatactatgctgaataggagtggtgagagaaggcatccttgtcttgtgctgattttcaagggggaatgcttctcactttttcccattcagtatgacattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgatggattagtttttggatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcgtgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacacttagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagatctcttctgtatgaccttgagtcagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaaaaatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttacttatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttaggaaaaaaaaaatgatttcaaaaggagcgggtgatatcagggatttagtaaaagtgacagtctccttgggctgctccagggtcagtacacatttagccagttgcctccattttaacttctacagtcctgggtaatgaatacctatgttcagaaagatgaccctgagacattgtaatatccttgggcaccaaaaaagattctgcaatattcagttggttatatttatcaaggaagaaaagtgggcttacatattttatagaaactttcaatggcatttcaataacaacaacaataacaacaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagagtttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaaccctgtctctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcagaatagctggtactaattagagcgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacattagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactgggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttattcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggtacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccaggcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttcttcctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagatctctagggcaagggcaaaatgccaccagtctctttgctaaaacataacaagagtcacctttgctccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgcttccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagaatcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacacccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcgtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatgagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcgaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagagaacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcatagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtgggtttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgatactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacgaatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttggtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttttaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagctgagatcgtgccactgcactccagcctgggtgacggagcaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctctcacacacacacacacacacacacacacacacacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctcaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatatctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccattttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccattaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtcaaagatcagatggttgtagatgtgtggtgttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatggggatggcattgaatctataaattaccttgggcaatatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaataccgcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaatgtgcaggtttgttacatatgtatacatgtgccatgttggtgtgctgcacccattaactcgtcatttagcattaggtatatctcctactgctatccctccccctccccccaccccacaacaggccccggtgtgtgatgttccccttcctgtgtccatgtgttctcattgttcaattcccacctatgagtgagaatatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcactgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctaggttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctttaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctaccatgaaatacacaatacattgttgttaactataattaccctactctgctattgaacaagagaacttttcccttctatctaactgtatgtttatactcattaaccagcctctcttcatcctgccccctctctcacccttcccagcccctactaactatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtacatgtgcaggtttgttatataggtaaacttgtatcacaggagtttgttttgtaaattattttgtcacccaggtactaagcctaggacccaatagttattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggccaacatggtgaaaccccgtctctactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgtgtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagcaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatggtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaccacgcccggctaatttttttgtatttttagtagagacgaagtttcaccatgttagccaggatggtctcgatctcctgacctcgtgatcctcctgccttggcctcccaaagtgctgggattacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatgtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttctacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccatggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacatcatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtaaagaccacaatgggttattggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctctatggcttagctctcttgtctgttacctgtctgtagctgagtgtgggttaaataagagggaaagctcatccctgtcactgtagtagctggcaaatgtgtaaccctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattatataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaatgagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttccgttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccacggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacaaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgatatcttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagctccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgctcttatatgtaatttaatcctcacaacacgcctctggggaaggtgtcattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacatcagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaatatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtcttttgtgatttcagaagtacttcaaactaggaatggccttctttgggaatctgttcttttgatgaatgttcctgggaatcagacaacaaaaagtcctgctttatccatctggccacgtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaacgtgcaggtttgttacataggtatacatgtgccatgttggtttgctgcaccaatcaacacgtcatttacgttaggcatttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggcttccagcttcatccatgtccctgcaaaggacatgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgaccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcttccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcatttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgttggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggatcacctgaggtcaggatttcaagaccagcctggccaacatggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagagcaaaactcagtctcaaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcatgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctcaattgtataacagcaatcactgtgatgtttctagaactattaacagatttagaaatttctgataataacacagttgttactctaagatttgtggttgccttgactacaaacaccagcagtatactttatttctgtttaatggccacagttggaatgcaaactcttcagaaagcccagaatgtgagcatgcattatacactctgacttttctcaaaattgaagcaattcaagaaattatgagaccacattttaaagtagaatttaagtattagagcaggagaaaatgtcagacataaattagcccaactgcttccatttactgggggcagagggacaacaaccaccttccctcagctcccactgtgtataggcactttacctccattatcaggtggattttaatcctcaaaacaccactgcagcgtgggcattatacttatttttaagttgaagaaggtgatagtcagattaaataatttgcccagccacacagctaatggcagagcctgagtacaaaccaagctccaattccaaaacatgctctttccacttcatgctgctttttccaatatcacagacaagggaacagcacccgaaggatgatgtgatgaaatccaaggtcatggaggttttcagaggcaacagtatgattatttccactactgcacactgcctcctactaccaacctgaagttgcactgtttgttccattcctctcctcatgctcaggcataagagctgttttccattctttcaacctctaaagaaactctaccttttttctggtttgcaatgaaagaaggcagtgagcatttaaaatattatcgagagtgtgtatgctcaaagtaagagactgggaaatcagaaacaagacatcatgagaaaaactgatggcatcattacatttccaccaaattattcacagctacctagaagcttaaagagtctatgtcaatattaggtttgaactaccataattgttcagagtgaataagtttgttctacatgaagctggaggctgagctaactctagagaaggtaatcaatataataacctgaggttttgtccacatacaaactgatttattaggaggagtcggtggaaggtacgaggagattcaattcaacctttttccccctgagtggggaaggagaagacaggcaatgggtacaggcagatggaagaagcatagtggttaagcacgtgggcactggagttagcctcactagattcacaatctgcttagcagttgtgtaacctggggcaaatcactaaaccttgctaagcctcagttcttcatctgtgaaataaaaagcacagtgcctagcatgtaagttctcaataaataatagctattgtcattattaaattggctgcacataatcatgctagtttcacaaatactaacagctaatataacatttgcattttagttcctaaaactccttgggaatacagttgaaataccagttagtatcaaagagctgacctctgatgagaaataaccagcaacactccttcttgaacttgcttttgttaaagattacaactcttgcaaatatttttattgtattattctactatgtcttactgatattggctggaagttgtaactttatttttaatacgaaatttatttcctttgtaaaacttggatagaaccactaagcagtccagagtccaagtccttccagacaaatgctccccctgctgactttctgtgcagctgcagggacatctgagggctagacaaattgaagacatgagagttgggggaattattacagagaaaatggaaagaacagatgaacttgaacctgattactgtgtatagatgtttccaaaggtgttactctcctgttaagttttcaagatatgaagtactttgttgaagagggcagggggtctgtccagattagttgacacgtagatcctcctttaaaatgtaaagtatgtgcagaataataaaagacatgaagggtataaaataaatgagatcaaagacaataggatttttggctatattttaagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttggaagaaagaagagaaaaaaaggaatgataaagagtttgtacaatagagaagcagttttcagtcccagctcttcatcttgtaaagctagtaaagtgaagattataaaatttacttacaagatgaaggttatagcacatagctcacttttattatcatttcaaaggtcataaaatatattttattattaactcagaaaatctagttctttattattacagataacaagagcattgtatattatttgatgtacgtattttgcagtgctttttatatgtctgttttcctcttgttgctaatttactttcattaacttcacgcctcctcttacatttcctcaaaaggtatgatacgcttcttataatgcacttttataaacactaaatgtgcagcattttacagccatttcattacgctaaccttgaaatctgtcttgtgcaacaaaactatttgaaatgaatgttaaacattttgtagctgcattaatggagggaaagatactggaaaatgacaggtctttttaactcaactataaagtcttgtcttattttaatagatcctttataaaatgtgatgggattgacccatcagtcactttttatataacctccatgtgaaatgtgagtttaagtggctatagtttccctaatgagaaaaggtaaatgtaaaaatgcctatggagcttcttccctgtaggttccactgcactttttctcagtgaaaggattgaggcgcttatgctaaacaagggaataaagtggtggaaattccatcaaatcttttgtctaagctactactgttttgaggcgagaatgttgaatgcaagcttgtgcattccacactgattccactgaagctccttttctatctctgctgaggtatgcaggtactgttatagcatttttatgtgggtaatcacccaaattctccatgatcataggtatatcatgacattaaccacaaaattgccaaagtcaataaccatgtagacaagaggccatgaaaatgaccattttgcatttagatttattttcagtcatgtcaacaaccaacagctgagtcattcagatcaaccacatgatgatctgagtcagtactaaagtggccaaaataaccagattatgatgtgcaggcttgattttagatcagactgacacagccacagtccattagcctcaatacaatggcacagtgtaatttccataaattactgtatttttctccacattgtcaagtagacaatgcataaactaccattagtattcacagcagcaaaatatacctctttccatatcaaactgtgattctggaattactccaaagtcagttttctccttggtctggcaaaacctcatcattccaaataaaaatgacagtcacagttctgtcccaaatgaacaacagataataaacaataattatacaaatatgtttggttttcatgccactatatttctcagtgtttggagaaaatttgtaccttctataacttgcacaccattttggattttcttatacaaaatacgggtattttatactacaaaaatgtgggtatttctctcctagtgtataagtttaaatgttttattttctattctgcctctctgtgcctcagtttctttatctgtaaaatacctctgtttgcttatctttaaaatagtacctaaccatagggatagagaattaaaatagttggcacaggtaaagcaattagaacagagtctggcacacaagaagtgctcaataagtattagctataattgttatcatttttcttcctctattactatggatgtttctttggaatgttaatcttttatatagcaaaattatttctagagtcagatcagttcagaataaattaaatgtatgtggcaacaatgaagaaagactctgaaaggtctaaatgcataatcaaaacaccctgtatacttttagcattcagaagtgtgccacattcttttctgactcatccagatgtttttacttctgattaaaagagaaatgttcccagatgaaatcctgagatagtgtaactgttagaaaaatctactgcaaagcagattttcaaattcaaaaagctaaaagtgatcatgttcaggaaataaatacgggttgtctcaggaatccagggacgaacaggaactacagatttaaaaaaaatcaagtcagtttgttatagttaaccaataataaatatttatcaaaatacctgccaaaattattcagagtgtagcatctaaaacaactgagttttccagaggccagaaaaaggttaccttgggacacaggaatttaaatttgctttaaagtggtgaaatgctggtacagacagagaagagcttgatttgccggctctcagcccagaactaccctcttcccacagagcctggagatatgccaggctcctacgcctattcttgactttatgacagagtgggttctcttcctgtgagtttttctgggcatgggagaacatagcgtaactaggatggagctctgccacacagcagaattatcctaaggatgatgtggcaatgttttataaaacctagggagcagattttcatttctgcagacagagccagccttcagcaacactgtgaaggagatgaagtttcctgagtacaagccattacccatcactgagcattcaattccctcacactgtccaataacttcttatggtccctgtctctgaggaacactcatgatgcaggaccaaacttgcaaccctgtctgcaccttgagagttttataaagtgctgctgcttagtcccaacccccagggttatgatttaattggtcttgaagcctaggcaaggttttttgtctttttgtgttgacgtgttttgactgaagctccctagatgatattgatatgcaggcagaactgagaatcactgatgtagaagaacaatgtttctcagtttggtctgcagaccacttgcagcagaatcacctgtgatgcttaagaagtgcagattcttgggcattcagctattctgaatctgcattttaacaaacacctcaggtaatgctgatgcacagtaacatttaagaacaaaaatttccccttattaaaacttacccatcttctttcccattccctactaactgaataaacagtgggtgctgttgaagtaatgtgttacattttgatcaagcctcctgaaaacaacacagagcgtgattccaatagaatttctccatcagaccaggaggatgattttgttttcgttttctgtgtgtgggggtggaagggggtgtggaggaagcaagccttttgatgcctctaatcccactatacaggtagtttcctacttcacttggagtctgccctgagtggttaaggcttagttgtcaaaggagaaagtttctaatctcctgggccccaaaagctatttatatgaagatgatgagaaatattatcatctagctccttgccttatggatgaccaactccacaaaatagcaatgtctttgttaaatttattaaactcaaagtgaatagtgctcattttccagcacctacccatttatcttcaagtgagaagaggtttttgactatgtttctctcatgacattaccttgtagcagtggttttcaaccttggttgcactttgtaatcacctggtgagctttaaaaaatttaaatgtctgtgtcctacctcccaagttctgatttaattggtgggcctgggcatgagtttttttttaagatcctaggtgattttaatgtggagccaaggctgaaaaccatttgcttctacaggtgtgcccagcaaacttcacaggaagagaactcaataagttaaattattacctgtggaagcaggagatggtaaaaaaaatatatattttttcctgtaattaaaaggaaaaatcctgctaggagtgcacttgtagtcccagctattcaggaggctgaagctggaagatagctagagcccaggagttcaagtccagtctgggcaacatagagagacctgacctcattttttaaaaagaaaatcctgctttgaaacgtgtataggcctgacaagtattatgcatgcaccatcatagtatgccatcatgacatggggtattgttgttaacatgtgacctttgtttaatgttttaattccctcacatcatctatttccctccttcatcagctatactgaaaccactcctctttccagaaataaagaaaaggatttcttaaacttagatctggcccctctgggtctggatttgtttttgttttgttttatagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctactccattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacatattctattttaaatgttagttgtctattgagatgtattacaattgtatcaagtatttgtgtacatggtgataatttcattttcaggacagctgataattgttttaatttcttgggtagacgtattccctcagctcctcataggcaaaatcttattgaggaaacagtaaattgttcattagcaaaagttaataaagctatgtaaagtctgtcaagaggaaagatgaaaggagattgaagcaggaaatgatagaaggataatatgagggacaaaccactttcacataaaccatcaagatctttattctgtggtaactggactattaaggaagaatactagtagagtttttaagaactaaaatgttttttcagttaccccaacaagaaaaatatgctaatttagattagaaaatggacacattctataatattactactgcctgctactgtaaccacagtaactagttgtagcaatgatccagaagccacttgggtagtaggtggagtagttagtcactctctccaaccaataatcaagttattggatgacagatataattgctgatttttcctcaaaggcccagagtaaacagatggtggttctaaacctcctttttaaataatcaataagaaatacatttctacatgtattatcatgagatttgtccaattacttcacagtaaaccaggaagagtacatttcttgacattacagcaattaactacaaacagttttcactccctgaaagagaatgtattagtcctgggaccctttcaagaattctcattgattcaagatatccatatctcacctataccacctgtttactgaccagatcataatccccaactgggaggaggggtccaatgttggtccaatgaagaccctctggaactaatctggccttgaccctcactactatggcagtcccagaagcttatttagaaacaattttctgcccccatgaaatcactcacatttatcggggctagaagccagggatttccatctgatgagtagtcaacacataaccagctccatggaaatctggtttgatatcaaccttcaacagagcttatgataaccatcccaataggcatgaagtttctatatgaagtaattaaccacttaggatatcaagacaccagaagcttctatatgaagtaattaaccacttaggatatcaagacaccagacttgaaccctcagataagagatacttgttccactggaaagcatttttctttcaaaaacaattagaggttagaaagttgtgctttaaatggtaatcaataaacggcatcaattcccattaggctttcaaaggccattcatccatattgcaggcaaaaggaggctctctggaaagatgaagagatttattagcccagaggcagaaagtgtgaccaaatattcattgccctcatgcccagaccccatctcccacttattctgtgtctttctcaaaaactaggaaagcatctactaaatcattcaatcatgatttcattaaagggcatcatattaccagagctgatttgaatcaacatttaattctgagcaaagctattgccacattctgattggtttgtggtttctaatgctcatcaattcctagccaatgagtaattcatatggaaattgagctgttttgaaaatctgattacacagggagctggatatttctaagtataaggaagtacaaatcattttctagttctggcatgccactttttctgtttccccaaatggtcactggtggcatcattaaggacttggtggggtggttcttcagggcagcacacgaatgttgattatctaaaagtggaactataaaagcagcatagaaaaaccaactcctttaacctgcttatactgaaaatgttatctagacccaacaaagactatctttgatattcgtgcaatacagggttgtggggccggcagccaattggtctccaagccatttaaatccaatggggcaaagaaggcagccagcaagagcacatcatcctttatttagggacttgactgccacagtcatgtcacttccccttcattcttcagtgatgtcaagtcataaaggcaattttaaaaactaactcctggccaggtgtagtggctcacacctgtagtcccagcactttgggaggccgaggcaggcagatcacgagctcaggagattgagaccagcctggtcaacacggtaaaaccctgtctctactaaaaatacaaaaattagctgagtgtggtggtgcatgcctgtaattccagctactcgggaggctgaggcaggagaatcgcttgaaccagggattcagaggttgcagtgagctgagatcttgccacaacactacagcctggcaatagagtgagactctgtctcaaaaacaaaaacaaaacaaaacaaaacaaaaaacagtaactcacatacacacacacacacacacacacacacacattggggatctctgatagcatgccttatgaacttcagaggatgaaacaagatcacatgcaacatttacaaacataatatgaactcatttcttcccgtgctcactctatactaatactacagggaccaaattgtaataacataagacagcctagggccagccctctagtccttccactaagagataggaataaataaaataaaattcttttctaattgccctgcagacatttttacttgtcctgagtaaagctgccattaaaatgatggtatttttaaatgattcatttgtttctctcattttctgagctttccctagctgtcatcttacaatcccatgatcagtggaacagagggacctgttccgtcaggaaaggcagggagcagaatgcatgctgctagaagagacacctggaatattactatcaactctcttgatttgaaaactgatttccttagacagcagctccaaaactatatatcccaaccagacgtagaagcacatatgccaaaaaaacaagtggacggctttattgttgttgcccagagaaatgctacaatgatttggaaagctgcactgaaatgaccattctccactaggttttggaaatttaacctgatacagattcatgttaaaaggtggcactggaagaaaaagtaattccaaagttctctctgcctgcagacctttaaaagtattagaaaataaccaggatgctggatttctttttttgtgaaaattgatattaatattttattaagatgcattcaaataattatttatacatttatatgcataaacacccaaaacattttatacatggaatcatataacatagtattctcttgccattatttgtttgttttttaaaactcaaataagtatagatttacttttttttttacttcatagtatttaactttacttcaactctattatttcctttatcaatttcctcttgataaatgtttaaccttttgaaaatattttggtgttaacagtggttcaataaacattattttccattgatgtaatagaattattttaaaatgtttttaaatatttgcccttcagttagatcccttaaagcacttagcctgtgatgtgacataagccatgtaatgcccagctgcagacaaagctggcttcacaaagttacagaatgtagtaggcacctggctaaggaaaactctaccccacaaaatatttagcccccagtaggcactttaacaggaatcacattttttcccctttttacattaaatgtctgatggtggaagaaggggacatgtttgttctaaagttaatcctaatggaaaagttaatggtccaatattttatttataccataatggacaatttttctctttctcatttgctgaactttatgcaaggctcttgtgtttatttgggcacaactccagaggccttcattcttattctcacctgactggatggcccagccaggtcatgtataacctgtgatatgcctgtgcatatacctgtgtgcgtaggctgctgaggccctggtatttggtttagtttgttgcttactttgccgttgcttggtttcctgattctctaaaagaatataaggcagaaaaatcccagagagatgtttcagagtttcagaacagtaccgttgaagatactagtcacactgaagtttacaaaagttacatataagagaacaaagacttctttcatcatttagacagagttggtttgacaaaggttttcagcaaatcacatcaccaaataagaaactaaacttgctgacttagcctattgcactaaccactaaactcagcttcctcccttagctacacagggaagaaacacaggggggaaaaatgccaccctttttgaaacaagcaaacttttggaaaatggccaggtctggaggctgacttgtatagtgcatcattttatgagatgtataccacacccagaaaccttgcagaaatcatcatgacagagatgagataatctcaaaactttctgattttatgtggcgatcatttgccatgctggtagaaggttttatgagaacttaaatgctctcttctggaaataggcagtaattctagaatcccagaaaatttaaatccatgtcaatttgatatgtttggacagttgacagggaaatagtactgttttaattccatgtatatagggcataaagacacatattaaaataagaaataaggaccagatcagaatgaagcaccataatgttaatgaaagcaataagttcaagggataattttataaaactgtcattagagtatttgccaaagagagagttgcattatctctatcatatctcttatttcactataccagagcctgcataactgcagtgattattttaggacttaagacaaatactttatttattctaagaacacattgatatacaacttatatatcacatataagaagtcaattgtctctttttgtattagttttgatcagttagctgatgaagtctttgagtcttaccccaatgccggatgccagatttcttttccagatacttggccatatccccattacagaaagtttgggggataaaaggaattcttttttaaaaatgaaatgtttaacattaatttaaacctctttaagaaagtaaatataaaagaagaggagtagagagagtggtgacttgctccagtgccctaggcaaggcagaagaattgaactttattaggagaccactaaggggactgtcctgcctcgtgagttacaggtattgtaagccctgtgaagcacagctgaattactcatgaagaatgttttgtctcaacacaagactctgattattgtcttggtcattatagtttttcattttttttaagcacaggcagcgaaaggaggggttctgccatgctgatttgaaaaggagtccctgctaatagcatttcgattctgcttacacattcacaaccacacacatacacaaagcattttcaactgggtctacatttcttcaatatttattggctatctataacagggcttttgaagtatatgcaggaagggagaaaaatctttccacaagcgcacctatgcagggtatgctgacattttgacataatccagaaaatcaaccattaatctttaagctttattataattgagctatgtacacaacagacctccctgacaccttaatccatccccttgccttaggaaacacatcaaaatgtaaaaatcttttgttaaaaatttttctcaccaaacaccatggtgaatttaagatcttaacagacaatatacctggaaagctgcagccaaattttatttgtttgaagacacatataatgtgaccaaatgtttgaggatacatccaaaccatgcactaggggaacacataacagcaacagcaacagatgagttgacactaagggtagtaggtcagggacatctgctgtacatactacttggcagtttaaaaaaaagaaaactgtctttcaattttgacatggctgttttgatgctgtcttatttttttttaagtcttactttcctatgttatataatacacagcaagagccatagaccttataggtcaagactggagacagagcaacagccacaggtgaggatgctgaggcctggccaaaaaggcctctggaaaagggaaagatgcagtaagaccaccgttggcttttcccatccttcagcagctaggaatctgtggctccatagctcttcctttcaggcaagtctcaggctggctggaaaggacaatctccaagaaagtagaggttgacctgacaactatgcacgcaactgaaaacacatctaatatctgcctccaagagaaaggaaagcatttagcaataaagacaagctaataatatgcctgatattccattatttattcagcagtctttcagtaacttttgagccaagcttcatgctaagcactgacgatcatacatcttataaacaaaattaaattcctatcttttgccaaattacctgaaaatacctagacaggctttttcaccatatttggagacagattaacttaaaatataggtatctcacataactagatgactttccctccagggaagctggtggtgtttatttctatggagctacttcccagcatgggccaatctctgggtatgctccatggtgacttagcagcagggttaatgattccctgtaacctcagtaggaagatcagctagtttatgaatgaaacagaaatggcctctaccctcttggagctcacaatctagtggaccattaattttcaacacacattcacatacattactacacaatccacacaacaatcctggggcagccagaacaagtatcattacacctgtttcatagaggagacaaatgaggtacatgacattgtgatttgctgaatgtcactcagctcaatggagaaaagctggcactaggatcctgatgctctgagtctctaatgcagcacatgttaaggcatctgtatcatctcccggttgatctatgtttttattccccttgatagatcaattagaaaaggaaatctatgcctacttttaaaagacacttcccatgctctgacaacttcaaagggttccaagataagaaggcaaagaaaggcatctataaagctagagtgaatgccataaatggagcaaacctctattattacatggcttgttatagtttctgacgtgctaagggttatgtcatgtgtgtagatgaaactagaaagaacaagagaaagatgaattgtttctagttccacatccactgatgactttcttatttttctttgggtaaagaatatttggtctcagtttcttcatttatcagggagaatattccttgctctactgtccttatggggttggtgagaggctaatatcacaaaagctctttaaaagtatgaaggtgtctacaagtcccaagaaacattaggaaaagggcccagcaatagagcaattaaaacctaaagactcagggggagggagagcatcaggataaatagctaatgtatgcagggtataatacttaggtgatgggttgataggtgcagcaaaccaccatggcacaagtttacctatgttataaacctgcacatcctgcacatgtatcctggaacttaaataaaataaaataaacctaaagactctccagacacagttctgtagagatgtgaggggtacttcacaaaaataaaataagataatctctctgctttcttgatggaagagatgtgggtttgttttttgtttttgtttgtttgtttgtttgtttttctggctttgggaagagaaagaaagctcattcaatattttccccatcctcttgatcccacttctacccttaaatataaaatattactattgtgctcatctcctagttgattcatctttagctattcctttgtggcctgcagattcaacaacttcaatatgcacaatttagagctgcccttgaagaccatctagaaactttaggtgcttccaaggtggcctgccggccatctgcccaaagtaaccaaccatatggattttattaaactatctccattagtcctccaaggtaacctacttgtttatgagagcgtttcacagcccagaaagcctaagggggttaagtctccattctttctgaggctgccaactctcacagacagcatcagggtaattaacatcacacaggacccccagatctttgtaagaactctgaaactctgtttcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaaacttgataagaattttttccccaaaagcctactagatgatgtcctgcagtcagattcattctagtcttcaacatcattcacactttggtcagagagtaaatgtattgaatgtttatcatagcaatttaggcaccaggtatacagtacaggaaacattgacagaacccttaccttcaaggagcttgcattctgttggaaggagacaaaccataaacacataaaaaatagatgtatagaataattccaggtacggataggtgctccaggatgctataataaagaatgacttagggttagaaaaatattttaaactgggagcttgggttggatggagggtttagggaaagactcattaaggaggtaacattttattagagacttaaatgataagaagaggcagctatgtgaaaatctgatggaaaagtattccaaacagaagtcatgcgaagtacaaagtcctggggcagaaacaatcctggaatgtttaaaggaaggaagaaaaccactgtggctgaagaatagtagcctacattagaattatagtgatggagactgtgtgaaggaatcagatttatgattcattttggaggtagagtcacagaatttgctgatggattggataacatttatgagcaaaaggaaagagccaaggatgactctcagattttgggcctacatcccttttcagtaatcacttatgaaatctatagtcacaagggctgaaaaggtatactaggactggttaagaaattttccaaagcgttggagaacgttagctgtctgaagggaagattgccgttgttataactgttttaaacacatctattgagatataattcatatatcacacaattcatccatttaaagggtataatggttttgttatatcacattattagtttttttaagttgtgataaaatatatttaacaaaacttgccattttaaccacttttaagcacacaattcagtggcactaattgcatccacaatgttatgcaaccatcattactaattccaaaatattttcatcacttcaaatagaaactctataaccattaatcaacttctcattccctcttctcccaggtcctggaaacttctaatctatttcctgtctctatgaatccacctatctaagtacctcatataaatggaacaatatgtccttttgtgtctggcatatttcacttagcataatgtcttcaagcttcatacatgttatagagcttcattcctttttaaaggctgaataatattccactgtatgtatatgccacattttgcttatctattcatctgttgatgaatacgtgactatttgtgaataatgctgctataaacattggcatacaaacatctgttcaaatccctgctttcaattctttggatatacacctaggagtaaaattgctggatcatatgtcaattctatgtttatctgctataacttttttttttccaagatggagtcttgctctgtcacccaggctggagtgcagtggcacaatctcagctcactgaaacctctgcctcctgggttcaagcaattatcctgcctcagcctcccaagtagctgggattacaggcgcatgccaccacgcccaactaatttttgtatttttagtagagatgtgtttttaccatgttggcccctgacctcgtgatctgcctgcctcagcctcccaaagtgctgggattacaggcgtgagccaccgcacccgatctgctataactttctaaaagtctattttgaaataaaatagatgagggcatcttctgttctgttttcttctcattcctgtttaaacaatctcagtcttgaggcaatagatgtttctgcttcagtaggaagagggatgctggataactggtgttgggggcagatctgtagttaatatcacaaagtttcatcttgatatcatgaatgaagttgaggaggaggtatatgtatgtatgcatgtgtcaaaaaagatctaaagccttgtctacaccacacatttatacaaagccttggacattttagttagtggccccgacttttagcaaaaacttaggggagcatgcttcccttttctgtgtttgggttgcaactctggtgcctcagcaggattgcactagcatgcaggcaaaggatgataaaaatggaactcattgtcctccctctgttttaaatggtttagaatgttacctgttggaagagaggggcttggatagagataatctattgcatttctctccagtcctgattgcatgaatctatctataagctgccctcaaaactgatcttctatctgtatactctgtggtgacctaatgaagatgtccctgaacgtggttaacttctatgcctagagaaatctgaattccagaactgagtcttaattcccagttttatcaaaattcttatgtgtttatagcctgatttatttgactctcaactttacttcctttgagtctggtctgggttacagactattatttttatgagaaatattttattttgtttttttttttaattaaggtatgttacaaataaaacttacatatcctgtcattcttggcaatatgaattcaccttgagggcattatgctaagagaaataagtcaggtattgaatgaattatctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtccagtacccaatagttatcttttctcctctcctctccctcttccaacctttcatcctcaagtagaccccaatgcctgttgttcccttctatgtgttcatgtgtgctgatcatttagctgccacttataagtgggaacacatggtatgtggttttctgttcctgcatcagtttgctaaggataatagcctccagctccatccatgttcccacaaaagacatgatctcgttcttttttatggctgcatagtattccatcgtgtatctgtaccacattttctttatccaattggtcattgacgggcatttaagttgattccatgcctttgctattgtgaatagtgctgcagtaaacattcatgttcatgtgtctttatggtagaatgatttatattcctctgggtatacacccagtaatgggattgtggagtcaaatggtagttttgcttttagctctttgaggaattgctacactgctttccacaatggttgaactaatttacactcccaacaacagtgtataagtgttcccgtttctctgcaacctcaccagcatctactattttttgactttttaataacagtcattctgactggtgtgagatggtatctcattgtggttttgatttgcatttctctaattatcagtgatgttgagctttctttcatatgcttgttggccgcatatatgtcttctttcgaaaagtgtcttttcatggcctttgcccactttttaatagggttatttttctcttataaatttgtttaactgccttatagatgctgggttaatacctttgccagatgaatactttagaaatattttcttccattctgtaggttgtctgtttgttgacagtttcttttgctgtgcagaaactctttaagtttaattagatctcatttgtcaatttttgcttttgttgtgattgcttctggtgtgtttgtcacaaaatctttgcctgttcctatgtccaggatggtattgcctaggttgtctatcagggtttttatagttttgggtttcacatttaacagactatttcttgtatcagtcagtaacattgattttccaacccactgggtaaagaagtctgtcctggacactctgggaataaaggaaatgccattcatactgagcccagtatgcagaaaataaagaagacaggtgatttcatcaggaacagtttctaaaaaagagggcaatttaaaattatttggagggagaaaagaattcaaaaatagttcaagggggatgtgagaatatttttgtggccaagaaagaaaaacaatgaacaataagaccatggctttatatcacattaaaccatggccactattgactaaggtagttagttttctctagtgttcacattaagatttgtttgtgagaaatagcatatgtatataaatttgggggagaaggatttaggagagataaaaacaattagtttctgagaaagaaattattgctttggaacaactgtatcatagtagaaatcaatatatagactgccaagggtaaactgggaatcattcctagagatcaaggtgctctggacatggtcttatttctaattttaaaacttacattttgcatgtgaaggtgaggttcattaaaaatgtgctctccaaagaatactttgctttcctttaaatgagcttcgggaatcaatgttgaaaagcaaaatccatctacacttttggcatacaatatcaaatgaaagaggattttatagcaaatctttcatatttaaaagcaacctcattacattagacattgtttcaaataaaataaacagcccctttcctgaacatgctagtatgaataagataatcataaaaagagtcaaattaaagcccctttgccaagaagtttgaagtttgatttccaaatgtttgtattcgccaccttcctctgaacacacacacacacacacacacacaattaagtacttatgattagcatattattgaagtttattatatatgaaagtcagagagaataaactgccccaccagccagattcttaaaaacacttttgctccattttcttggcctgggatttcagccaactgtacaaacaggaaggttgggaacaccatggtcaataaccaaggaaaaatataaataaattcaaggagacttggataaattcatacaatacggatacgtggaaagttgttaaagttaagggacaggtacttgaaggacactttcacgaaggacactttcacttttagagttgacatccagaagacaaccatggcttcccatagtccatagtcctgtcttaaaacattcttatctggaactgcccaaagagcagacctatagggactagcctataattttttacaagattgtttacaaacacagttgtttctcagttcgcaagaattgagactatttagcctgaagaagatatgtagcagcagaatatattagaattgtcttcaaaaatttgaagggtagacattttaaagatcgactggactgttccgtggggccccaagggacagaacaaagatcaaagagtggatattacagggatagagattttagatcaatgtaagaagaacattctaatatagcaatccatagataaaatgagctatattcatagatagtgaggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttaaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctgtgtgttcctgtcagggattgagaaaaaggaaaaacctttcctctaatcaacagggaccagtgggagataattgtttcaggggctggaatctgaggtcgaattggcactgtcgcattgatgctttgccaaaggtttagggagccccaaatgaagatctctatagggaagctcaagtaatggtatctggctgaagactatgaacaataacacaccctgaaaactaaaagtaagagcaaaattaaactgcaaagagagaaatcatggccaaaagccttgaaaggtttacaattttgatcttcttctcctctgatccagataatgcccttccttttccactgcccatttactgggtgagtcttgagtgaccaggactgttgtatttatgtctttatggatctttcagagagccccctgattcctatcctagaggactgcaggtggccaggtccaagtgctggttatcagtggagatcttcaattagtatgacctaggtaaaggctgtgggtaaaaggaacttcttagaaaaatatggagcagatgacaaatatatatcaggagcctggaaactcctgccctttggagagaagctctctcctactttcctttacccgacccttacttccttttctctttccttcctttacctgctgggtcttgggtattcaggactgttatgttagtgtctgtacagaggcttcagggaaactccccacaagcactcttacctgaaagaatttagatgaatagccatagatattagtcagcatgggaaaataagagccacagaacctggaaagaagtagggacataagcaacttcataaaaagaaagaagaaaatggagtagaggagcagactggtcaggagcttggcaacttatgccaacctaaagaagctgtcccactggccctttctgagacctaagggtctcaggtggtgaggacttctatgttggtgtttttacagaggttttaggatggacaaaaagaagagctacccttcacaaaggaaagttcattaaaatatggttggaagctatgggcaagagaaaggtccttaaaaatgaaaagggacagaatgagagattgcaccaagagctttgaactcttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggatgtaaatgttatcaggaaaagaaacagattttaaaactgatacagaaggaaaagaaccaggagccaggaaattcctgccctgtagccagaagcacaaccctaatgcacaactccttattccttactccctttctctttgcctatttgacctgctgggtgtgggcattgggtaatcaatgcagttgcattcatttacaaaggcactgaggagaccaggggtccaaccttccccacacagaagacttgtgggtggacagccccaagtgactgaatggcagggtgaagcctcctgagagtaagtggaggtgatctgtgaggagaatatgagctgcataccctcctttagtatctttaccagcgagagttagtgagggcacatctttaagaaaagagtggtatggtagatagtacccagactgaagtgctagctcttaggcctaaaagaaagaagtaggatttctgtaatcctttctccctccctctcttcttccctcccttttgttaattctacattgccattgccattttaacctgctatgggtattaggcaaacagaagtgtgatcatattcaaaggcacctatccatggagtgggcataaggtatcttttgaatacaggcaccggggtggcgataggagagttccaattctcaagcaggagagaaatgttttccagcccagagggcagattgcccagcctttatctacatcagcagttgggcacagttgatcaattttcgaatcagtgcaggctttgctgattaaggctatattatggacattgctcagcttcatatgtggttaagctggacctgttaacaaggtacatagagtatttccaccacaaattatttggatatctgatggatatttaagaggagccatcccttctttctaactttctttggagtgccatcatctcccaaacataaggatcctggcttctgcagaaaagagaactctgcccttcccctccctggaaagtaatactccgccttttatgaagaccagatcagtttttataaggctagggttcaatattttttcactcttttctactaggacccttgctattaccatggatacctattttgccccttgacactttggagatgcagtacagtatccattgtaccaggatctcccaccttgaagctctttttactggttttttgttgttgttgtttgcttgtttgtttgttttgtcttccaggcaatttccaggcttgcctatcttccagaccaaagattaccaaaagctagttaaaaatatttgttatctttaaggctttccctttcttccaaaatctttgactatacaacacagcaggaccctgccttaagtaatccattaatcagacaattcacaactgatgaaagcaataaatagtaattactcacattggaaacataatcttccctagaaaacagagatcccttagtgcatttagtgcatttgggtgctaacagatcattaactacttgtcagagaaacctaggaggagggctttcagaaataaacataaaacaacctatgcatcaatagaaaaataaaatttgattttcaaaaacgaatctaatttatggcacagcttttttttaggaattcccctgttatataacggaagacatactattttctaggcaaagcagcacaaatcagggaaaggaacatttaaaagtgttggaaaacttacttgcctatgttgagccaatctatgtaggtatggttacatcattctagaagtctggtagtcaatctcggagtctcctttacacacactggtcattttttcaatacttttggatccatgtcttcctaatgctgggctaaatattcagcatgtgccatgttgctaaaacagaaacaatgagaaacctaaatgttctgcattccttgattttgagtttaaatttgtaacgttattaatattgcattaataacctattttgcatatctgtttgattgtaccatcttaaacattcatttaaacctggggaggtcagcatgactcctacctgcttctcactaataacatgcttttcagcgagtagataatgagtgacctggatagaaatcagtggaaatgcagattgccttcaggtggagaaacaggcaggaaatccactttctccacaacactgacaagcagttttgaggctgaaggtagagaaagtaagcctcaaagagagatgactgtttaggaaggctcttaatcaaatattctgttgtctttacatgtggtagtatgaaggaaaagtcatcctaatggaaattaaatcttgcaagtgactttaaaaatcttgggttaatagaaataagtgatttaattatggagagaaaaacagataactcttggctactgattatcctaatgggttacaggcctgaataagcattccttagttcgttgaattaactactgttagtggcacacaggtaaggataggggtgggaagtagtgggcagtcaaaggtctgccattgattgatcagagctgggatagaaggcaatcaggtgagtcttaaaggagaaccacataattttttttaagtattaatggcccactccacttttctggaataacaaaatatattaataataatgcccttgctcaagatatagagggcctgtttttcaagttactgtatttctttggtaataacgtactggcacagaaacagggacttatgtgaaatgtatttcaaaccaatgtctgctaataaattatcccacaggccataggtttcacaggtattagaaaatgcatgagatttgggccggatgcagtggctcatgcctgtaatcccagcattttgggaggccaaggctggcagatcacttgaggttaggagtttgagaccagcctggccaacatggtgaaatcccatctctactacaaatacaaaaattagccgggcatggtggtgcacacctgtaattccagctgtctcaaaaacaaaacaaaacaaaaaaaaacacaacaaacaaaaaataatacatgagatttggaaatgcaacctgggctttcagtttctctcttctaagttctttacgattcaacatggcttccttctgcagtttgactatttatcttcactgaataaaggtgatagctgtatcagaaactcaagtcaaaccaaataatggtgtgatttgtttactttggagggttttcagactttggttttgtttctgttcgacggtggtaataaaaacataggtctgaatataaaacaacctagttttctacttgattcttgaaaaagaaaaaaaactttgcttcagctcatgagtctgtttcttattttttgttttctaatggagtttgacttgcaaatctgcaatttggcagcatttatttctgtttggggcttttggtatagcttggctcaagtccctggttactgtatgacagcaaccaagccaaatggctgtaacattcaatctgcccaattaaaaagcgttggttccatgccccctttggtgactcagatcaggcaaatttactgttgttttaatcttgattgtactcaattattcaacccatctctcagagctgatacagataactattttttaaaaaccttggggaattgtgagtgttgtcacctggctgctcactccttttggaattcttcccttggaaataagagtcagagagagtaggtctaaacaacttaatgtagcaactcacagagccagaaaaagataatcaggctacgtagaaacttaaggagtgcaccttttgttttttccacaaatattttcttctatctgctctttttgaaataaagtatggttcttaaataagaacagcaagaatattcttccatggaatacctagactcaggagttcatttattttcaattttacacaattaggataaatgtaaaggaaacagtttctgcacgtgcctaaggaattcttgcccatacaaataacacagcttacctttctctagagaggcttccatgagcacaggctgggggagctattccagagctacatactagctctgaatagagcagaagttaattccccaacctacccccctgtctctcaacccagatgatagccagccctccaaatggtgcaggcaggatgtccatttgatgtagtcatcacctccataatcagagtaaactagaaaaatattataaaatagggaaagtggttcttggtgctgttttctgccttttagttcctctctgcttttccttaagctgtagacctatactgtccaatatggtacccactagccacgtgtaactatttaaattgaaaataactaaaattaaaagtaaatttaaaattcagtatttcggtagcactagccacatttcaagtgctcaatagacatgtgtggctagaagctaccatattggagagcagagatatagaacatttcagaaagttctatgagatgttgcttccaactattagttcttttagcttcttgagcataaggaacatgttttccacatctccattccttacagcaggtaccacaattcctgatacaactatggaattggggagaaactaagtgcttactatgttgtcgtgagctatgtcaaattcattataagcaatctctcatttcattacctcaagaacactataaggtgggtcctattaccatccccatttttcagaggaggaaactgagtctcagtgaggttgaattatttgcccaaagtcacacagttaataagtacctaaaccaggtctttataacttcaggatctatactcttaacaactgctgtgtacaccaaaagaaaactgcacataactacaaatttcaacatgggacagacaggccccttccagagcattggtgactaggtggcttctccacagcactcatgctggccaaggcagaataaagacaatttgagatcagggcctgagcatgaagattggggacttaaataagtgtgctgatttgtgtttgcatatggctatcagattaagtggctatctgactacttctctaatgaaatagcagcaaattagtagttttatctgccattttgcatatggagaccattgccttgaccccaatggtaaagattagtggaacctaatcatttcatgaagtcaacctcacttgctgcacttatcagaagcttctgtaacttgagcttccatggcgtgcagtttatgccaggacacgcaaatgccagaaaatcaattttcctgcagctttcacagtcagtgtgtttgccagacaaaactgcagccagccaccttttttaaatcagcatagcacctttagaaataatacttaccagaacgctcctaacacagcaaggaggaaaagacttaaatctaaacccaactgttcaaaatcgagagccacaggagaaggtgaaatatgaatatattgaaagtgaacattttagtggccccatttggcactgtaaagtattctctgccaagcatctgttgagttaactttaattctaatctgtgccacagtaggactgaaaacacttaatatgataccatacttcctgtcacccacatgtgcccaggccctcacgtgcccctgacatatcggggtggcactccacattgcctgcctgccccaagacctatcttgattcttcttcctctggtattcttctggcacacattctcaaataaaccaaaccacacaaaggcagtggatgtggggtcatgttaccttcccatttgccatgagtgcataatctactttattgaagacttactacttgccaagaactgttatgggtgctttacatgaattatctcatttagtagtctatctccatttcagagataattattagagtcttagagaaatttaagtaacttgaccaagtcaaacagaaggcatgatctctaatggtagcatttagggcctgtgacaagctagtgagttatcatattggtgccttttacctcggagcatcttgcacaggtttcaaagctgaaccaagaaagaagatcaaggttatataaaatcatgtcaaaacaacaggtcaaagaagtaaacttcactcaattcactagttttggtcaatgtagctactaacgatctttccactgggaggcagtgcagagtagtagaaaaaaacaacacaggtttttgaaagccagcacacctggatttgaatactaattctgtccccctgcatctatgcaaacttggaattataactttacctctctaaactctggaagagagaagaaggagaatatagactttggtgtcaaatgagctgggtttaaatctcagctacgcatttattcattcagttaatatttattaagtacatgctatatgacagccattgttgtaagggctcaaaaccaaagtccttgtaatcactgtagtgggtgagacaaaattaaacaaattctgtaaataacatatatgtttctgttggtgttaagtgcaatgaagacaaaaagctggtgaagagacaaaatgttggtgtggaggtgctatttcatcttggctgattgtggaaggcctttctgacatttgatcagacaccctgaatgaaaggaaggagcaggccatgaaagtatgaggtggagttgcgtggagagaaaagcattccagatggaatagcgttagcaaaggccctgacatgggaatacacttggtaggtttgaggaagaaggtccatgtgctagagtgaagtaagtgagggaaagagtggtaagagatgagagcagtgaagaagacaaaccgtggtaaaaattctggattatattctgtttgacagaaagtcacttagccgactttgagcagaggaatgacatgatctaatctatgtgtaaaaggatcaatcagactgctatgtcagggcaaaagttgagaagcagggagacagaccacttaagaagtgattgtaggccgggcatggtggcttatgccaataattccagcactttgggaggccaaggcatgaggaacacttgagcccagaagttcaagaccagcctcagcaaaatagtgagatctccatctctacaaagaaatttttaaaaaattagctggatgaggtggcacatgcttgtagtaccagttactcaagaggctgaggtgggaggatccctgagcctaggaattcgaagctgcagtaagctaggatcacacaagtgcacgccagcctggacaacagagagagactctgtctctaaaaaaaaaaaaaaaaaaaaaaaaaaaaaaaaaaattaattcaatttaaaaaagaagcaattgcaatatttcaggtgaacaatgattagcttgaattaggaggagggtagggagaagtggttgcattttgaatatagattgagctgacaaggtgtggaatgtgaggccaaagagaggagtcaaggatgactaaaaggattttgacctgagcaactggacaaattggaaggtgctgccattttctctgatggagaaccctagaggagtagcaagcaggggtgggggagaatcaagagatccattttggccatgctaagttggagatacctatgagatatctaagtggagatatcagttaggtagatggataaatgaatctaaactttagtgaggtcagagctaaaaatttaaccagctgtatcaccttggagaagtaaaataacttctataagtattagttaacttctcagtaaaatggagataatattggtttcacaaggttgttttaagaattagcaatcatgtatataatgcacgaagcaccattcctgttgcatgtaagtgcttaataaatggtagccctctcattgtcagtatttatgcactaattggtagctagttgttgcagctgtaggaccattgttgattattctaaacacatcgttgaatattagaatcacttaggaagcattatttacaatgttggccccgcctcaggccaattaaaccagaatcacagaagcagtcatcagtagcttcccaggtacatagtatttcctgctgacaagctggctttaacagaacttctcttcagattagttccagctcaccttttaggaaactaacactccccccccaaaaaaaaaaaactctaaatggaaaatttgggctcttttggataaccccaagcaaattgcttcttcttttcttcattgcttttttctccccttagtaagaaaataattctccagggacctggaagtaacagccacagtggaaacaaaacattgcaatttcaggatagatttttcttcttaatagaagaacattttcccgctcatttcctaggacctgtattgtcaggtttggcctccacactacaattaattgattcaagaataacaatagtattgaacttctcttttgaatatcttagtaatagaaaataaaaatacatttaatccaattggtcaatggtaattggctttggattgctggagatgccgtttcattgaaaaatagaactctagaaggctgagggaagtgaccttggagtgttcaatagtgatagcagtcctagaagcaatccttgattgagagtcagggaatttgaggctttgctctagttagtagtgaaagggtgtggcagacacactttctttgtgacccattctctgtcttgaaaataggttctgcaacttttacactgttggtgggactgtaactagttcaaccattgtggaagaagtcagtgtggcgattcctcaaggatctagaactagaaataccatttgagccagccatcccattactgggtatatacccaaaggattataaatcatgctgctataaagacacatgcacatgtatgtttattgcgacactattcacaatagcaaagacttggaaccaacccaaatgtccatcaatgatagactggattaagaaaatgtggcacatatacaccatggaatactacgcagccataaaaaaggatgagttcatgtcctttgtagggacatggttgaagctggaaaccatcattctgagcaaactatcaaaaggacagaaaaccaaacaccacatgttctcactcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacatatgtaacaaacctgcacgttgtgcacatgtaccctagaactgaaagtataataaaaaataaaaaataataaaaaaagaaaataggttctgcaatctaaaggtgaaggtacatagcaaagtcaggttttcaacacacacacacacacacacacacacacacaaacttctcctccatacccaattaatgtgtccaccattaggctatcattcctttagctgtggtttgatcctatgaggagatcacacttttgtatattgttcatcatttctacctcagtgtgaatgtttccaattcttttctgagcacaggatggggtggggagggcatcttttacctgataaggcaaatgaaagagaggtggtactacccacgcaggggagtggaaaatgaggagcatctgtgaaaataaaagttgactcacagtcttggcttataacagccatataagttcaatacataacgttatactccttatatattttcattctcaaaataaggagaaaaaaataatttgtcaacttctggtttaaaaggtagggttttcatgtggactaagggtaagacactttagtctccaatcctacatttcagggagggaataatagaaatatcatgccccttgaaatgatgctaaagtataagcatcatttcaatcagaaagcagaatttctgtgaagtcatcccaaccctaccacatggcttaacctatctaggaatagtgtactgtttgagagcagactctggagcctgaatgagttcccagatccaccacataccagctgtgtggcattaagcaaactacttaactcctctgtgcctctgtttctgcatgtttaaatggggtaatatataatagtataatctatttcatagagttgttgtgagaattacatgagttaacacatgtaaaacccttgaaatggacctggaacaaaaagtatgtattcaattaaatgttagttatgatgggttttcttacttaaagatggcttaatcaaagtccatatagcagagtttctcaaccttagcaccgttgacatttggggccggataattactggtggtgggggctgtcctgtgcattgtaagacatttaacagctccgctggcttctacccactagataccagtagcactcctctccccaagttgtgacaatgaaaagttgttgccaaacgtctcctgagaggcaaagttgttgcttactgagagacacaggggtagagggtactgtttcccttcctccattctcccagaatagagcaatggtaccttagaaacattttctgaaagaatgtgttgactctagctttcaaagtcacatggccactggcactattttcaacccattggaatatgcttagtctgactcagcaagagaagcagaagattaatcagaacagtaatctgactttgcataccagagagggacactagaaaggtctcaggaaacttagctgattgtcacctgcacctttggaaaggagacatcagaaatagcccttcttgaagtggaaggaaacatgtccctggacttgtgaacacagtttgaaactgttaagcaaagtcatttacatttgagggcaaaacttaatgtctaggcgaaaggtgacctccaactccaatgaagttatctaaaagcccagccctcaaaataactcagtcaggctcataacacacaagtagaaaaactaagaatagaaaccagaatttctttcccttcctttcccctgtgttcaccaatacacagtctcatgacagctgctgattgtctgaagcaaaaggacacagacaagcagtacttctctgaatgttaaaaatgtgcaaacctaagtgaaggaagaaagtgaaattggggttttggccatgcttagaaatgatatcatttgttgtgtgccttgctccaaatcaaaatggaaactatttcctttactttagggggaaaactgtaaaaatcaatgattcctttttccaaatgcaccttattagagctattgacttcttcaaaacataagtggaagaaaaaaatgtgtccgatgcatttggcaacccagatgtatttttcttcttttgcctcaaattgctctgatcactttacatggtgaagtatggacactaagggcctatagcagggttacaatgagtgacaagaatgttcactaattccagtgccttagtgagaggggatttggagttaatttacaatttaccccaacttcaaaaaaagcttggacaagaagcaaaaaatgtttttggaggtgagttgccctctttcatcaaaaaggatattgtcagtgctaaagcaagcaaaagaggctggggttatcacggggaaagatctatctgaaacctttctagttgacttggatagtgtcccagccttgttcctcattagctgtgtgacctaagataagtagttgagtcaatggcaaatctttgaatttctgtattggagactcttcaaggtggagttctggttaggccttatttggaaactgcttagcaagcacacagcttttttcaggcttgatttatactgagggggtagattcatggaaatgagtgagtaggctaaagcccactatggcacctcttggcattgccactgcacttaccctcccttaccctcagttccatcttttataaaatgggaattcattctttcattcaatatatatttatggggcactactgggcacacacactgttctcagtgctggggagtaagcagtgaaaaaacaatagctactgcacccacctcacagggctgctgtggggtttaaatgagatggtgtgtgttaaatcaccctggcacccagaaagctttatggaaatataaagtttaaagatattcagctatctcctgcttctagtcatgacaaatctaaggcctctctgaataagggagtatttgaaaagttgtatggcaggtaattctcaccacaaaaatctcctcttcatgagtctaaaccaagtgcttgagatttccacagttggagtcttaacttaaagaacttaatttctgtagacctgagacttgtgactacattaaagaacttcagaatgggcccaccccagccacaccttacccctcccttatagtcctaccccacccaccctagtaggacatgcaagcacattgtcctcttccaatcccatcaaacattagaagaggcaaagaagaaaggaggaaaagagggggaggtcaggagctctccagagctgtggcatcattggccttctttccttctagcaccttgccttgtaaggatcacctatgcatatcctagtattggtcaattctgtgaggcaacatttgctcctgaatgttagagaaggcacacaaggcacacaggggtcctgtaagtgttccgttcaggcagatggaggcccaaagccacccttttgaatttttaccacctagacacctgagcctttaataaaagcagaaattacagaggacgctaaataattcagaagaaaaagcagattgtagtttataattatattatcttaaagatacaatctaaagaaaaaatggaccaaattgtcaagcaagaagtagtccacaataaacttagagacagcaaaatgagtgaggaaaagtcatttttgtttgaaactcttgccatatttccctttcttagtgtctcatacacaaggcagccttctccagcccttgaaaggcaccttttataatgccaagaagcccactctcctttttggggtatgaatcccctattcaaatcaaaatgaccccttgctcaggggtaacagaagccattatactgttagtgaacacctctatgaggaccatgactgctgataccagaaaaggggtacaagttatatctctgagggaggcagacagtgaaacagggagaaagtggtagaagatgagcaccccaaagtcaaatctagcccctttgacatgtatgtacaaggctagtcctgtacatacaatgatggaaatggacaacataggcatggtggcaacagtgttcaaaaaaataattacatgcataaagctggcccattttcctttgaggaacactggaatacaaagtgcctaaaagtatcttccccgacctctccttcattacatgttggggaatagagatgttacaaacaccaatactgtctttacaaattatgtaatactttgtctgcattctgacagtaaattaatagcataaatgaatagcatattatgcttctgttgataaacatgcttccaatttattagtccattttggtaattcagttaattctgcactatcaacatatgggaaagtggatgttgaaccctgtcaaactgaggaattgtgctcatgtcaagaccacgagaagagatggttccattgtcctttatgttaatgtcactatatcaagcatattgtgctcaatttgggaggccacattttaggagggactttaaaaaaatgaaaaggtatctagaagattgtgaccagaaaaggtgagttgaatggaatttgtgtcataaaagtaacaaatgaaggcccttaaaatgtttagcctgcaaacaaggcaattaacaagtgacactgtggcagtagattccaggctgtacatcgtgtcgggaagagagcatactgattctctattgctacaaagagaaaaattaggaccagtaggtgacacttcaattttaatattcactcattccaccgacacatagtgagagtttactgtgtgccaggcatcatgctacacacccgtggtgcggtgacaaaaaaagacatgatccctactctcaaggggctcagatttggctggggataaccattgcaaagcaaaataatcagtactccctacaatggagaaatggaaacagagaggacgtactgcccaattcaagcaggagacagaagtaggattggagaggagaggctttcattaagaatatcagccaaaccaaaggaactttctatcaacttgaattgtcccaccatggaataagctacttcctatgcctcctctgagctagggagtgcctcttcaccagaagcatttaagcaagaagctatcacttcaccgggtgagaggctcaacaaaatggtttttaaggcgccttctagctctaaaattctgttattctactgactccaagtggatatactattgaccaagtggatatcctattttatctcacaggaaagcagaaaattttattcaccaagtttccccagtagcagtgttctggttaatgaggattttaatgtataagcctcaacttaactgcaaaacataaatgtaaaaggaaaagttgccatcctgcccattctcctacaccaacaaaatttttaaaatccaatttcaaatgatagtaatttttgttgatggcagaccctggtcattcaccaggcatatgtctggagatccaaatatacaaataatacttaagcatgtgatttctcccataaaatgaagtaatgattccgtaaatatggcactgaagtaatttataataccattaaaataaattctgtcagtaaaacaaattatactttctttattataaagatatataatgtttttcccacttcctgtgtttcagggattcttctaagtatgtattaacccatttaatttctcccaataaacctttgaagtatacacttaaaaaatcatcccattttatgggtgaggaaattgagacacatagatgctagataatttatgtacttagcaagtgtgattcaaacccaagcagtctgactacatgttcttaagcactgcactatatagttactttgaacttacataaagaatagttttatcactagagagctactatatgcacaatgactaggagtgaacaacaccgttgcaaagagacacaaggtctaagtggtaggcttctgtgtaccagactcacagggcccaagattcaaatcttcacatcaacaaaaagacagatttcttcatatatttgaccttcatgatgtattacgaatagttagagctacaactgttgaatccattaatgctaaggctctaccatatctgctatttgggattaatctgttccttctccatttatgtatttctcctttggattttggttgctaattatctagcagtgcttgagaatttcttatggcctttctttataaccattgtttgttcctttttaggtacaaaatggtgctctgtgggatgaatgaaatgaatggtggtgggttggagaaaaatgaacttgttattacacatcctgcccataaattgtttaacttctcccagatgacagagctaagattcagtcccttttattgccttctttatttcatccaaaataagacagaatgcaaaaaaaaaaaggaaagaaaaaaagaggaaatgctagttttctttcttctttatggtctgaatgttatactgacacttaaatactagttggaaagataaacgtttcagcttaatttctcctacttatgagtcatttcttttcccccttctaatctttttgagaattcagtcatcaaaaagagtccaatcatttctgccactaactgacttgtcatttaatgcattcattaatatctgccacatgtacaccatgtgcatttaaagggcctgcttcaagcactgctatttattctcctagaaatgcatcattacctaaaggaataaaccttttaacctgtatcagcaatcaaagagctcaagtaaatgatgaagtaaatgagtccaaattatagtgcacttggatcagaattcatggacccctttgcccttggcttataaatttatctttggaagcaatggcctgtttgcaaatagtgtaaaagacaaatatgtctgaagtctccccttcctggacccccactttgtattcaggtctggttgggccaagatgaaaaacacaaaacagctctttataaatgcacaaaaatgcatacccactacagggttttctataatgccaaaaataatggaaattatctaagagcccttcaaaaggggttgggtaaataaaacatagtgtgttcgtagattgaagagctatgcagccattataaaggaaatatgcttattctagtaaaagtataaaaaggtgcaagggaatagtaaaggctaaattcagtatcgtggttacttttggcgagtagagaagaatatgtatttagggaggggtagataagcagactttaactaacttcataatgtttaatttgttaagctttatggcaggtacacaggtgtttttacattatttttatatctttctgtgtatcgaattattgattattttttaattccttgggtaactaactaggaaatgtctactgaaataaagtccttgacaatgtatttcattacaatgcttaaaaattgtcttatgtgtcaaaagaggataatgtaatatggaatgagcataaatgactatgggtgagattttaatcttagaaggccttgattgttagggattatttggggggaagttattgatgtgggcatcaaaggcagactaagtagcatttaaaaagaggattgaaaagcatatatccaaattggtttagcaaggtactcagtgatttttagaaaaatttcagctctagaattctacagtgctataaagatagtgctggtagccatttttacctgaacttctgatatctttgaccagcaatctggtcgtcaccatggtcaagcctaagcttcagttattaagaaaacttatctttagtctgtcatgtatagagtaatttgctggctgccaagagggctagcaaaattaataaggtatggactttgtcctcaagaaacactcaagtaacaggggaagacagacacatagtcaactcaccctactgcaattaagctctatagcaaaggtatgagcaaatggctttgggaggacacccaaagaagcacttcgtgggggcaggaaagggttaggaaagacttcacagaagacatgacatctgctctggatcttgtagatgaataaggtaatttaagcagaagcaaaagcataaccaaaggcataagacatggaagtggcttatttcagtgaccagtgaatagcccagcatgacctaatcacaggagagtgtaaccaagatcataagcactcttgaatatcatacataagagtttggatttttttttcctgtaggtattagggaactagccgaggattttaaagaatgaagtaacttgattaagtttgcattttggaagaatcactagaggataaattgaagagagagatgaagcagggagactagttaggaagcaagatagtctagacaaaacaacgatggagcctgaccaagggagggcaatggtaatgagaatgaaaagaagatgagaggacagattttaaagtcattactatattagaaaaaacatggcagaatgagggagtgagggaaaagtaaaaccaaaccctttagcttggaggttaggtggtttactgatagaatgtagaaggaaacccaggctttacaaggtatataatatagatttagttgggaaaagtttaatctgaaaatgtctacaggaccatcaggtggagatgtccatcatcagggcttgtttgctatcttcccaaaacacatctggaatccagccttttctttctacctccattgctcccaccctagtccaagccacagtcatctcccctctggaatatcagaatagcctcctaactaatttccctttcttccactctgacccaactcatagtctattctccatatggcagtgagagtaatctttaaaaatttaagtaagatcttatcacacccctcctcaaaatcttccaatagtctcctataacaggtagaataaatccaaactttttaccatgacctacagggccctacaagatctggcctctgattatccacctaagctcatttcctacgactctccctttttctcatttaatttcagccacagtggcttcctttgctataatttgtgcaaaccaaatgtgttcccatctcagtgaagagtttcactgactctgtgagggcttccatgagggtctgattgccataaacacaatgcttaatgtccctggtgatccagctgggcgaggtggctcaggccggtaatcccagcactttgccaggtgaaggtgggaggattgcttgaggccagcaatttgagtccatggtgatagttctggaagttccagccccccctggaattatttgggcaggtccaagcaggccccaagaaagatgcaacacagccggccaaagtctagagaagagcaactaaataaataatcaagaaagttggggtgggggccaggaaaccccacaaaaagacatttgaaaacatggtatatgtttatggtttctgccatgctatctcaacctctggtcaagtatcaccttagaatttttttctaggattttcattcctaaggacctagctcccaagtcaattggaagtttttgagtcattgagtctacaattcttttatagtctccagaatgactaacatagggctagaggcacagtaagcatttaatatatgttctagggaccacctgaattgaaatgaaatttaatgggattatatgcaaaattcaaaaaggtaaagatgaaggagacttgacttggcagaaagaactaagttttggtttgacctcaacctgagttgatggaaagactctattgactctattatattcttccagtgcttctcaataaaaaaaaattttgttgaaaggatagaggaatgactaaatatattaatgcaaattcaaacagcattggtagaaaataatgctccaggtcaggtgctcacgcctgtaatcccaacactttgggaggctgaggagggagattcacttgagcccaggagtttgagaccagcctaggaaacatagtgagacctcgtctctacaaaaaaataaacaaaattagctgggcttggtggtgcacacttgtagtcccaggtattcaggaggctgatgcaggaggatcacttgagcctgggaggtcaaggctgcagtgaactaagatcacagcactgcactccagtctgggtgacagagtgagacgaaagaagcgaaggaaggaaggaaggaaggaaggaagggagggagggagggagggagggagggagggagggaaagaaagaaagaaagaaagaaagaaagaaagaaagaaagaaagaaagaaagaaagaaagaaagaaagaaagagagagaaagaaagaaaaagaaagaaagaaagaaagaaagagaaagaagagagagaaagaaagaaaaagagagaaagaaagaagagaaagaaagaaaaagaaagagaaagaaagaagaaagagagagaaagaaaaagaaagagaaagaaagaaagaaagagagaaaccaaacagaaaagaatgctctaaaataagaagcaaaagtttgttgttgttgttttttcattctgttctggtcatttatttggggtaccgtgtctatttctatacactctaaatagagacagacattaccaactacaatgtgcctacgagtggaaaaccaaagttgtgagagttctggaaacaatatcagtcagagtttcacctgatgaagagatgagaaggggacataataaaggcctttcaataattaaagaaccgttgtacattaaaaaaaagaaccgttgtaaaaagggacagaattattttacatagctctaggggatagtaccgggggtgggggtgtggattaaaatactacctattgaatacaatattcacaaactaggtggcaggatccgtactccataccttagcatcacacaatattcctatgtaacacatctgcaaatgtaccccctgtgtctaaaataaaagttgaaattgtaaaaaggaatgggagttatagaaaaacaaagatcatctcagaataaggaggtactttcttacaataattgatatctcatgctggactgggctgactaaaatagctgtacactaccttataatggtctttgattaggcatatcctgctacgattagataaacatagcaggatattgtagaggagattttttcattgagaggaaggttgaactaacaaagtgtttttcaaataagattgcaaccaattagtggggccatgaaatccatttagtgggtcctgagcaacattatttaaaatgaattagaatagaatagaaaatatcagagagcatcacacatagcaaggatgagtgtggttttgagaacttgttttggaaacaatgtttacgtatgtatgaacgtgcctactaggttgcagtgtaacgtgttttttattactgtggattgcaattaaaaaaaaaaaactactgcactaaccctcctccagactgaatatctggcagctctaagaattcttatctctttggtgcagagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaaggtgggtggaataatataacaatatccgtgttgttatagtattccacctaccctgatgcattttgttgtcattttctttcttgtggattttgaggtaacttttaaaagtttaaaatctacaatattccatggagttaaataagacggtaaattatggtttcatctatttaatgcatccattttttttaatgttctctctctgtgttgtcctctctgactgtttgttgctgttttaattttacagttcaacggctttttcaatttaaatggtaaaagccaagttatggtgccatatgtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttatacgttaacgatttcctaagcatttgtgcattttcttacaagttatgttttatcgtttcaagaaatgctgttaacctggcagtattaaaactgaatgagcaaggcctcttggacaaattgaaaaacaaatggtggtacgacaaaggagagtgcggcagcgggggcggtgactccaaggtcagcctcaatgtcaccacaaccgggtacccttagtgacgagtaatcggcaagactgttatcttattattgaggagagagcacaagactcacacataaagtggaatgaccaggttattcccctgcctggcagctttgggaaccaaaaagactttagggcactgcccacatttttgatctaacttgggtcccttcttcaactcccagacagaggctccaaccacaccctttcccttcctttacccaccagtttggttgccttatgaaagccatgatgtgggtttcaatgccctaggctttcaagagtccaaggctttcctgtgagactgtccccgcctgcctcagttgagtggtatgaaaaatcagatccatctactgaaaaatcagggcatagccttttgttttctaggttgtgatggttgctcacagaggttggttggttgagtaagggtggcttcttcaattatgtgtctgagtgatgagatgttgttctctatatgtgatagcccatttaagcaggccccacttaacttgaaagccaaataacaagctcggtttcaagttaaatggggtctttcttcaataggccaccccatatagagactttgcagagacattttgtgtatttaagcaagtgcgtcgcctaactgtgatactatatgtgtgtatgaatccctgatttagcttctccttagccatgttcttggttcaggtaggtctaattgttatccaggctgccatcatgagaaaacccatcttacttggcattcctttgacttctaatgctctttggagctagaatgaatgaatagccatcatccaagcaacaagaaataggggcaagctcagaagccgcgatacaaagtcatggaaacacacttcgggtaagtacaggagaggacctgaaaatagaatcctccttggcccaaggggcatgagaattatattgaagcatgtaaactcacctcttgtacgaccaagatcccatgggcatcttaaggtgaagaacagtgtttcccaaccacagaccaacagacaggcaagccaaaacttttcttcttcagagacaatggttgcacttctgctcctctctttccctctctatccctcaggatcctgatggaaaagttagtttgccagtctgcaaatataatatgggtttggaaacactgatccagaacactttcaaagaaatcaattttaaaagaactttcttcagcaaataatcttaccaggcattggcatggccttttatcgtaaaaccttgattaaccagaactcacctaaccagtaccccaactaactgaattgccccttcagtacttcacattgatgagaaagcagcaatagtattccaaaaaagaagactgcaaggaattgatttttttaaaaaatacttaccaagagatgacctatggttgggtcacattcggctctttctcctctatcttctctccatctggattgaccctcaaacgttagaggctgcttccctgaggcgagaaagtagatagaagcattttaagaaaaactgttattagccaacaatgaacaaaatggttgttcttattgaaaattccattcatcccttatggattccaattaatcaaggttttactatgtgtcaaaaagcagtaactttctttcccaccaatgtgaactgatgacactgacaatttagccaagcttttggctcatttcatatttacaatggccaacttgatggccaaagtatttagcacctgtctttttctcatgttatttgcacggagaacctaattgtatcattgaagtgagttgcagaatgaaaattgagctggattggatgcattgctctcacgaattcatcattcatactcatcatggttaaaaaggagccatggactgtaacaagatgactctaaaacatccacatgatgccaagtgcccagaagttttcagataaccagacgtttgatgttatataaacaaacaaaaaaatctgcacatatttggctgactttttacttttcacccagatgttttggtacatgaagaccccaaaactttagaccagctattttttcattacaaccagcaatcaagctttttttccctcagctagtactgctgcaaagttttttatcaagtaactttattgacagctcacgatttccagattatctgaattttgatatgcaaatagaaaaatatttcagtagatcctaaatgttttcaacttctctaaccatagtgctacctgccaggcatctttcaaatcgctttccttggtcattcctacagccagtcttttgaaataagtcaacccttttctcaactatggataatagtatgatcgatcagtgctgcatacccaacgattgcttattccatttctggattaccaagaagcttgcctttgtcttcttccttcttgctacctgctgttttctgagagtgagcaagagaaggggcaagagatgaacgtgaatctggttaccactacgtattagtgatgcaaaaaaaaaaaatcaatggagaaggaggtagaaatagcagtaaaacctcattaatttgaagccctctaattaataatttgtgataaactagacagggaccagtctacaagttaactttatattatcaggcatgaggacaagaaaggtttgttaagcaaatgaagagtttagactggaatgtcagttgaattttttcttaagagaacaaacccttttcaaatgttagaagcacttattagatataatcatattcgttacatatctataggctaaagtagctctcacgaggatctccactaaggcaatgttttatagtcagtttgaattacaaaatagacttaaagtaataaaattgtcattctttaaacctattttgtaatgcaggacttgctttactcattcagacaatcctttccctctgttcctccaaatcagtgaggttttactgtattagcaaaatgacttgagatttacatctcttcattgtgtcccatctcgttaacatgaaaattgactgttgaatataccatcatttcacagagaaagtgcgatccagagatggtgatgactttgagaaggtcacacagctaatgctgtcataaatctctgctgactttcagagtcacctcttgtgataatattgcagatggcaatttagcactaccacctatccaatgagcaatgtgaatctgattgcaagcgatatgtttccataagaatcaggttcattcgcaactaccttggttactaggcaaaaggcatatttaagctgttccagccctcagtactgattactaaaaatgacaataatcacaacgcctgacatttataagtgcttttactttttcaaaaacactttcagacctattatctctgaaaccagaagagggagaaatacctgtatcacttatctttctgtctctctctctctctccaacctttaactaatgataaatgggcaattatattaagtcattgactttttcttccctggcatgagacattacacattctgagattagtctagaaaagttaccatactatggaaagaaacagcaaattttcaggctgtcgtaaatgtgcatgagcttaaactaataaaactaatgttttattattttattttatttttatggatacagggaattaaaaacaaggtcagtctctgaggcagcccctgaaccatacctacaagctgaaaccagaatactccttggctttcccaatttcccaaacctgagctaataggacctaaacaaaacagacttgatcatttcttgatgaactgtaaatgcacatgcaaggatcatgtaaattagaactgtgctttgggaatttttaacctgcaaatcacccttttgtgttcatgctttattacaatgtgtgtgcagatgcagtaattaagagccagtaggttgtttcagtgataaacccagatcaccagggatttgtgacatagccagtgaaagtctatcattgtaaatcacagcagaatggaggatttatgtacagaactaccacataggcacatcagcctccttctgcagctgcctgtcccctcaaaagtttatgttcttatccaccctacttcattcccttaatcttgggtaaagggcaccagcttcgctttcccatctagccttaccttacaagatagggtagggtcagtgaaacgagctatttgtgactgaggtggaaagttattaacaaaccctacccaacctcaccacagaattataccagactttagtcctctctagggattaaaatagactcccagtttccatatattccaagatgaaaatcagcacatgtgtgctcttgggaacattgtaacaatatttaaagggaccattctgagccccttgactgcaatgataattgtaggataggtgggtgccttaacttgagaggcatataaggaaatgagggaggaggatgggatgtgcaattgaacctccattatttaaataaatggtaagatgctcattatgacttatagaatattgatagagaaatgcagttttactatatcttcaaaaatatataggaactagaataaactgaccaatgtgatgctaggaaaaaacatagggaatttgtttaaatcgtttcaaaaaatgcctgcaattaaaatcagtggtgtttcctttcacatgggtgctcttaaggtacctaaaaagagtttgttctctgaagaaattaaaacatgttcctcctccctatcactagctatctttgtttttttaaatcccatgcatttgcttagcaagtcttctcttcaaagatagtaaaaagttacactctcggacagcccatttccaaaatccctcagcttcatatttggtggcacatagatgaatgaggttatactgtatttcccattggtatacatgagatcttcagttttgtgtgtatttcttcttcttccatgtatgtctacaattctcctctcctatgccaccgtctcttaaccacttctcttccacacccagaattctttgactttcttgggccgtgggtaatggatatgaatctgcatctgcctttgcctgcaacaaaatggaccttttattggcaggagccatccctaaaggttgacatttcggatactcagggttaagatggatcccaatgactctttattgacactgttatgtgtgtaggcaagaatcattacagatcgatggcacttcctgggtcttagcagaagttcctgtgaatcctcaagactctggtttgggatcgaggagtagggtgagtatattgtgctcttcgttggtttgcatgattctatgctggtactgcctcctggaagtatgaagaacctgacagttttctttcctggtagtcactaaatttgctccttgaacttactcaggtcttcctcccaagagcaaatcctcactttctctcaagtgactgcttcaagcaagggacctgttgccttaagaactgaaccagtccaatggctgccaaaaccattgattttgccaaatgatattaaagaataaattctaccaccggaaaaaaatgtaatccagaaagaaaacacttttaaaaaataattccattctaatgattttttaaaaaatgaactatggccttaacatggtttctatgattaggacattattatttgcctttggtgttatcctgataacatgaatgtgtttcttattgacaaataatgaccaaatgtccaacaccagagctacagaaagagccacaggaatgaaaagcctgaaggtaagaatgctgttatacaattgccaagaggaaagatgccattgcagtggcagacagtgaaatggtgtatgtttattccctttctgccctttgaagaccaaatcatttggtttcctttcatttgaagagaaggttatacacaatctctgaaaggtaggacagccatggaaaagaaacatgaaaaatttgatgcaattgaaatatatttggtgagggtgggagttggggttggtggaacagggtgggggcaaatttcttttacgaacaattgaattccattctcttttgactttctagagagcggtatagcatttggcccttggcacatgaggctgatccccattgatcagaagtggcaaaagtgttgtccaagtgctggattcacctttttgcctaatttcatctagcattgaagcaaatgtttttcaaaatatatacctaaggcaatggcattcatatatatatatatatatatatatatatatatgactatttgtatgtcctgtctaacatcactgctggaagggcagatgtgatgtgtagatgctagaatgtatgctaatagagggtggtatatgccctggcatggcaaacagatctgatttcagatctgatatatagacttcacttgttgcaatctagctaaaactgattatttttctatgagtcatggtcaagggatggctattggagaataaagaggatgttggcacccatcagattgaactctcaatgcatattttgtctaggatcaggggaatgagttaaatgtcttcagaaacatacatcatgtgagtttctggtaccgatctgtttctctcttctcattctatgcttctctaggtgccattggaatgaactaaagaaaacacacttatatatgataaaacccaataaaatttgatagtttgatctttcaaaggatcttaaaccagagttttcaagtgaatcatgccaattatgtatttgagaaagtgtctatggccatattttgttcaaaacttagcattttccctgagccccttctctctgtcagggataaattgagtaagaggtcttcccagactattgggttcaactactagatggagaagttgaacagaggtccagtttggcagtttagtagaaatctatcagtgaaatacacaacctatggaatcaaggggtctactgctctgtatttgagaggttgtaatttagaaatgtcactggctttacccatgtgtgtaagagttgcttctggggctgctgctgcagcatagatgctcatcaataggtttcaatcactagcattgttaggcccttagtgaaatgactcacagctttcaactcttaatgttatatgcacgcattattgaattttctctttgcacttatattaaattattatcccaatagcaaggagttaaataggtttgagctatatttgtgaactacatgaatataaatactctctcagagatggtttctagcagctaagcactgcataactgcaaatcattgtagctgcccttgttaaatgaggattatttaggttgccagagttcagtaatgccagcagccatatatgcacatgctcccacgttgtacagaaagcccaggctgatccaaggatagaaggattgaaataaaatcctcattttcctggaatcctacattcaggaacccctgtgaaaacaaagggatagagatttgttttaaaggacttcagacactggtgtactcaagggcatattctgaactgccatggccttaaacagctgctatatggagagataaatcccttcattatacatatcccaggttaatctacagaaaagaatgtaaagtaccacatagtaaattctttaatacagcaaatattcttcttttgcttgatcatcaattggcttcagctaaataaagcaagaccaacctgggcagagatgtctgtgactgcctgcctgtacatgcctgttatgtcctgggtgatgctggggcttttccagagaatgctagagaagcaagtgagtgattgggaaagatgctttgccatcatgaaaacctgaaacatcttcagtaaaagagttagcaaaagagaggatggctgttctccctccattgggccaaagacatttctaaaaagttgttcccaaaagatcactagataccaagaagcaggtgttagtaacttagagcaagggtttggttaagggatagggtgagggaggggcttccagcttaggccgtgataagtttccattctcgtcatccagataatgtgttatcagagcagatttctaattgactatgcaaatgcaccacccttgctcatacatttcttttacttctctgtgatctctttgtctttctccataacctacatatttacacatatatctatctctcctaagggcaccattgaggatcttctggaataattaattaaacagacatttgctctttaggtgtccctgctctgaaaggagaagtgaagccatttatagtagtatatatcccatagtatttcaggggactaaatcatactacaacctgggttctgatatttttcaggcccagaaccatattgacagtatagattcctctctttacccttccaggatcaccagattatttcacagaatcaacttggtaattaattgacaagacccaattttccttcttttcccctaagctcagcaccctcatatcactctcttcaccatttctttgttcatgataaggaatccaacctggttctaagctactatttgctatttactattttaggtatttcctgaaattaaaactttaaaataaattaagcagttcttttgaaatacatcaaaagttttatttattttgttttttaaaaaaattaagttttggctgggcgtggtggctcacacctgtaatcccagcactttgggaggctgaggtgggcggatcacaaggtcaagagattgagaccatcctggccaacatggtgaaaccccatctctacgaaaaatataaaaaattagctggacatggtggcatgtgcctgtagtctcagctacttgggaggctgaggcaggaggatcacttgaacccgggaggcggaggttgcagtgagccgagatcatgccactgcactccagcctggcaacagagcgagactctgtctcaaaaataaataattaataaaaatttaaaaaaaaaataagtttctactttcacagaaaaaaaaatcaatggcattcttatcctaaagctgtctccatatgtaaggttggccatcactaagataacattgattctttaaaatggctggttggtacaacccaggaactgagcctggaatccaggagaccaccagctggcaggtggaggccttggattgtgagcagtcttagtagctgagttagtggcaggtgtggatggtagagataagcagaaatttttataatccaataatgttttcttcaaaaaatgaactcattatcaaagtattatgaattacattactatcctccatataaaaaacagacagatgtaattccatgactgttccccacactcaggaatcatcactgagacacaattcagcattaacttcacatacttttaaatgactatctaattcccatttctctcactctctccatctgatcagcaatccatatgcatttttatgacttacatgccacaaaatgttttcttaggggaaccttacactcttccaccccacctcaaacatttttttagacaaaatagaacaaagagttgtagtttataaatatttactctttgtttcatttcccatttctcagaaggatttgtattttaacaaatcatgtcacttgaagatgtgaaattctcacagtggaatttcagctgccagtgagataaatatttttggatggagggatgttcccagtccccatgaaattatgtcacaaagcactcctgttttttccctaagcctgctgactcatgtctttgtcttaagacggctctactcagcaaaaagttcatagcaagcccttcagaggggagagtgcctgactaatttccacgataggaatctgacctactttgtttaattctttctgttctctattgaggtgagtacaataaatatttctgacttataattctcttaggtaccagttaagggcctgcagtaattgctgtgaaacattacactggagacattgctgcaccacagtaaaaggccccagctgcaaaatacacccttgctagattgatagttatttggagtatgggggtccctaaaggaaaataaagtcatcacaaatatctaagcttgaagagcaaaaataaagagggatgctacccttttgtgtattccattggagaatgtacagaacacagctcaatgtatattaattggcctcttgacccaccccataagttgctgcacaggtttgtgcaaattgcttaacctatctgtgcctcaatttctttttgtattaaatagacaccataaatctaccttcttagggtgatcattaaacctgaacaataattataatcataataataagtatgtaaatatactagattgaaaaacaaaatactaaaagagttattgatttgacaagtatttattaagaaaaatatcctaaatggagatacaaatacatgagccatattccctgcccttgagaagcacacagtgtagtgggagacataagacataggcataaataataaggcaaggtagaagtcatggaagagacagaaaacattgaagagcaaaaatggcttcatggagaaaatgacattcaaaatgatcaaatgcccacctatttccacttccttcaaaatacctatgtgtaagagtgtgtgtgtgtgttggggagagggtgtcaataccttcagttggttaggattgggctaggtaacacatctaataaggtacagtaagaaagaaaactatgtggacaaaagcagttttcctctgccgtctcagaaatttagtctaccccacagcaacatagagttctaggagatttggattttaaagtactttcttttcttggcatctattgtaaccttgttaagtggtattatctgtgatttctgattacagcttttatgtttgttggctgtgctgctgcttgaaatgtttgtttttctccctcatttttatttagaagttcccaaaagcacattggttccctgccaggtttcataaaccctgtgattatttttccgatccaaggctaaacttctaagagtaggtcatttgtcaaaattctctaaagtcctgtggtatctcacaggaggtctggatactcaaaggcagcatttgttgcctgtagcatctcccggccccgacccaggtgtgacaacaaaaaatgactccagacattgccaaatgtcccctggaggacaaaatggcctctggttgaaaactattgctctaaagtaacctacactgtaatggtttaagccatgggagtgaaaagcagttactagccagttcgtggaagccactagatggcctaaggcagggataagccattgttcagaagtaggatgctaagtcaccgatgtactgagcctgggttttggcaagagtggacagtggcagcccagcatggacccctagcacaagaatagccttccctcctccaaaacctgtttctgaaatgctttgtcccaggacttctctacattcttaaaaatgattaagaatcccaaatagattttctttatgtgtgttacatctattcatatttaccacatcagaaattaaaactgaaaaattgttcatgtattcattgattcattttaaaaaataataaacccaatatatgctaacataaataatatactttcatgaaaaataactatttttctaaaacaataaaaagaatagtgagaagaatggcactgtctatatttctgtaaatctctttggtatctggtataatacagagaatgagattctcatttctgcttcttcaatcaatctattgtaatttcacccatcatatggcctccaggaaactccactgtatatcaagaaggaataatagtgagaagggcacttagcattattataaaaatagttttgacctcacagatcttttgatgaaagggtttcagggatcctccgggggtccctggaccacactttgagaacaactgctctaaactgacatgccacacttttatgaatgtagttcacttaagggttgataaatttcttttgaaactaggatctctaggagcagtgaaatctccctattagaccttagtgtgagtacctttaatcagactgctctgttcctaagatctggtgagcagcagtactgaagaaactgaatgacgtaatttgaagaacatattaccgggagggaggacaggaccgggtaagggcttagtcaggtagcagtgtgaggacactgggccctttgcaataagaaaagaggaagcacagaaaggaggaagaatttgctttgtagtttctcctgtggtcctgatgagcccagtcactcatatgccattggaaagcatcttcccctgtatcctgagctaattgccacattgctgagcctggtgccactgcctgacttaaggcatagcattgcaggagaagtggtagtgatgagacaacaacagggaagaggaagagagagaagagcatcagacggtggagaatagaggagaagacagtgccaacactaaactcagggccatcgatggcctgtctgtcatttgaaagcctgacttaactttcactgccagtaatatcttaaagaggctcaaagttttatttgagtatatttttgttgctttgcattccaagcaactggttagcatttgagaagcctggggttccgagcattggttgaaggaacttgtttaaagtataaaaggatctcaatttcctagtgagatacaaaatccaaatattctggctgccaggtcctacgctaaccaagaaagttacctccctgatattaaagatttatagttattcaaaccgcaagtactctgaaattgcattatttttaaatgattatatctttctcagactatctgaagataagatagcccctctgttttaaacagcaaatgagggaagaaaggaaataggttttgggactttgtatgatagagaccagatctctgtgactatagcaagtcttattagtgactggatatgttagtgggtccaacttatccaaaataggctaagaaatttttacagcatgttcacagttccataaatttttctgctgtcctctttttaagttagtgacattcagaccaacatgcactaatatttggcaatattgctcccatgaatgtgaacagacagtttattgcctcagaattatgccaccctctctacatggtgcattttttatcccaagtcattaaagattcttcatttaaaatctaatagctctagaaagaagacaggataaaggtcattattcccattttacagctgaagaaatttataagggagaaaatctttatcctagaaccagtagggtttcgggcacttgcccagtggctctgaatgcagtccttatgttttaagcagtgaaggactaaggagcagtggcctggcctcctggggatatgtactagcctcttagttgaggaagtcttatcttactagaacaattaaactatttctctacagcgttacccaacagtggcagagtcattttgctggtttaggccctgccatattaataatccattttgaaacaatctggtttgccctctggtgatctaagttgaccacagacatatggccatatcagaaggacagccaatcagtaactcaaaaacaatccatagaccagtttttacattgttgaaaatactccccttatccaaaacagaggtccacaatatacctttaatactaagaccagtatgtgcataagaatttcgactacatgtttgtggagtaagaacatgtacgtggtacagttctttctgagatcattttcagctgggcaacagacttgtgtgataaaggacaattaattagaaggcatgttatttatgtagaatctattttcaattctgttcggatttatccatttgtctcggtccacaatatggaaacacttccccttctgggtctgtccttttcccgactcctccataaaatttgctttctgtctggaagtacaacaagacacccagttagatcaaacttaacacatctccttcacaaagctactgcaagctgccgccgacgattgtcacctgaggggagaccctcctcaccacacacaacctatctgaggagtgcctttttttctatcctcattatttaacagtgtgtgccgattactcaaagcgatatgggcaggccctggtaaatatagcgttgctgtagtgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctaccctaaaacggctttccttcccaacacacactccctgacacagtgggacccctttataacaacagtgctaaaggaataagacaaatgccagcctcagaggcctgccacatgacatcaattgttgactctatagaacagttatgatgattaggaaactcaatctggcctactgcatttccaaagttataaaataatgagctgtgttataagggggttttactgtatttcacatttcaaaagttcaaagagaaaatataataacaataacaacaacaacaaccaaaaaaaagaaagatttatttgtgacagtactttctcttaacctcttacagtgtcagagactttgtagttataaatgcatttggttattaatatattatgtcaatcccatctgaaaacagtcaaacgaataaataacaaagactggtctctgtaagcagaatgattagcctcctgccagctgctgttgtattgagttcagcattaatttggatctcgaatctcattaagtctgtcacacttctctcttccaaaggtgtcatttgaatctctgtacgtaatacttttaaaatttagtcgcatgctccttaaaggtatacatcgttaggataacatcacattgataagcatgaaacactcttccccgcctccttcctgccccccttcgctcccctaagaaagttcttttttagtttcaatttttgcctttcctttttttggactaatatcgtggtatcagttaattcatttcatgaaatgccactcattttccccgtgcaatgaaccattttgctactggttttctacatcccacatcagggaattctataactcttgtgaaacttaaataatacatggaacttgaaactgttcttcttgtcacagcttacatgggttatgtcaaaggacctctccccccattaaatatcatatacatataaaagtctaatggcagaggaagggttaccagaaattggtctatttcccaatggactgtggaacatccttgcagatagcctcaccagtctccttaaagagataatccaatatttcatatgtgacagaaattattactacttgtctagctgtcattcatcctaaaagagtgactatttgcaaggttgttgtgaatatgaggcattcccacaccccgtttctgaatgcaattcaatttcaattggaccttttattaaagtaaacaagtataggactggcttctatgaaaatgggataagaaggacacggccatattgtctttacttttaattatttaaatgataccaagaccagctgaactagagtgttaagtgtcagcaatggccatcatctgtcactgtgttgtcacttaaataagatgctcaaaattcactggcttaacaatttgggtattccattcaattacattcagcagcaaaatggttacataccctctaaaaagactacaaaatgctattttattttatttctttttcaaagaaagactcctggcccttggtgtgtcctacctcaaggtagggctcaagacaccaacttttttctttccattgttcagcagttcagattttgctttttcatacaggcagatagcttagtcagatttgcacagtttgacctgaaagtcactgaccggcttcctcaatttttcccccttgttacaaagaaagcaaataagtgtaatttttaaaaattattctctacattccctggagtaaaagttaaaaatgagctggatttttaaaaaaatcatcagcctcctggaaaagctttctgatttgtatggagccaatctaggacccgatggatcctctgacactctccttaaactctcaggaaaatggaacggagccaattctttgtgctgtgcccttgttccagcaacacaaagacttgctgccctgattttaactaggatgaagatttagcagccaatctccaaagggagcattttctcagccactaggggaaagaggagagttaaccctttttaagcaaacccttgcaaaataactcctcagagaaaaatagcaggaacctctaatattatcatgtcgtatcttaaagactagtcgttcacaaagtttgtcacagggagagcaagggagaaaggggtgttgcggggcagagaggggaaagagtgcttcaagttcccaaatgaaaagagtgttacatttatagagattatgtcaccgctcaactctggcaaatggtgtttatcaaggctggcagaggaataaattatgcttgtgtttactcttttgttcccatggccaagtgctgttttattaattgttgaacaccattttgaggcactaaggaacgtaaggagtcaagatgaaaggacatttaggtgaggatcaagactgttaacagaggcacaatctaccgtcttgctggtcattgcaaaacattagccagttgccagaattgagtcataacacttacatcaatgtttagttattttacaatttagaactcccctgtactgttgtaatatattataatgttccattgcctttgttttccccaagatctaatcacgttgttcatttctcttaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggggtacggttaaggtctagtaaactaatcagctttactttactgtatgtcaatctctttttttcttctttttttttttttttagtttggtttattgttcaaagcattgtctctttgcaaccatttgattctttgaaaacaatggttgtgctttcttgtcaggcagtggtgcttttctaatagaatggttgtaattaaattgtggtctgtgacccaaaaggaaatacaattctccagaacatcattgttcaatagaaaatatatgcaagccacatacatgagccacgtgtgcaattttaaatgttctagtagtcatatgttaaaaagtaaaacaagtgaaattaattttaatgatacattttatttaacccaatatatccaaaatatgatcctttcaacatgttatcaatacaaaaaaaagaatgacaaattttacattcttcacgctaatcttgcaaatctggggtatattttatgcttatggtacatcttgactcatactagttacatatcaaatgttcagtagtcacacatggccagtggttattgtattggacaatgcatctctagagaaagcagctgctctggaacagatattaaaattaggggccgggcacggtggctcacgcctgtaatcccagcactttgggaggctgaggcgggtggatcacgcagtcaggagatcgagaccatcttggctaacacggtgaaaccctgtctctactaaaaatacaaaaaattaggcgggcatagtggcaggcgcctgtagtcccagctactcgggaggctgaggcaggagaatggcgtgaacctgggaggtggagcttgcagtgagccgagatagtgccactgcactccagcctgggtgacagtgtgagactccatctcaaaaaaaaaaattaggtacacaggtgaaacactgccacctcaagtaatacagcacttccatagggagaggtggttcttttaagtaaacagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccaataattcagaatgttcaaatgcaagctcgaattagaataatgtctccattctggacgtgtttaaaagaatatagtcttgttactttaaagtgcatctgtcatcactaaaatgcctatctgaagtggaacagaacaataagcaacttcataccccttattttaggcaattttgacctcatgagtaaatgtcaatatgctgggatttctacaagtgcatttgtgttttgttgttgttgttgttgttgttttgttttggggtttttttggggggtgttctgttttgttttgtttttgaggcggaatttcactctatcgcccaggctggagtgcagtgacgcgatctcagctcattgcaacctccacatcccgggttcaagcgattctcccgcctcaccctcccaagtagctgggattacaggcacttgccaccatgcccagctaatttttttctatttttagtagagacagagtttcaccatgttggccaggctggtctccaactcttgacttcaagtgatccgcctgcgtcagcctcccaaagtgctgggattacaggcgtgagccaccatgcccggctgcatttgtgttttggccttcttatagttcacactgtggatttacatttagccaatttttaaataatatttcattcaaataaatcatttgtcttggtcatggaaaacataattttgtccagtgaagttgctggttgttccttcttcctgccttttgccacaacatattcagcacactgcaccaatccgctgacagtgttcccattgcattggtggatgtacaatacatggattcatctgtaattgcattgtttgcatgcaagcatttaatgtttcaatgtgcttaaaatgttttactcttgagtaggtgccataggcccattacaatttggggcatatgtttttataggataatattaatacatgattcataatccattttcaaagtgatccactttctttctgtagcctacacatagacaggcttgctggacatgagcaatttcaatctaacttaattatcccaaattttgaggtgctggcctccaaataaataatacacctgaaatttgtgtagcagtcatccaagtgttctcacatctattggctcatttgagataagatggatcaggcaattatcagtaagacccagcccatgaagtgacttactcaaggcaacacagttaggtagtggcagttctgggactagaacccagcccttcttctgcctatagccatatctttgctaaaccatgctacttctaaccacccatggcctgatgtcccccaggaaacttgaaatcctaatgggatcctgtcaaatggagagcagatcttgagtttctgttccacttgtccacaaaaaaagtcttgagaaacttcaccaagcctccatatgccccattccttatgcactccacacaagattgaatattcaatcactcctactttccccagaaagaatctttctgaaacaggattacatcaaggctcagggtcacatgacctccagactctttatcaacgattccatctgagaatttatgtccctactatccaattactatagcctcagactcttattaaagccccagagcagtattcatcaaacattagtgtgcatgcaactcatgtgggaaccttctaaaaatatagatcctgatccagcaggtctgggatggggcctgagggtctagatttctcacaaactcccaggtcatgcagatgctgctggtcccaggagtagaaagattctagagaaaataaactcagagaatgtaacttaagaaaagaaaggaaggaagaaaagagggatagagatacaggaagaaagaggaagaaaggaaggagggaaggaaggaaggatggaggcagggaggcagggaggggggaaaagaaagaaagagggaaggaaggagggaaggaaggaaggaaagaagaaagggagggagggagggagggaggaactgaaaggaaatgaaaggaaagaaactgggatcagcaaacctttgttaggacataatgttgccatccaaaagtggcggcctggaacatcaaacctgaggggaaagtctcagaaactaatatgccacaacttctggctttcctttactcatctgagttgatccacttttgtgaagcaaaattcaggctacttgaggcaacactcacattttaatagactcccatgccagtgtggttatagcccaattacctagcaccttggcaaccatctccagggtgaaagaaaggttgggaagagcatctgcaaacaaatctgtcctccaagcctgtacaaagtctccagacaagaagcaaaagcctcatacgacgccaggaaaacctcacttgtgttagtcaagaggcataaagcaagctgctttgaaacctctctgttgtcctcagccaatttggtgatgtgattaggggaatgttggttaagtgaagagtgagatcttcacccactcatcttttatttcccaagaaggtctggaatatctcctggtgacttctaatttgttacctagttattaggcttccagttctctgagttggcctaaatctgtcaaggtctatccaggggcaccgacatcaagaggtaccctgagattttacttctattactaattatcagagcccaccttgggagtttatagtaccagtaattgttcaggaaaaatgactcagggcaaatcacctgcaaaaatgtgatctagtgaaatctggttaataaaagggcatccttgaaagatgagggagtcgtttctcattttctatgggtgatagtcacatcaggattactgggcttattgtgggaacatgtgcctcggcctcagatcatgtttagctcccactagggagcagaaagcctcttgactacctggtgcctctctgggttactgaccagccactggaagtgtatcctcccaagcatgccttggcaggtgactgcccatcaagtgctccagattcactgcaccctagggttgactgtgctaattgttttaggaagttatttctcatttcctaattgcagttcagaagtacttctggcttctttggtttcttcaaaaatatttttgaaatctctgtcctttacaagacctcaacatgcctgaagttaggggaaaagattttcatttttcttgtaggagttttctgtttagtcatcctaaaaatattagctttgtggatgcagcccattttcaaagtgatccactttccttctgtagcctatgcataggcatgcttactggagacattttgctgctgaaaagaattcacgttatgttaagtatgaaaaaaaaaagcattctggataaccaaggtgatgatgttctttctcccaagggacttttacatcagtgataatagttcatttgaccccatttaaaagtggaaacagaggcactgagaggttgggttcctttcccaaagtcatgccactagttagtgatgtcccatgcccactggggagacagggggagactttattctttctgccagatacaaaacttctccaagcttctgcgatacatatgactcaggacttaggggtgccaaggaagaggtttgtctactttcatgttagtcttattctaccatccttggatgcttttggccttcaggtgcatatttgacattcttcttacagatacttttactacagggccagtggtagatcataattacgtcattcttttgggataaaattcggtgttagcttagaagaaaaggaagtgtttcattagtgcagaatgaaaggataaagagagggatgtaaacttgaagaggaggtaagaaagtgtcctacagtattcagaatcaggggcaaatgaatcccctgcactagttagtgcctccaaaaagaagacactatcagcatttcaatcaggcctatatgtcagggcaaagaccgcattgatgccaagtccccttcatgggtatcactgctctggcctcttcctagaatctgctgtctctttaaagtcccagagctattttcagactttaataactaaggttgtaggtactaagagaaacaattgctcacttttctagcaataagcaaaatattttcttctcacagttaaaatggatttcaattcagtaagccatagaacactgtttaccctctgtcctgggtgaacaatcctttgtcatagtttctgcaatcagaatacactcttttagttcttgtgaatatctgtattaaaatgccatggaaactttctggtatacctacatcataagtgattaaagccttgaattaaacttcctgcaacacctgcatattccttagtacaatacatatagtagagaatgtaaccagacctgtcacctaaagccagtcaaataaatgaggtgcaaccccagaaatgccaatttcagaaaacagccatagttttgtccaagatagactgagccattataaacttctcaattcctaataggaagccccttcaaatttaaatatccccttgcctttgcagatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgtaaagaaagaa

SEQ ID NO: 453 - DNA, 306671 bp, Homo sapiens; identical to SEQ ID NO: 452
  source 1..306671: mol_type = genomic DNA

SEQ ID NO: 454 - DNA, 20438 bp, Homo sapiens
  source 1..20438: mol_type = genomic DNA
agagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaa

SEQ ID NO: 455 - DNA, 7486 bp, Homo sapiens
  source 1..7486: mol_type = genomic DNA
ggctctcgtggaggcagctagcgcgaggctggggagcgctgagccgcgcgtcgtgccctgcgctgcccagactagcgaacaatacaggtacgtctcgcaccgcccgctcccgccgccgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtgttcagcagtggtaagagttgttgtttttaattgtgttaacagttagcagatgaccagatagtcttaagtcatagatttcaagcttctatcacccccaccaaatgtgtcctctctctacccttcccactttgtgattgtagtttccaaaacatagcagttctgtaaacgtaacactgagtaccctacttgggtcggctccatttggagcacttgatcgcttttgagaagtaactcgcaaaccagcgcgcttcgtgctggtcaaaagttaaatgacaagcgacaatgaagctgatttctttcctactctgccttctgccactggtgtccggcattgggggaaggggacttcctaacagcaagtgtagttttagttttgctctgcctttggtacgtcttgtacttcttgtcaattcctccttgcttttcctcattgtatttctttgtttctcttttatcacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaaggtatttttctttggtacccttcaaactagtcttagttgggtttcttactttggggttacttaccttcagattttctcccagatagctgcttgcttcctcttttacttttacttagaatcatttttgcttgtcttaagaattttgtgtgtgtgcttttatttttttaaggccctgcacaggtttcaggcctttacctacccccttttgcaagtggttctagcaactgctagtttaatcacaagaaactgaataggtatgtgttcactgcatcgagggatttaacgagtcctgttctttgcagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtaagtgactataggattcaagataacaattaataccttttcttctgcttggaggatttggttttttggtcgtcctgtatttcatttcaaaatgaaatattttttaaaagatacttaaaagatggcaatacctctgcaaaccattctgtacttgggctttacgatgcagtgccagcgttgtctgtggttaaggctgaagtgtttgtgggctgtgcttgcacattcacagtggttgtctgttggcctttccattgtgaaggaggcactctagttttggttgtcagggtccttgaagtatgttctttatgcctttcctagtaattgaaagactgggacagcaccatatatatatgcgcgtatatatacgcatatgtattatatatgcatacacacacacagagcaccatatatatatgcgcgtatatatacgcatatattttatatatgcatacacacacacacgcatacatatttgagatggagtttcgctcttgaccaggctggagtgcaaggtgtgatcttggctcactgcaacctccacctcctgggttcaagtgattctcctgcctcagcctcctgagtagctgggattacagacatgcaccaccatgcccggctaattttttttatatttttagtagagacggggtttctccatgttggtcaggctggtctgaaactcccaacctcaggtgatccgcctgcctcggcctcccaaagtgctggaattacaggcgtgagccgcgcaccacatatttttctaaccttatatattttagaacctacaactttgtagcattgtatatggtatcatagattacttcactttagggagaagtcatagtggtaggagggagatgcttctcaggaatgtgggatttcaactttaactcaaattttttgtggtttctcatgtaatgtatgtaattcttccaaggtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggtaaggtggggctggaagcctggactggtgaacaggcagtggttctgctatcagtaggttgcagggcatgtggcagctttgctgggctgagtacttagcatagcgctcaagggcccatccccctgcaaggtagctacgggtgctggtgttcatgcttttttttgacaggtctttgttttggggacaacttcaggcttgaaaaattttccttactctttaaggaaaaaaaaatgttaacagaggatttgatagtcctactaatgtgacttgaaggacacttgaacacccactaacttttaaattcgaatggctaagaaccaaattcatatatggaaacacttcagatatatatgatagcagcactgtcttacttgatttcaattcctgtcctcttacctgagatgaggactgcatgtttctactttgtgttaaaacagccgcatactcatttgaaatgtgtccctgttcctctaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaa

SEQ ID NO: 456-999 - skipped (544 entries)

SEQ ID NO: 1000 - DNA, 40 bp, Homo sapiens
  misc_difference 20: note = C->G
  source 1..40: mol_type = genomic DNA
ttccccggcccccagccttcctctgtgtccctgtggtccc

SEQ ID NO: 1001 - DNA, 40 bp, Homo sapiens
  misc_difference 20: note = T->C
  source 1..40: mol_type = genomic DNA
tggtgattgcagaaagcagtgtgagcccgactactacctg

SEQ ID NO: 1002 - DNA, 40 bp, Homo sapiens
  misc_difference 20: note = G->T
  source 1..40: mol_type = genomic DNA
aggtgggcttagagaacttgctgtatttcgggacactgaa

SEQ ID NO: 1003 - DNA, 40 bp, Homo sapiens
  misc_difference 20: note = C->A
  source 1..40: mol_type = genomic DNA
ctggccttctgatactaggctgaaatagagaggaaacaag

SEQ ID NO: 1004 - DNA, 40 bp, Homo sapiens
  misc_difference 20: note = T->A
  source 1..40: mol_type = genomic DNA
gtggatcccccgtttcctgtagtactctatgagtggggtg

SEQ ID NO: 1005 - DNA, 40 bp, Homo sapiens
  misc_difference 20: note = C->T
  source 1..40: mol_type = genomic DNA
cagcagagagtctgggatgctgaattcaatcacagaatca

SEQ ID NO: 1006 - DNA, 40 bp, Homo sapiens
  misc_difference 20: note = C->T
  source 1..40: mol_type = genomic DNA
ccaaagacacagtcgtcctcctggcttggggctggggtta

SEQ ID NO: 1007 - DNA, 40 bp, Homo sapiens
  misc_difference 20: note = A->G
  source 1..40: mol_type = genomic DNA
ttggtccagaagatggtgtagtgggtaagggggctcttcc

SEQ ID NO: 1008 - DNA, 40 bp, Homo sapiens
  misc_difference 20: note = C->G
  source 1..40: mol_type = genomic DNA
aggtggccgcagaggaaatctgggacaatgagcttttggc

SEQ ID NO: 1009 - DNA, 40 bp, Homo sapiens
  misc_difference 20: note = G->C
  source 1..40: mol_type = genomic DNA
ttcagggcctgcagccgcgggtgctgcacgggcatctgct

SEQ ID NO: 1010 - DNA, 40 bp, Homo sapiens
  misc_difference 20: note = T->C
  source 1..40: mol_type = genomic DNA
gcctgccccgttgaccggctgcgccgccgacgtgacgctg

SEQ ID NO: 1011 - DNA, 40 bp, Homo sapiens
  misc_difference 20: note = C->T
  source 1..40: mol_type = genomic DNA
aaacccttcccacagaggtcgcagccgaagggcttgaagc

SEQ ID NO: 1012 - DNA, 40 bp, Homo sapiens
  misc_difference 20: note = G->C
  source 1..40: mol_type = genomic DNA
tgggcttcgtccagcgatgggcacattgacttctccgagg

SEQ ID NO: 1013 - DNA, 40 bp, Homo sapiens; identical to SEQ ID NO: 1012
  misc_difference 20: note = G->C
  source 1..40: mol_type = genomic DNA

SEQ ID NO: 1014 - DNA, 40 bp, Homo sapiens
  misc_difference 20: note = C->T
  source 1..40: mol_type = genomic DNA
attgatctttccagagtgccgggaatcagtaaagacttaa

SEQ ID NO: 1015 - DNA, 40 bp, Homo sapiens
  misc_difference 20: note = C->T
  source 1..40: mol_type = genomic DNA
tctcccaactggggatttacgcccatagtacttctgaaga

SEQ ID NO: 1016 - DNA, 40 bp, Homo sapiens
  misc_difference 20: note = T->G
  source 1..40: mol_type = genomic DNA
ttggattgcactttccctttattacttgattctacagaac

SEQ ID NO: 1017 - DNA, 40 bp, Homo sapiens
  misc_difference 20: note = C->T
  source 1..40: mol_type = genomic DNA
gctcaactttggcaatcggcgtttaaggaagtcatgatct

SEQ ID NO: 1018 - DNA, 40 bp, Homo sapiens
  misc_difference 20: note = C->T
  source 1..40: mol_type = genomic DNA
tatagatgacaggacatttcgggcaaattcatcttcctca

SEQ ID NO: 1019 - DNA, 40 bp, Homo sapiens
  misc_difference 20: note = T->G
  source 1..40: mol_type = genomic DNA
ttttcagagacttccttcatataggagctggaggacacag

SEQ ID NO: 1020 - DNA, 40 bp, Homo sapiens
  misc_difference 20: note = A->T
  source 1..40: mol_type = genomic DNA
aggagctggaggacacagcacattggaaatcaagaagaaa

SEQ ID NO: 1021 - DNA, 40 bp, Homo sapiens
  misc_difference 20: note = C->T
  source 1..40: mol_type = genomic DNA
cctgggctggccctcaccccagtcaggaggaccaggcaac

SEQ ID NO: 1022 - DNA, 40 bp, Homo sapiens
  misc_difference 20: note = C->T
  source 1..40: mol_type = genomic DNA
aatgttggctccattgctccaggattgtctgtgacttaca

SEQ ID NO: 1023 - DNA, 40 bp, Homo sapiens
  misc_difference 20: note = G->T
  source 1..40: mol_type = genomic DNA
tacatagcataacctgaaagaaaaaagacatgaatttgta

SEQ ID NO: 1024 - DNA, 40 bp, Homo sapiens
  misc_difference 20: note = C->T
  source 1..40: mol_type = genomic DNA
ctcttcttcagtcaattcaccttggtgattatgtatcaac

SEQ ID NO: 1025 - DNA, 40 bp, Homo sapiens
  misc_difference 20: note = A->T
  source 1..40: mol_type = genomic DNA
ttcagtttgagcaaggggaaattttcgaggacctttaaaa

SEQ ID NO: 1026 - DNA, 40 bp, Homo sapiens
  misc_difference 20: note = C->T
  source 1..40: mol_type = genomic DNA
ttgatcttctgcacccaggcggtcctacgggagaagcagg

SEQ ID NO: 1027 - DNA, 40 bp, Homo sapiens
  misc_difference 20: note = C->T
  source 1..40: mol_type = genomic DNA
aatttcactttttaaatcccggcacaaaccatccagtgcc

SEQ ID NO: 1028 - DNA, 40 bp, Homo sapiens
  misc_difference 20: note = G->A
  source 1..40: mol_type = genomic DNA
aggggcattcctttacaccgcgggtcagatgccagcttct

SEQ ID NO: 1029 - DNA, 40 bp, Homo sapiens
  misc_difference 20: note = C->T
  source 1..40: mol_type = genomic DNA
aatggctctctctctgtttcccttcccagaccacaaataa

SEQ ID NO: 1030 - DNA, 40 bp, Homo sapiens
  misc_difference 20: note = A->G
  source 1..40: mol_type = genomic DNA
cacagcctgatgttcaccaaggtgaagctggagcaggtgc

SEQ ID NO: 1031 - DNA, 40 bp, Homo sapiens
  misc_difference 20: note = T->C
  source 1..40: mol_type = genomic DNA
tgatgcccatgatgcagactctggtaagaacgagctcctt

SEQ ID NO: 1032 - DNA, 40 bp, Homo sapiens
  misc_difference 20: note = T->C
  source 1..40: mol_type = genomic DNA
gctggaaagagcggtctaattgaacgatctgccaaaagaa

SEQ ID NO: 1033 - DNA, 40 bp, Homo sapiens
  misc_difference 20: note = C->T
  source 1..40: mol_type = genomic DNA
gacctcttcacttagactgcggatcttcttttttttcaaa

SEQ ID NO: 1034 - DNA, 40 bp, Homo sapiens
  misc_difference 20: note = C->G
  source 1..40: mol_type = genomic DNA
cgatgcccatggacacgagcgtgtatgagagcccctacag

SEQ ID NO: 1035 - DNA, 40 bp, Homo sapiens
  misc_difference 20: note = C->T
  source 1..40: mol_type = genomic DNA
ctacagcgacccagaggagctcaaggacaagaagctcttc

SEQ ID NO: 1036 - DNA, 40 bp, Homo sapiens
  misc_difference 20: note = C->T
  source 1..40: mol_type = genomic DNA
ggagctcaaggacaagaagctcttcctgaagcgcgataac

SEQ ID NO: 1037 - DNA, 40 bp, Homo sapiens
  misc_difference 20: note = C->T
  source 1..40: mol_type = genomic DNA
aaggacatggagaacaccactgaagaaagaagggggtctt

SEQ ID NO: 1038 - DNA, 40 bp, Homo sapiens
  misc_difference 20: note = C->T
  source 1..40: mol_type = genomic DNA
gcacacttcttttgcagtgctttgttttctcttacaatgt

SEQ ID NO: 1039 - DNA, 40 bp, Homo sapiens
  misc_difference 20: note = T->C
  source 1..40: mol_type = genomic DNA
tcgtccaaaaggatatttatacctgtgtcatgggtttgaa

SEQ ID NO: 1040 - DNA, 40 bp, Homo sapiens
  misc_difference 20: note = G->T
  source 1..40: mol_type = genomic DNA
gcgatttccttcttttgcagctgtgaaaaaatatattatg

SEQ ID NO: 1041 - DNA, 40 bp, Homo sapiens
  misc_difference 20: note = C->G
  source 1..40: mol_type = genomic DNA
ataaaacattaagcccatacttctctggttgcatctgcaa

SEQ ID NO: 1042 - DNA, 40 bp, Homo sapiens
  misc_difference 20: note = C->T
  source 1..40: mol_type = genomic DNA
accacttaatccaataacacgataccatttcttcaaaaat

SEQ ID NO: 1043 - DNA, 40 bp, Homo sapiens
  misc_difference 20: note = A->T
  source 1..40: mol_type = genomic DNA
gagctgttcaactagcagtaccttaaaaaaatgtgaagat

SEQ ID NO: 1044 - DNA, 40 bp, Homo sapiens
  misc_difference 20: note = G->A
  source 1..40: mol_type = genomic DNA
aaagaaaaataagagaagggacaacaaaataacagagctt

SEQ ID NO: 1045 - DNA, 40 bp, Homo sapiens
  misc_difference 20: note = C->A
  source 1..40: mol_type = genomic DNA
gaagcctgctttgcaaaatctgcctaaaaggctagctcca

SEQ ID NO: 1046 - DNA, 40 bp, Homo sapiens
  misc_difference 20: note = T->G
  source 1..40: mol_type = genomic DNA
aagcctgctttgcaaaatctgcctaaaaggctagctccat

SEQ ID NO: 1047 - DNA, 40 bp, Homo sapiens
  misc_difference 20: note = T->A
  source 1..40: mol_type = genomic DNA
ggagaccagttgttctggctggtttacacattggctatcg

SEQ ID NO: 1048 - DNA, 40 bp, Homo sapiens
  misc_difference 20: note = C->T
  source 1..40: mol_type = genomic DNA
tctgcaagctgtagccacgcccatggctgcatcaacaggc

SEQ ID NO: 1049 - DNA, 40 bp, Homo sapiens
  misc_difference 20: note = C->T
  source 1..40: mol_type = genomic DNA
gcattgctgaactcgctgtcgatgctgcggcagttgtaga

SEQ ID NO: 1050 - DNA, 40 bp, Homo sapiens
  misc_difference 20: note = T->A
  source 1..40: mol_type = genomic DNA
cctgaagcctgaaggggggtcacacttcgtccatctatga

SEQ ID NO: 1051 - DNA, 40 bp, Homo sapiens
  misc_difference 20: note = G->T
  source 1..40: mol_type = genomic DNA
gcatatgcctgagcgtttcgatgccttcatctgctattgc

SEQ ID NO: 1052 - DNA, 40 bp, Homo sapiens
  misc_difference 20: note = A->C
  source 1..40: mol_type = genomic DNA
aatccaagtctgccaacttaaacgcctccaggggttctct

SEQ ID NO: 1053 - DNA, 40 bp, Homo sapiens
  misc_difference 20: note = G->C
  source 1..40: mol_type = genomic DNA
ggggcgcgtcatccagattgtgctaatgcgggcagcagag

SEQ ID NO: 1054 - DNA, 40 bp, Homo sapiens
  misc_difference 20: note = T->C
  source 1..40: mol_type = genomic DNA
gataatgtgtggactgcagtttctacacagcaagggcatc

SEQ ID NO: 1055 - DNA, 40 bp, Homo sapiens
  misc_difference 20: note = T->C
  source 1..40: mol_type = genomic DNA
tttttagtaagctcacttgttgtagaactaactttcaatt

SEQ ID NO: 1056 - DNA, 40 bp, Homo sapiens
  misc_difference 20: note = C->T
  source 1..40: mol_type = genomic DNA
taggcctgggcgcaggggactgccactttccatcttcatg

SEQ ID NO: 1057 - DNA, 40 bp, Homo sapiens
  misc_difference 20: note = C->T
  source 1..40: mol_type = genomic DNA
aggcccgggtggtgtgagtcggggtgctgcgcattcagca

SEQ ID NO: 1058 - DNA, 40 bp, Homo sapiens
  misc_difference 20: note = A->G
  source 1..40: mol_type = genomic DNA
ggtttcttatactggctgaaaaaactttgcagtttaacac

SEQ ID NO: 1059 - DNA, 40 bp, Homo sapiens
  misc_difference 20: note = G->C
  source 1..40: mol_type = genomic DNA
agagaaaggttctgttaaagaacttgtcagataaaacatg

SEQ ID NO: 1060 - DNA, 40 bp, Homo sapiens
  misc_difference 20: note = C->G
  source 1..40: mol_type = genomic DNA
gaaatagtgtctttatcagctttgataatggctcttcata

SEQ ID NO: 1061 - DNA, 40 bp, Homo sapiens
  misc_difference 20: note = C->T
  source 1..40: mol_type = genomic DNA
atttacatctgtaagtatccggtcaatgaattgacacaga

SEQ ID NO: 1062 - DNA, 40 bp, Homo sapiens
  misc_difference 20: note = A->T
  source 1..40: mol_type = genomic DNA
ttggcaccatttgctctttatccacctccttctgaagttg

SEQ ID NO: 1063 - DNA, 40 bp, Homo sapiens
  misc_difference 20: note = G->T
  source 1..40: mol_type = genomic DNA
tctttttgcagaaaagcatggatccttgactgcttcaaag

SEQ ID NO: 1064 - DNA, 40 bp, Homo sapiens
  misc_difference 20: note = G->A
  source 1..40: mol_type = genomic DNA
ttcagacttgggtgtaactggatcagattttctggaattc

SEQ ID NO: 1065 - DNA, 40 bp, Homo sapiens
  misc_difference 20: note = T->C
  source 1..40: mol_type = genomic DNA
tccctcacagaaattgttcttcaacaatagaaaaagcata

SEQ ID NO: 1066 - DNA, 40 bp, Homo sapiens
  misc_difference 20: note = C->T
  source 1..40: mol_type = genomic DNA
tcatcacttttcagttgttcttccatcgctcttcgccttt

SEQ ID NO: 1067 - DNA, 40 bp, Homo sapiens
  misc_difference 20: note = C->T
  source 1..40: mol_type = genomic DNA
gcttgctccacacgccccccacccgtcacaccctcggcac

SEQ ID NO: 1068 - DNA, 40 bp, Homo sapiens
  misc_difference 20: note = A->G
  source 1..40: mol_type = genomic DNA
gacacagcttcagaatgtgactccttaaattcttccattg

SEQ ID NO: 1069 - DNA, 40 bp, Homo sapiens
  misc_difference 20: note = A->G
  source 1..40: mol_type = genomic DNA
cagtgtcttacacttagcaatcatccaccttcattctcaa

SEQ ID NO: 1070 - DNA, 40 bp, Homo sapiens
  misc_difference 20: note = G->A
  source 1..40: mol_type = genomic DNA
gatgacattatcaacatgagaaatgatctgtaccaggtaa

SEQ ID NO: 1071 - DNA, 40 bp, Homo sapiens
  misc_difference 20: note = C->T
  source 1..40: mol_type = genomic DNA
ctgaatgccattcatctagccatgatgagcaatagcctgc

SEQ ID NO: 1072 - DNA, 40 bp, Homo sapiens
  misc_difference 20: note = G->A
  source 1..40: mol_type = genomic DNA
aaagagctgcttgaggtccgacacctgccggaccacgacc

SEQ ID NO: 1073 - DNA, 40 bp, Homo sapiens
  misc_difference 20: note = G->A
  source 1..40: mol_type = genomic DNA
gtcgatcctagagggttacgcacaaatcgtcgccggcgcc

SEQ ID NO: 1074 - DNA, 40 bp, Homo sapiens
  misc_difference 20: note = C->G
  source 1..40: mol_type = genomic DNA
taacgattcctttgcttggcttccacaactagaatatttc

SEQ ID NO: 1075 - DNA, 40 bp, Homo sapiens
  misc_difference 20: note = C->T
  source 1..40: mol_type = genomic DNA
tcattctcccttacacatactcaacctaaccaagaataaa

SEQ ID NO: 1076 - DNA, 40 bp, Homo sapiens
  misc_difference 20: note = A->C
  source 1..40: mol_type = genomic DNA
acaaaatctggattccattatattggttttccttgaggag

SEQ ID NO: 1077 - DNA, 40 bp, Homo sapiens
  misc_difference 20: note = A->C
  source 1..40: mol_type = genomic DNA
tgaagtctcgaatcagtgaaattattgacagtagaagaag

SEQ ID NO: 1078 - DNA, 40 bp, Homo sapiens
  misc_difference 20: note = C->T
  source 1..40: mol_type = genomic DNA
tcattcattcctgttagcactcctgtaaaagcaaaagaag

SEQ ID NO: 1079 - DNA, 40 bp, Homo sapiens; identical to SEQ ID NO: 1078
  misc_difference 20: note = C->T
  source 1..40: mol_type = genomic DNA

SEQ ID NO: 1080 - DNA, 40 bp, Homo sapiens
  misc_difference 20: note = T->C
  source 1..40: mol_type = genomic DNA
cagtagtgttattcagtgttatttgtatagagaccatctt

SEQ ID NO: 1081 - DNA, 40 bp, Homo sapiens; identical to SEQ ID NO: 1080
  misc_difference 20: note = T->C
  source 1..40: mol_type = genomic DNA

SEQ ID NO: 1082 - DNA, 40 bp, Homo sapiens
  misc_difference 20: note = G->T
  source 1..40: mol_type = genomic DNA
tgcaaggctgtcttggaaagaaataatgggcagctagtcc

SEQ ID NO: 1083 - DNA, 40 bp, Homo sapiens; identical to SEQ ID NO: 1082
  misc_difference 20: note = G->T
  source 1..40: mol_type = genomic DNA

SEQ ID NO: 1084 - DNA, 40 bp, Homo sapiens
  misc_difference 20: note = G->C
  source 1..40: mol_type = genomic DNA
ggggcaattttaggaactcgttcacagttttctccaatta

SEQ ID NO: 1085 - DNA, 40 bp, Homo sapiens; identical to SEQ ID NO: 1084
  misc_difference 20: note = G->C
  source 1..40: mol_type = genomic DNA

SEQ ID NO: 1086 - DNA, 40 bp, Homo sapiens
  misc_difference 20: note = G->C
  source 1..40: mol_type = genomic DNA
agaagcgatagcacgattggatcagttagaagctgattat

SEQ ID NO: 1087 - DNA, 40 bp, Homo sapiens
  misc_difference 20: note = C->T
  source 1..40: mol_type = genomic DNA
aacccctcaccctggtaggcaatgaggcggcagttgttct

SEQ ID NO: 1088 - DNA, 40 bp, Homo sapiens
  misc_difference 20: note = C->T
  source 1..40: mol_type = genomic DNA
cccccatggaggttttgaacgcactcattgaagagtagct

SEQ ID NO: 1089 - DNA, 40 bp, Homo sapiens
  misc_difference 20: note = G->C
  source 1..40: mol_type = genomic DNA
ccccccagctctccctgcagatcggcgatgtggtgcgaat

SEQ ID NO: 1090 - DNA, 40 bp, Homo sapiens
  misc_difference 20: note = T->C
  source 1..40: mol_type = genomic DNA
agaactggacagcggaggctttgggaaggtgtctctgtgt

SEQ ID NO: 1091 - DNA, 40 bp, Homo sapiens
  misc_difference 20: note = C->T
  source 1..40: mol_type = genomic DNA
tcacctttgtcaataagtccggctaattctacacagtcgc

SEQ ID NO: 1092 - DNA, 40 bp, Homo sapiens
  misc_difference 20: note = T->G
  source 1..40: mol_type = genomic DNA
agtgagtccaccaactccctttgccagaaggttacccagc

SEQ ID NO: 1093 - DNA, 40 bp, Homo sapiens
  misc_difference 20: note = G->T
  source 1..40: mol_type = genomic DNA
agctgaatagaacggggaagtccgggtctctaaaagtgat

SEQ ID NO: 1094 - DNA, 40 bp, Homo sapiens
  misc_difference 20: note = C->T
  source 1..40: mol_type = genomic DNA
tgtggaagcatcaccccaccccagacaacaccacttactg

SEQ ID NO: 1095 - DNA, 40 bp, Homo sapiens
  misc_difference 20: note = C->T
  source 1..40: mol_type = genomic DNA
atatctgttggtcgactttcccctcaacaagaatcttcag

SEQ ID NO: 1096 - DNA, 40 bp, Homo sapiens
  misc_difference 20: note = C->T
  source 1..40: mol_type = genomic DNA
attccgtctgtagacacttccaggtccccgtgtcatcaga

SEQ ID NO: 1097 - DNA, 40 bp, Homo sapiens
  misc_difference 20: note = C->T
  source 1..40: mol_type = genomic DNA
acagccgactccaggcttgccttctccccacactcatttg

SEQ ID NO: 1098 - DNA, 40 bp, Homo sapiens
  misc_difference 20: note = A->G
  source 1..40: mol_type = genomic DNA
ttatggggaaatccaactcagtatcccttctggccaggtg

SEQ ID NO: 1099 - DNA, 40 bp, Homo sapiens
  misc_difference 20: note = G->A
  source 1..40: mol_type = genomic DNA
agggccttgtgaccacaccgtggtcaagctccagccagga

SEQ ID NO: 1100 - DNA, 40 bp, Homo sapiens
  misc_difference 20: note = C->T
  source 1..40: mol_type = genomic DNA
ctgggttatgtggacgaggcgggcactgtgaagctggcag

SEQ ID NO: 1101 - DNA, 40 bp, Homo sapiens
  misc_difference 20: note = C->T
  source 1..40: mol_type = genomic DNA
cagctctgcagcccataagcaatgttgttcctcacagaac

SEQ ID NO: 1102 - DNA, 40 bp, Homo sapiens
  misc_difference 20: note = T->A
  source 1..40: mol_type = genomic DNA
aacttgaaggcgagcgtggtggtgccatgggccatctcaa

SEQ ID NO: 1103 - DNA, 40 bp, Homo sapiens
  misc_difference 20: note = C->T
  source 1..40: mol_type = genomic DNA
cgctgccctcggggggctccgcatacatctagtagcgcca

SEQ ID NO: 1104 - DNA, 40 bp, Homo sapiens
  misc_difference 20: note = T->C
  source 1..40: mol_type = genomic DNA
gcaggaggctttcttctcttgggaaagccccaagctgcca

SEQ ID NO: 1105 - DNA, 40 bp, Homo sapiens
  misc_difference 20: note = G->C
  source 1..40: mol_type = genomic DNA
gattttggcctgccagctggtatctgagcaactgctcttg

SEQ ID NO: 1106 - DNA, 40 bp, Homo sapiens
  misc_difference 20: note = G->A
  source 1..40: mol_type = genomic DNA
atattttgattattagtctgggattcaggaatctcttcag

SEQ ID NO: 1107 - DNA, 40 bp, Homo sapiens
  misc_difference 20: note = C->A
  source 1..40: mol_type = genomic DNA
gacagcaaatggcttggatcgagctgtaaaattgactcct

SEQ ID NO: 1108 - DNA, 40 bp, Homo sapiens
  misc_difference 20: note = C->G
  source 1..40: mol_type = genomic DNA
tagttggcaccaatagattcattcagcaataaggaagctg

SEQ ID NO: 1109 - DNA, 40 bp, Homo sapiens
  misc_difference 20: note = G->T
  source 1..40: mol_type = genomic DNA
cccctaagaagacgtgggggctctggagctcatggtagaa

SEQ ID NO: 1110 - DNA, 40 bp, Homo sapiens
  misc_difference 20: note = G->A
  source 1..40: mol_type = genomic DNA
tgttgatgtcaagttggctgagtgcggcttcactttgtcc

SEQ ID NO: 1111 - DNA, 40 bp, Homo sapiens
  misc_difference 20: note = T->C
  source 1..40: mol_type = genomic DNA
ggagcaaagttgtcaaaggttgctgagtacttgaagtgaa

SEQ ID NO: 1112 - DNA, 40 bp, Homo sapiens
  misc_difference 20: note = T->A
  source 1..40: mol_type = genomic DNA
agtaactgaagtatttgcatcactttccaagacgtcaatt

SEQ ID NO: 1113 - DNA, 40 bp, Homo sapiens
  misc_difference 20: note = C->T
  source 1..40: mol_type = genomic DNA
gatcaattgcctcactcaccgtgcagagaaagagttccat

SEQ ID NO: 1114 - DNA, 40 bp, Homo sapiens
  misc_difference 20: note = C->T
  source 1..40: mol_type = genomic DNA
ccttggtgcttcctccggacgaccagggtctcttgctgga

SEQ ID NO: 1115 - DNA, 40 bp, Homo sapiens
  misc_difference 20: note = C->G
  source 1..40: mol_type = genomic DNA
ttcttatcttccagttgttctgctgattgttttatcttca

SEQ ID NO: 1116 - DNA, 40 bp, Homo sapiens
  misc_difference 20: note = T->C
  source 1..40: mol_type = genomic DNA
gataaatctcctttgggtatcagatacctctttggtgaat

SEQ ID NO: 1117 - DNA, 40 bp, Homo sapiens
  misc_difference 20: note = T->C
  source 1..40: mol_type = genomic DNA
ctgaaaagagggcttgccatagctcttctgagggtgctga

SEQ ID NO: 1118 - DNA, 40 bp, Homo sapiens
  misc_difference 20: note = G->A
  source 1..40: mol_type = genomic DNA
ctccctggacggtgataccgtggaggctgctgctcccgac

SEQ ID NO: 1119 - DNA, 40 bp, Homo sapiens
  misc_difference 20: note = G->A
  source 1..40: mol_type = genomic DNA
cgagaacttgctggccgacgtgaagggcgcgcgggccgcc

SEQ ID NO: 1120 - DNA, 40 bp, Homo sapiens
  misc_difference 20: note = G->A
  source 1..40: mol_type = genomic DNA
ggcgcaggtgcggaaggccgtgcagtacgaggagaagaac

SEQ ID NO: 1121 - DNA, 40 bp, Homo sapiens
  misc_difference 20: note = C->T
  source 1..40: mol_type = genomic DNA
catgtccttcaccagcttccggtaccctgcggagggaaag

SEQ ID NO: 1122 - DNA, 40 bp, Homo sapiens
  misc_difference 20: note = C->T
  source 1..40: mol_type = genomic DNA
gagggccctgggccccgcacgtgccccacagaggtgaccg

SEQ ID NO: 1123 - DNA, 40 bp, Homo sapiens
  misc_difference 20: note = T->C
  source 1..40: mol_type = genomic DNA
caccttgaccagctcgtcattgtagctgtcccgctcttcc

SEQ ID NO: 1124 - DNA, 40 bp, Homo sapiens
  misc_difference 20: note = A->G
  source 1..40: mol_type = genomic DNA
gaacttggggctccctcctatcctggtccactcagacttg

SEQ ID NO: 1125 - DNA, 40 bp, Homo sapiens
  misc_difference 20: note = C->T
  source 1..40: mol_type = genomic DNA
catattttatgcaggcatccggatctttctctctgggtaa

SEQ ID NO: 1126 - DNA, 40 bp, Homo sapiens
  misc_difference 20: note = T->A
  source 1..40: mol_type = genomic DNA
aggcatccggatctttctctctgggtaagtatagttcagt

SEQ ID NO: 1127 - DNA, 40 bp, Homo sapiens
  misc_difference 20: note = G->A
  source 1..40: mol_type = genomic DNA
gcagcagggacagcgagccgccatgtagcgtgccaggctt

SEQ ID NO: 1128 - DNA, 40 bp, Homo sapiens
  misc_difference 20: note = A->G
  source 1..40: mol_type = genomic DNA
atccatggtgttggtgagcaggccagggtctgagcggaag

SEQ ID NO: 1129 - DNA, 40 bp, Homo sapiens
  misc_difference 20: note = T->C
  source 1..40: mol_type = genomic DNA
tactttttctttctttccataggaacctattgggaagaac

SEQ ID NO: 1130 - DNA, 40 bp, Homo sapiens
  misc_difference 20: note = T->C
  source 1..40: mol_type = genomic DNA
aagggaaactttgttaccattttggtattatccactgaag

SEQ ID NO: 1131 - DNA, 40 bp, Homo sapiens
  misc_difference 20: note = C->G
  source 1..40: mol_type = genomic DNA
ctgcaaagctcagccgcttctctctgtcccaggccacata

SEQ ID NO: 1132 - DNA, 40 bp, Homo sapiens
  misc_difference 20: note = T->A
  source 1..40: mol_type = genomic DNA
cggactcgcgtctccgcactcgcagtatcacacccctccc

SEQ ID NO: 1133 - DNA, 40 bp, Homo sapiens
  misc_difference 20: note = A->G
  source 1..40: mol_type = genomic DNA
aatggactttgcacgtagcacagatgaccggggagaggta

SEQ ID NO: 1134 - DNA, 40 bp, Homo sapiens
  misc_difference 20: note = C->T
  source 1..40: mol_type = genomic DNA
tattattatgatggtgattctaggtttgtcagctcctgtg

SEQ ID NO: 1135 - DNA, 40 bp, Homo sapiens
  misc_difference 20: note = A->G
  source 1..40: mol_type = genomic DNA
ctgcttttcatgagccacaaacggacgtcattgagtgcag

SEQ ID NO: 1136 - DNA, 40 bp, Homo sapiens
  misc_difference 20: note = C->G
  source 1..40: mol_type = genomic DNA
gctgccaggaatggcgggcctgcccaacgtgtttggcttg

SEQ ID NO: 1137 - DNA, 40 bp, Homo sapiens
  misc_difference 20: note = C->G
  source 1..40: mol_type = genomic DNA
gaatggcgggcctgcccaacgtgtttggcttgggcgggct

SEQ ID NO: 1138 - DNA, 40 bp, Homo sapiens
  misc_difference 20: note = T->C
  source 1..40: mol_type = genomic DNA
aaatattctggctttacaattggacgtccacaaatgagtg

SEQ ID NO: 1139 - DNA, 40 bp, Homo sapiens
  misc_difference 20: note = G->A
  source 1..40: mol_type = genomic DNA
ctcttccgcagtgattgaagctttgataaatgaaatcttc

SEQ ID NO: 1140 - DNA, 40 bp, Homo sapiens
  misc_difference 20: note = G->A
  source 1..40: mol_type = genomic DNA
agtttccagcgatgtagtggaaaagctgcttgactgcacc

SEQ ID NO: 1141 - DNA, 40 bp, Homo sapiens
  misc_difference 20: note = G->A
  source 1..40: mol_type = genomic DNA
caagtccaatttccactttgctgtcttagtctgccaggga

SEQ ID NO: 1142 - DNA, 40 bp, Homo sapiens
  misc_difference 20: note = G->A
  source 1..40: mol_type = genomic DNA
agcaagtagaggaaagcagggtccccatcctgccgaaccc

SEQ ID NO: 1143 - DNA, 40 bp, Homo sapiens; identical to SEQ ID NO: 1142
  misc_difference 20: note = G->A
  source 1..40: mol_type = genomic DNA

SEQ ID NO: 1144 - DNA, 40 bp, Homo sapiens
  misc_difference 20: note = C->G
  source 1..40: mol_type = genomic DNA
aaccccgtaagaggcaaggctgcgctcaggcacacacagg

SEQ ID NO: 1145 - DNA, 40 bp, Homo sapiens
  misc_difference 20: note = A->C
  source 1..40: mol_type = genomic DNA
cccccaaccccctccccccacctgtacctctctccgtcaa

SEQ ID NO: 1146 - DNA, 40 bp, Homo sapiens
  misc_difference 20: note = G->A
  source 1..40: mol_type = genomic DNA
tgaccctgtggagccagtggactttgaaggacttctgatg

SEQ ID NO: 1147 - DNA, 40 bp, Homo sapiens
  misc_difference 20: note = C->A
  source 1..40: mol_type = genomic DNA
cttggacgtggtgttcacgccaaaggaatgtaggactttg

SEQ ID NO: 1148 - DNA, 40 bp, Homo sapiens
  misc_difference 20: note = G->A
  source 1..40: mol_type = genomic DNA
tttaaaaagactggatctcgaaaagattttcacaagacgc

SEQ ID NO: 1149 - DNA, 40 bp, Homo sapiens
  misc_difference 20: note = G->A
  source 1..40: mol_type = genomic DNA
gaggaccaataggcaggccgagctctttgccctttaccca

SEQ ID NO: 1150 - DNA, 40 bp, Homo sapiens
  misc_difference 20: note = T->A
  source 1..40: mol_type = genomic DNA
gaaaattttcactgtgacctgaactctgaccagttcaaag

SEQ ID NO: 1151 - DNA, 40 bp, Homo sapiens
  misc_difference 20: note = G->A
  source 1..40: mol_type = genomic DNA
gctgaatccttctgccagcgtttggggaaataccggatgc

SEQ ID NO: 1152 - DNA, 40 bp, Homo sapiens
  misc_difference 20: note = C->T
  source 1..40: mol_type = genomic DNA
ggagaagatgctagcaatgcgatgccggtaaggagggaaa

SEQ ID NO: 1153 - DNA, 40 bp, Homo sapiens
  misc_difference 20: note = A->G
  source 1..40: mol_type = genomic DNA
ggatcggggctttgtgtttaacctcatcagacattattgc

SEQ ID NO: 1154 - DNA, 40 bp, Homo sapiens
  misc_difference 20: note = A->G
  source 1..40: mol_type = genomic DNA
atcacttttgtggagccctactttgatgagtatgagatga

SEQ ID NO: 1155 - DNA, 40 bp, Homo sapiens
  misc_difference 20: note = C->T
  source 1..40: mol_type = genomic DNA
accacaagctccctcccttcttttgtgggttctggaaacc

SEQ ID NO: 1156 - DNA, 40 bp, Homo sapiens
  misc_difference 20: note = G->T
  source 1..40: mol_type = genomic DNA
ccaccacagttgactgtggggctgacagccagcagaagga

SEQ ID NO: 1157 - DNA, 40 bp, Homo sapiens
  misc_difference 20: note = C->T
  source 1..40: mol_type = genomic DNA
ccctccctaaaccagggggccatgtagctcaggatgtagg

SEQ ID NO: 1158 - DNA, 40 bp, Homo sapiens; identical to SEQ ID NO: 1157
  misc_difference 20: note = C->T
  source 1..40: mol_type = genomic DNA

SEQ ID NO: 1159 - DNA, 40 bp, Homo sapiens
  misc_difference 20: note = A->G
  source 1..40: mol_type = genomic DNA
ggccttcctctcctgcgtgagaccagaaagctgggagccc

SEQ ID NO: 1160 - DNA, 40 bp, Homo sapiens
  misc_difference 20: note = A->G
  source 1..40: mol_type = genomic DNA
ttagactactacctcgatgatattattgacttatttaatt

SEQ ID NO: 1161 - DNA, 40 bp, Homo sapiens
  misc_difference 20: note = C->T
  source 1..40: mol_type = genomic DNA
caaagtgattttgggacaaccagcctaaagtatttagatc

SEQ ID NO: 1162 - DNA, 40 bp, Homo sapiens
  misc_difference 20: note = A->G
  source 1..40: mol_type = genomic DNA
ggtgtggccattgctgccaacatcatccatgaaggtttcc

SEQ ID NO: 1163 - DNA, 40 bp, Homo sapiens
  misc_difference 20: note = C->T
  source 1..40: mol_type = genomic DNA
ggaggacagtgtcctggggcggcacatcttctggagacga

SEQ ID NO: 1164 - DNA, 40 bp, Homo sapiens
  misc_difference 20: note = G->A
  source 1..40: mol_type = genomic DNA
gttttggagaaggagatgcgtagtcttggtgttgacatgg

SEQ ID NO: 1165 - DNA, 40 bp, Homo sapiens
  misc_difference 20: note = T->C
  source 1..40: mol_type = genomic DNA
gcggtctgttgtgagatgatgaaggatctcaggcatgttc

SEQ ID NO: 1166 - DNA, 40 bp, Homo sapiens
  misc_difference 20: note = G->C
  source 1..40: mol_type = genomic DNA
tggaatttggtaaaatcttggatcacagaacgtagtatcc

SEQ ID NO: 1167 - DNA, 40 bp, Homo sapiens
  misc_difference 20: note = C->A
  misc_difference 20: note = C->T
  source 1..40: mol_type = genomic DNA
gaggcccagtacctgcccccggagtgcagaagctccattc

SEQ ID NO: 1168 - DNA, 40 bp, Homo sapiens
  misc_difference 20: note = G->A
  source 1..40: mol_type = genomic DNA
aaagaagagcttcacataggcatccgtggcagtgaaccag

SEQ ID NO: 1169 - DNA, 40 bp, Homo sapiens
  misc_difference 20: note = G->T
  source 1..40: mol_type = genomic DNA
ggatcatgtaatgatctccgcaatgtggattggaataaac

SEQ ID NO: 1170 - DNA, 40 bp, Homo sapiens
  misc_difference 20: note = C->T
  source 1..40: mol_type = genomic DNA
cataatgatcatgccccagcaccaaaggcaaggatttgga

SEQ ID NO: 1171 - DNA, 40 bp, Homo sapiens
  misc_difference 20: note = G->T
  source 1..40: mol_type = genomic DNA
tttttttttaggacaaaatgtttcacttttgggtaaatac

SEQ ID NO: 1172 - DNA, 40 bp, Homo sapiens
  misc_difference 20: note = G->A
  source 1..40: mol_type = genomic DNA
tctttcagtgaagagaaaggaagtacagaaaacatgcaga

SEQ ID NO: 1173 - DNA, 40 bp, Homo sapiens
  misc_difference 20: note = G->A
  source 1..40: mol_type = genomic DNA
cctgcgggccaaagtcttcgtgaagcggtttgtgcgggcc

SEQ ID NO: 1174 - DNA, 40 bp, Homo sapiens
  misc_difference 20: note = C->A
  source 1..40: mol_type = genomic DNA
ggctgccctcaacatagaccccagctggatgggcagtaca

SEQ ID NO: 1175 - DNA, 40 bp, Homo sapiens
  misc_difference 20: note = C->T
  source 1..40: mol_type = genomic DNA
gcgtgtggcccccaaacctcctcagatgagccgtgctgca

SEQ ID NO: 1176 - DNA, 40 bp, Homo sapiens
  misc_difference 20: note = G->A
  source 1..40: mol_type = genomic DNA
aatttcttctaggcagaacgctttgagagaagtatatgct

SEQ ID NO: 1177 - DNA, 40 bp, Homo sapiens
  misc_difference 20: note = G->A
  source 1..40: mol_type = genomic DNA
gcattcagtattgctgtccgcttctagaaagagtgcagaa

SEQ ID NO: 1178 - DNA, 40 bp, Homo sapiens
  misc_difference 20: note = C->T
  source 1..40: mol_type = genomic DNA
tcctggccggacctcattgccaaggttttccggatcgatg

SEQ ID NO: 1179 - DNA, 40 bp, Homo sapiens
  misc_difference 20: note = G->C
  source 1..40: mol_type = genomic DNA
cagtggacaccattgcaaagaggttccgctatgattcagc

SEQ ID NO: 1180 - DNA, 40 bp, Homo sapiens
  misc_difference 20: note = C->T
  source 1..40: mol_type = genomic DNA
gatgagtctgaccacgagacgctgactgccatcctgagtc

SEQ ID NO: 1181 - DNA, 40 bp, Homo sapiens
  misc_difference 20: note = G->A
  source 1..40: mol_type = genomic DNA
ggctctgagggagctgatggatctttacctgaagatgaaa

SEQ ID NO: 1182 - DNA, 40 bp, Homo sapiens
  misc_difference 20: note = G->T
  source 1..40: mol_type = genomic DNA
aactatttgcttctgcactgaaacaaaattcttcagagtc

SEQ ID NO: 1183 - DNA, 40 bp, Homo sapiens
  misc_difference 20: note = C->T
  source 1..40: mol_type = genomic DNA
tctgtacaggttggcaggccggatattattggcaagtgaa

SEQ ID NO: 1184 - DNA, 40 bp, Homo sapiens
  misc_difference 20: note = G->A
  source 1..40: mol_type = genomic DNA
gctgctcatgttcctgttcgccctggccatggtccttgcg

SEQ ID NO: 1185 - DNA, 40 bp, Homo sapiens
  misc_difference 20: note = G->A
  source 1..40: mol_type = genomic DNA
gctgagtcccttcaccttcgctgccacagatgactagggc

SEQ ID NO: 1186 - DNA, 40 bp, Homo sapiens
  misc_difference 20: note = G->A
  source 1..40: mol_type = genomic DNA
gatactaaacggcccacatgctgaaaaccaggagccacgg

SEQ ID NO: 1187 - DNA, 40 bp, Homo sapiens
  misc_difference 20: note = A->G
  source 1..40: mol_type = genomic DNA
gctttcttaccttaagtgtatatcagtctccaatccatgg

SEQ ID NO: 1188 - DNA, 40 bp, Homo sapiens
  misc_difference 20: note = C->T
  source 1..40: mol_type = genomic DNA
ggaagtagaggaaagtattcttcaggatttcgtaatattg

SEQ ID NO: 1189 - DNA, 40 bp, Homo sapiens
  misc_difference 20: note = T->C
  source 1..40: mol_type = genomic DNA
cagaatgattttgatcttgtgccttggtaaagtgttacca

SEQ ID NO: 1190 - DNA, 40 bp, Homo sapiens
  misc_difference 20: note = C->T
  source 1..40: mol_type = genomic DNA
ttttctttgtagtaattttcctcatcttgtactggagaaa

SEQ ID NO: 1191 - DNA, 40 bp, Homo sapiens
  misc_difference 20: note = T->C
  source 1..40: mol_type = genomic DNA
tcagtcatccatgaatctatttaacgattaccctgatagt

SEQ ID NO: 1192 - DNA, 40 bp, Homo sapiens
  misc_difference 20: note = C->G
  source 1..40: mol_type = genomic DNA
cttttcccgtaggctgatccttattcaaaatgggccattc

SEQ ID NO: 1193 - DNA, 40 bp, Homo sapiens
  misc_difference 20: note = G->A
  source 1..40: mol_type = genomic DNA
tcatgatattttactccaagatacaaatgaatcatggaga

SEQ ID NO: 1194 - DNA, 40 bp, Homo sapiens
  misc_difference 20: note = A->G
  source 1..40: mol_type = genomic DNA
tgcagaaatctatgcagataagaaaagtatggatgatcaa

SEQ ID NO: 1195 - DNA, 40 bp, Homo sapiens
  misc_difference 20: note = G->A
  source 1..40: mol_type = genomic DNA
tagtttgtatggctgtggtggagggaagatgttacaaccc

SEQ ID NO: 1196 - DNA, 40 bp, Homo sapiens
  misc_difference 20: note = A->G
  source 1..40: mol_type = genomic DNA
agggaagatgttacaacccattactaggtaaattgcattt

SEQ ID NO: 1197 - DNA, 40 bp, Homo sapiens
  misc_difference 20: note = C->G
  source 1..40: mol_type = genomic DNA
tatacagaacaatcccagcctaaaacttacatacacagaa

SEQ ID NO: 1198 - DNA, 40 bp, Homo sapiens
  misc_difference 20: note = G->T
  source 1..40: mol_type = genomic DNA
cagcttgatgaggtatttggattaaacatacgtacctttt

SEQ ID NO: 1199 - DNA, 40 bp, Homo sapiens
  misc_difference 20: note = G->A
  source 1..40: mol_type = genomic DNA
aattagcagcactttttccgttccactttccagcagagcc

SEQ ID NO: 1200 - DNA, 40 bp, Homo sapiens
  misc_difference 20: note = G->A
  source 1..40: mol_type = genomic DNA
aaacgtgcgagtgtctaacgggagccctagcctggagcgg

SEQ ID NO: 1201 - DNA, 40 bp, Homo sapiens
  misc_difference 20: note = A->G
  source 1..40: mol_type = genomic DNA
ttatgaattgaagaatgtcacaaataactttgatgaacga

SEQ ID NO: 1202 - DNA, 40 bp, Homo sapiens
  misc_difference 20: note = A->T
  source 1..40: mol_type = genomic DNA
agtttgatcaagaaataaaagtaatggcaaagtaagtctt

SEQ ID NO: 1203 - DNA, 40 bp, Homo sapiens
  misc_difference 20: note = G->A
  source 1..40: mol_type = genomic DNA
cctatatttgtagtaagccgggaacctctgaataccatag

SEQ ID NO: 1204 - DNA, 40 bp, Homo sapiens
  misc_difference 20: note = C->T
  source 1..40: mol_type = genomic DNA
gctttatcaggaattaatgcgaaaggggatacgatggctg

SEQ ID NO: 1205 - DNA, 40 bp, Homo sapiens
  misc_difference 20: note = C->A
  source 1..40: mol_type = genomic DNA
gcccagtgtaggctggagtctccagggggatttttggcct

SEQ ID NO: 1206 - DNA, 40 bp, Homo sapiens
  misc_difference 20: note = C->T
  source 1..40: mol_type = genomic DNA
attttcactttttgtagttctgttactgttgtttgaattc

SEQ ID NO: 1207 - DNA, 40 bp, Homo sapiens
  misc_difference 20: note = T->G
  source 1..40: mol_type = genomic DNA
tttccagctgactgcaatgttcttgcttgtcttgtaactt

SEQ ID NO: 1208 - DNA, 40 bp, Homo sapiens
  misc_difference 20: note = A->C
  source 1..40: mol_type = genomic DNA
gaggagctctacccagaggaactgctgattgaccatcagg

SEQ ID NO: 1209 - DNA, 40 bp, Homo sapiens
  misc_difference 20: note = G->GT
  source 1..40: mol_type = genomic DNA
gggccccgccaccgccaccgccgccgtccgccgtcaccta

SEQ ID NO: 1210 - DNA, 40 bp, Homo sapiens
  misc_difference 20: note = T->A
  source 1..40: mol_type = genomic DNA
atgttccggaatattccgatctgttccatgaagacctgca

SEQ ID NO: 1211 - DNA, 40 bp, Homo sapiens
  misc_difference 20: note = C->T
  source 1..40: mol_type = genomic DNA
tctcggaactgggcctcctcggagaactcgccgacatcca

SEQ ID NO: 1212 - DNA, 40 bp, Homo sapiens
  misc_difference 20: note = G->C
  source 1..40: mol_type = genomic DNA
gagcctgtgactttcttctgaatcttctgagtgatggtga

SEQ ID NO: 1213 - DNA, 40 bp, Homo sapiens
  misc_difference 20: note = T->C
  source 1..40: mol_type = genomic DNA
cactgaatactcatagagattgtagaccatgttggagcga

SEQ ID NO: 1214 - DNA, 40 bp, Homo sapiens
  misc_difference 20: note = C->T
  source 1..40: mol_type = genomic DNA
attgtagaccatgttggagcgaggaaggacccgatttacc

SEQ ID NO: 1215 - DNA, 40 bp, Homo sapiens
  misc_difference 20: note = T->G
  source 1..40: mol_type = genomic DNA
ggcctcaaacaccgaggattggaagatcttaatcagctgc

SEQ ID NO: 1216 - DNA, 40 bp, Homo sapiens
  misc_difference 20: note = G->A
  source 1..40: mol_type = genomic DNA
ggcccctctgggaacaagggggggaacttctctgactcca

SEQ ID NO: 1217 - DNA, 40 bp, Homo sapiens
  misc_difference 20: note = C->A
  source 1..40: mol_type = genomic DNA
cacctttggatcagatgagcctgaacccaagtcacagcag

SEQ ID NO: 1218 - DNA, 40 bp, Homo sapiens
  misc_difference 20: note = C->T
  source 1..40: mol_type = genomic DNA
tcgttcaacaaggtcatctcggcgggtgatttctaccgga

SEQ ID NO: 1219 - DNA, 40 bp, Homo sapiens
  misc_difference 20: note = G->A
  source 1..40: mol_type = genomic DNA
ggtgatttctaccggaaaagcatttcctcggtatctgaca

SEQ ID NO: 1220 - DNA, 40 bp, Homo sapiens
  misc_difference 20: note = T->C
  source 1..40: mol_type = genomic DNA
gatatggtccaaacagcaatgattttcagaaatgccttag

SEQ ID NO: 1221 - DNA, 40 bp, Homo sapiens
  misc_difference 20: note = G->T
  source 1..40: mol_type = genomic DNA
atgaaaccgaagctccaaggctttaatagctaaccttgtc

SEQ ID NO: 1222 - DNA, 40 bp, Homo sapiens
  misc_difference 20: note = G->A
  source 1..40: mol_type = genomic DNA
aggaacgtgagatgcaacagtttgtgaagtttgtgaggca

SEQ ID NO: 1223 - DNA, 40 bp, Homo sapiens
  misc_difference 20: note = T->C
  source 1..40: mol_type = genomic DNA
gtggagagcagagtcaggctctctgtggcactgagtgctg

SEQ ID NO: 1224 - DNA, 40 bp, Homo sapiens
  misc_difference 20: note = G->A
  source 1..40: mol_type = genomic DNA
actgcctacccctgggggcggagggggtggtggaggagga

SEQ ID NO: 1225 - DNA, 40 bp, Homo sapiens
  misc_difference 20: note = G->T
  source 1..40: mol_type = genomic DNA
acccaccgttctcagacgcgctgggaccttcgcagtccga

SEQ ID NO: 1226 - DNA, 40 bp, Homo sapiens
  misc_difference 20: note = G->T
  source 1..40: mol_type = genomic DNA
ttcttgcgaacctactggtggggggtgctgcaagcccctc

SEQ ID NO: 1227 - DNA, 40 bp, Homo sapiens
  misc_difference 20: note = G->A
  source 1..40: mol_type = genomic DNA
tgtctcacctgattccctcggggtccaggacttggtgttc

SEQ ID NO: 1228 - DNA, 40 bp, Homo sapiens
  misc_difference 20: note = C->G
  source 1..40: mol_type = genomic DNA
tcgacaactttgagttcatccgagtgttggggaaggggag

SEQ ID NO: 1229 - DNA, 40 bp, Homo sapiens
  misc_difference 20: note = G->A
  source 1..40: mol_type = genomic DNA
acacctttggtttggaagcgagtgatagacagccaagcag

SEQ ID NO: 1230 - DNA, 40 bp, Homo sapiens
  misc_difference 20: note = G->A
  source 1..40: mol_type = genomic DNA
ctatagcttcccattgaccggggtggaggtgaaggaaagg

SEQ ID NO: 1231 - DNA, 40 bp, Homo sapiens
  misc_difference 20: note = A->C
  source 1..40: mol_type = genomic DNA
gctgtagtcctgctgtgcaaatgaaaattaaggaactcta

SEQ ID NO: 1232 - DNA, 40 bp, Homo sapiens
  misc_difference 20: note = C->T
  source 1..40: mol_type = genomic DNA
tgtggagaggaacgggcagcgtggcttcgtccctggttcc

SEQ ID NO: 1233 - DNA, 40 bp, Homo sapiens
  misc_difference 20: note = G->A
  source 1..40: mol_type = genomic DNA
agaaatctgaaacatgagcgtttccaaagtcttagttttc

SEQ ID NO: 1234 - DNA, 40 bp, Homo sapiens
  misc_difference 20: note = A->G
  source 1..40: mol_type = genomic DNA
tatttacctccagttatcaaaaaaagacccaatcataaaa

SEQ ID NO: 1235 - DNA, 40 bp, Homo sapiens
  misc_difference 20: note = C->T
  source 1..40: mol_type = genomic DNA
ctgaaatactatgtattaccgaaaaagcctaaaaaggtgg

SEQ ID NO: 1236 - DNA, 40 bp, Homo sapiens
  misc_difference 20: note = G->T
  source 1..40: mol_type = genomic DNA
ggctgacacgttacagagagatgggctcgctgctcttgct

SEQ ID NO: 1237 - DNA, 40 bp, Homo sapiens
  misc_difference 20: note = A->G
  source 1..40: mol_type = genomic DNA
attaatcaggatggctgtcaggtaacatttttaaagataa

SEQ ID NO: 1238 - DNA, 40 bp, Homo sapiens
  misc_difference 20: note = A->C
  source 1..40: mol_type = genomic DNA
ttctggaagatttactatgaatatgctggtcgacattttc

SEQ ID NO: 1239 - DNA, 40 bp, Homo sapiens
  misc_difference 20: note = G->A
  source 1..40: mol_type = genomic DNA
gccgttgtgattggacgccgtgtcgctcagcacgtccaca

SEQ ID NO: 1240 - DNA, 40 bp, Homo sapiens
  misc_difference 20: note = C->T
  source 1..40: mol_type = genomic DNA
aacttgtcgatatctggggctcatcaaggagggctggctg

SEQ ID NO: 1241 - DNA, 40 bp, Homo sapiens
  misc_difference 20: note = C->G
  source 1..40: mol_type = genomic DNA
tggcgcgcagccccaggcccagccccgttcagcagcggcg

SEQ ID NO: 1242 - DNA, 40 bp, Homo sapiens
  misc_difference 20: note = C->T
  source 1..40: mol_type = genomic DNA
cacaggccagaccacggttcccgagcacacattaaacctg

SEQ ID NO: 1243 - DNA, 40 bp, Homo sapiens
  misc_difference 20: note = A->G
  source 1..40: mol_type = genomic DNA
cctgcgaggccgcggtcgcaccgtgtacaacaccttcagg

SEQ ID NO: 1244 - DNA, 40 bp, Homo sapiens
  misc_difference 20: note = C->T
  source 1..40: mol_type = genomic DNA
cactaatatggatgtttctctttgtgtgtgcacccttgca

SEQ ID NO: 1245 - DNA, 40 bp, Homo sapiens
  misc_difference 20: note = G->A
  source 1..40: mol_type = genomic DNA
tgctccagcccccacctacggcgttggtgccatggtgagt

SEQ ID NO: 1246 - DNA, 40 bp, Homo sapiens
  misc_difference 20: note = C->T
  source 1..40: mol_type = genomic DNA
ttgctgctcattcacatagccccaaggttccagccccagc

SEQ ID NO: 1247 - DNA, 40 bp, Homo sapiens
  misc_difference 20: note = A->G
  source 1..40: mol_type = genomic DNA
ccagaaggaagtgaggccaatgaagaactgcggcagaaat

SEQ ID NO: 1248 - DNA, 40 bp, Homo sapiens
  misc_difference 20: note = G->A
  source 1..40: mol_type = genomic DNA
agagctggtggagtctgacggtgtgcccaagcccagcttc

SEQ ID NO: 1249 - DNA, 40 bp, Homo sapiens
  misc_difference 20: note = T->C
  source 1..40: mol_type = genomic DNA
aagcgcagcaggatctggatctcccggagcgtgcgctggc

SEQ ID NO: 1250 - DNA, 40 bp, Homo sapiens
  misc_difference 20: note = A->C
  source 1..40: mol_type = genomic DNA
ctgagccgccgccgccgccatctccactcctcccctccca

SEQ ID NO: 1251 - DNA, 40 bp, Homo sapiens
  misc_difference 20: note = T->C
  source 1..40: mol_type = genomic DNA
ggtcctctcctgggaggactacgagggcttccacctcctg

SEQ ID NO: 1252 - DNA, 40 bp, Homo sapiens
  misc_difference 20: note = C->T
  source 1..40: mol_type = genomic DNA
aggctgcttgatcttgccacggtgaaagcgaatggattgg

SEQ ID NO: 1253 - DNA, 40 bp, Homo sapiens; identical to SEQ ID NO: 1252
  misc_difference 20: note = C->T
  source 1..40: mol_type = genomic DNA

SEQ ID NO: 1254 - DNA, 40 bp, Homo sapiens
  misc_difference 20: note = A->G
  source 1..40: mol_type = genomic DNA
agcacccctggccacctcaatgacgatgcggacactgtgc

SEQ ID NO: 1255 - DNA, 40 bp, Homo sapiens
  misc_difference 20: note = C->T
  source 1..40: mol_type = genomic DNA
cactgctccccgaccgaccccacctctgtccagaccctgc

SEQ ID NO: 1256 - DNA, 40 bp, Homo sapiens
  misc_difference 20: note = G->T
  source 1..40: mol_type = genomic DNA
ctacatcactgccgcgggagcccaagtgctggccgagggg

SEQ ID NO: 1257 - DNA, 40 bp, Homo sapiens
  misc_difference 20: note = A->G
  source 1..40: mol_type = genomic DNA
ctccactgcatggctgagaacgtgaccagggaggacttcc

SEQ ID NO: 1258 - DNA, 40 bp, Homo sapiens
  misc_difference 20: note = C->T
  source 1..40: mol_type = genomic DNA
cggccgacaatgtccaccacggtcaatgtagattcccttg

SEQ ID NO: 1259 - DNA, 40 bp, Homo sapiens
  misc_difference 20: note = C->T
  source 1..40: mol_type = genomic DNA
cctcttttgcagcatcagtctccgagagttgaagaccatc

SEQ ID NO: 1260 - DNA, 40 bp, Homo sapiens
  misc_difference 20: note = C->T
  source 1..40: mol_type = genomic DNA
atgtttgaacagcaaaaatcggtaagatgattcttgagca

SEQ ID NO: 1261 - DNA, 40 bp, Homo sapiens
  misc_difference 20: note = T->C
  source 1..40: mol_type = genomic DNA
caagcaacagggggagctgtacatgtgggattccattgac

SEQ ID NO: 1262 - DNA, 40 bp, Homo sapiens
  misc_difference 20: note = C->G
  source 1..40: mol_type = genomic DNA
tttgcggcccaggatataccccctacagaactacattttg

SEQ ID NO: 1263 - DNA, 40 bp, Homo sapiens
  misc_difference 20: note = A->G
  source 1..40: mol_type = genomic DNA
gagagcgagaccttccccaatgactacaccctgtccttct

SEQ ID NO: 1264 - DNA, 40 bp, Homo sapiens
  misc_difference 20: note = A->G
  source 1..40: mol_type = genomic DNA
ccgggacggggccttcctgatccggaagcgagaggggagc

SEQ ID NO: 1265 - DNA, 40 bp, Homo sapiens
  misc_difference 20: note = C->A
  source 1..40: mol_type = genomic DNA
aactgcagacttcgaggagctagaaaagcaggtgagtccc

SEQ ID NO: 1266 - DNA, 40 bp, Homo sapiens
  misc_difference 20: note = C->T
  source 1..40: mol_type = genomic DNA
gtgaggctcccctttcttgcggagattctcttcctctgtg

SEQ ID NO: 1267 - DNA, 40 bp, Homo sapiens
  misc_difference 20: note = A->G
  source 1..40: mol_type = genomic DNA
ctcctgagcttgttctcacagaagtatgcacattgcttag

SEQ ID NO: 1268 - DNA, 40 bp, Homo sapiens
  misc_difference 20: note = C->T
  source 1..40: mol_type = genomic DNA
ccgcaaatctgctccagggcgcacacccgctgcggctcgt

SEQ ID NO: 1269 - DNA, 40 bp, Homo sapiens
  misc_difference 20: note = C->T
  source 1..40: mol_type = genomic DNA
cttccgactggtcacttaccgggcgggttaaagacaatga

SEQ ID NO: 1270 - DNA, 40 bp, Homo sapiens
  misc_difference 20: note = T->G
  source 1..40: mol_type = genomic DNA
ggcgggttaaagacaatgatatcgtctaagagcttagaca

SEQ ID NO: 1271 - DNA, 40 bp, Homo sapiens
  misc_difference 20: note = C->T
  source 1..40: mol_type = genomic DNA
ctctagccaggggtaatgccgctgttggctgctttaaaga

SEQ ID NO: 1272 - DNA, 40 bp, Homo sapiens
  misc_difference 20: note = G->A
  source 1..40: mol_type = genomic DNA
gaattttaagtctacaaacgtcaaaggaatttgaatatct

SEQ ID NO: 1273 - DNA, 40 bp, Homo sapiens
  misc_difference 20: note = C->A
  source 1..40: mol_type = genomic DNA
ccctcggtggacgctgccccctgctggcagctgggggcgc

SEQ ID NO: 1274 - DNA, 40 bp, Homo sapiens
  misc_difference 20: note = C->T
  source 1..40: mol_type = genomic DNA
tctgcactctgatttaatgccactgataaataccttggaa

SEQ ID NO: 1275 - DNA, 40 bp, Homo sapiens
  misc_difference 20: note = T->C
  source 1..40: mol_type = genomic DNA
ttcacatactgctttggcattgtgtctaacagctcaccat

SEQ ID NO: 1276 - DNA, 40 bp, Homo sapiens
  misc_difference 20: note = T->C
  source 1..40: mol_type = genomic DNA
tcatcttctagccataatatatatacattgaagagcctaa

SEQ ID NO: 1277 - DNA, 40 bp, Homo sapiens
  misc_difference 20: note = G->A
  source 1..40: mol_type = genomic DNA
cttggttgggaagacaggcgggagtgtgcttaggggcttg

SEQ ID NO: 1278 - DNA, 40 bp, Homo sapiens
  misc_difference 20: note = G->A
  source 1..40: mol_type = genomic DNA
taggaacaagaggagatgcgataaaaacctgccaagcaca

SEQ ID NO: 1279 - DNA, 40 bp, Homo sapiens
  misc_difference 20: note = A->G
  source 1..40: mol_type = genomic DNA
aatcttatccaggacatgaaccactgttctcaaatgtctt

SEQ ID NO: 1280 - DNA, 40 bp, Homo sapiens
  misc_difference 20: note = C->T
  source 1..40: mol_type = genomic DNA
caaaggcaaaaattttcatcatctcttgaggtcttgttgt

SEQ ID NO: 1281 - DNA, 40 bp, Homo sapiens
  misc_difference 20: note = C->T
  source 1..40: mol_type = genomic DNA
cagccaactctttgtagcacggatacctgaacaataaagg

SEQ ID NO: 1282 - DNA, 40 bp, Homo sapiens
  misc_difference 20: note = C->T
  source 1..40: mol_type = genomic DNA
acacagatcagagggaatgctttctgtctgcttagacgct

SEQ ID NO: 1283 - DNA, 40 bp, Homo sapiens
  misc_difference 20: note = T->C
  source 1..40: mol_type = genomic DNA
ttacttccactgctggttatgacccctgtctcactcctgc

SEQ ID NO: 1284 - DNA, 40 bp, Homo sapiens
  misc_difference 20: note = C->T
  source 1..40: mol_type = genomic DNA
gttcctctaggtcagcctgccagtatactggggggcagcc

SEQ ID NO: 1285 - DNA, 40 bp, Homo sapiens
  misc_difference 20: note = C->T
  source 1..40: mol_type = genomic DNA
atttctatctgccctcctccgcctcccttaaatagaaatg

SEQ ID NO: 1286 - DNA, 40 bp, Homo sapiens
  misc_difference 20: note = G->A
  source 1..40: mol_type = genomic DNA
ctacttgcaaaaagaggtggacagtggccattgcccgcac

SEQ ID NO: 1287 - DNA, 40 bp, Homo sapiens
  misc_difference 20: note = A->C
  source 1..40: mol_type = genomic DNA
catctccagcgggcaggtgatgaacttcaagggcgacatc

SEQ ID NO: 1288 - DNA, 40 bp, Homo sapiens
  misc_difference 20: note = C->T
  source 1..40: mol_type = genomic DNA
tcaggctcctggcagccaccggggacaggctcgggcacca

SEQ ID NO: 1289 - DNA, 40 bp, Homo sapiens
  misc_difference 20: note = G->A
  source 1..40: mol_type = genomic DNA
gaaacaccgtcaatggggcgtgggaggctcctggtcccag

SEQ ID NO: 1290 - DNA, 40 bp, Homo sapiens
  misc_difference 20: note = C->T
  source 1..40: mol_type = genomic DNA
cctgttcagtgagctaggccgctctcgtctggcaaaggtg

SEQ ID NO: 1291 - DNA, 40 bp, Homo sapiens
  misc_difference 20: note = G->C
  source 1..40: mol_type = genomic DNA
aaggctggcatagaagcccgggcgggcccccggctcatcg

SEQ ID NO: 1292 - DNA, 40 bp, Homo sapiens
  misc_difference 20: note = G->A
  source 1..40: mol_type = genomic DNA
ggtgtccaggatgaaggatgtgaccgatgggagtttaatc

SEQ ID NO: 1293 - DNA, 40 bp, Homo sapiens
  misc_difference 20: note = T->C
  source 1..40: mol_type = genomic DNA
cccttcccagcatccaccatggctggtgggaattctaaga

SEQ ID NO: 1294 - DNA, 40 bp, Homo sapiens
  misc_difference 20: note = C->A
  source 1..40: mol_type = genomic DNA
ctccagcgggcatcaggagcaggacacagaactgggcagt

SEQ ID NO: 1295 - DNA, 40 bp, Homo sapiens
  misc_difference 20: note = C->T
  source 1..40: mol_type = genomic DNA
gcctggctagacagcagctctgagaataggggccttgggt

SEQ ID NO: 1296 - DNA, 40 bp, Homo sapiens
  misc_difference 20: note = G->A
  source 1..40: mol_type = genomic DNA
gacaaattgctataacaacggcaaagaccgaggggatgaa

SEQ ID NO: 1297 - DNA, 40 bp, Homo sapiens
  misc_difference 20: note = G->T
  source 1..40: mol_type = genomic DNA
gatggctgtttgtcttgtggcaggaaaaaccccgtgtcct

SEQ ID NO: 1298 - DNA, 40 bp, Homo sapiens
  misc_difference 20: note = C->T
  source 1..40: mol_type = genomic DNA
gactcccccagcccaggtgcgttcatagccagactgcttg

SEQ ID NO: 1299 - DNA, 40 bp, Homo sapiens
  misc_difference 20: note = T->C
  source 1..40: mol_type = genomic DNA
acacctcctcgacccacagtgatcctgctgcgcctggagg

SEQ ID NO: 1300 - DNA, 40 bp, Homo sapiens
  misc_difference 20: note = C->G
  source 1..40: mol_type = genomic DNA
tccagtgccctgcctgtgacttccagcgctgccaagcctg

SEQ ID NO: 1301 - DNA, 40 bp, Homo sapiens
  misc_difference 20: note = T->C
  source 1..40: mol_type = genomic DNA
cagagagtgttgagagagattgatgggagaccctgctttg

SEQ ID NO: 1302 - DNA, 40 bp, Homo sapiens
  misc_difference 20: note = T->C
  source 1..40: mol_type = genomic DNA
tgttccactttgtccaacatgatgaggagactctgcaaac

SEQ ID NO: 1303 - DNA, 40 bp, Homo sapiens
  misc_difference 20: note = T->G
  source 1..40: mol_type = genomic DNA
cctgggaggagtcccggagtgtagagatttgcaggtgatg

SEQ ID NO: 1304 - DNA, 40 bp, Homo sapiens
  misc_difference 20: note = C->T
  source 1..40: mol_type = genomic DNA
gtgtccattatctcgtttccggaaaaggagcaagaagatg

SEQ ID NO: 1305 - DNA, 40 bp, Homo sapiens
  misc_difference 20: note = C->T
  source 1..40: mol_type = genomic DNA
ccgcagtacgtccgagtctcccaggacacgccctccagcg

SEQ ID NO: 1306 - DNA, 40 bp, Homo sapiens
  misc_difference 20: note = G->T
  source 1..40: mol_type = genomic DNA
gacccacggccagtacggggtggagattcctctgaggacc

SEQ ID NO: 1307 - DNA, 40 bp, Homo sapiens
  misc_difference 20: note = G->T
  source 1..40: mol_type = genomic DNA
tggagaagttcatatcggagcagaccaaggaaagaggagg

SEQ ID NO: 1308 - DNA, 40 bp, Homo sapiens
  misc_difference 20: note = G->T
  source 1..40: mol_type = genomic DNA
cacgtggcccaggtgctgcgggagctgctgggggacttca

SEQ ID NO: 1309 - DNA, 40 bp, Homo sapiens
  misc_difference 20: note = C->T
  source 1..40: mol_type = genomic DNA
ctgggggacttcacgcagccgctttatccccggccccggc

SEQ ID NO: 1310 - DNA, 40 bp, Homo sapiens
  misc_difference 20: note = T->C
  source 1..40: mol_type = genomic DNA
gctcaccaggtgcagggagtgagcctccggtccctctaca

SEQ ID NO: 1311 - DNA, 40 bp, Homo sapiens
  misc_difference 20: note = G->A
  source 1..40: mol_type = genomic DNA
ctccggtccctctacaagcgttcctcaggccatgtgacct

SEQ ID NO: 1312 - DNA, 40 bp, Homo sapiens
  misc_difference 20: note = A->G
  source 1..40: mol_type = genomic DNA
tacaagcgttcctcaggccatgtgaccttcaccatggacc

SEQ ID NO: 1313 - DNA, 40 bp, Homo sapiens
  misc_difference 20: note = C->G
  source 1..40: mol_type = genomic DNA
gggagctggcaggaatcatctgggctcaggtaataagact

SEQ ID NO: 1314 - DNA, 40 bp, Homo sapiens
  misc_difference 20: note = C->T
  source 1..40: mol_type = genomic DNA
cgtggacaatgggctgtggcgtgtgaccctgtgcatgctg

SEQ ID NO: 1315 - DNA, 40 bp, Homo sapiens
  misc_difference 20: note = G->A
  source 1..40: mol_type = genomic DNA
tgtcctgcagatgaaggacgtcttcttcttcctcttcctg

SEQ ID NO: 1316 - DNA, 40 bp, Homo sapiens
  misc_difference 20: note = C->T
  source 1..40: mol_type = genomic DNA
gtctaccactcctacctcaccatcttcgggcagatcccgg

SEQ ID NO: 1317 - DNA, 40 bp, Homo sapiens
  misc_difference 20: note = C->T
  source 1..40: mol_type = genomic DNA
ctggagaagaacgaggaggcggccctgctatcctgggaga

SEQ ID NO: 1318 - DNA, 40 bp, Homo sapiens
  misc_difference 20: note = C->T
  source 1..40: mol_type = genomic DNA
ctggatcgtgaggacgctgcgggccagcggcttcagctcg

SEQ ID NO: 1319 - DNA, 40 bp, Homo sapiens
  misc_difference 20: note = G->A
  source 1..40: mol_type = genomic DNA
agcccgggctccgccttgcgtcacgtcttcctgactgtcc

SEQ ID NO: 1320 - DNA, 40 bp, Homo sapiens
  misc_difference 20: note = A->G
  source 1..40: mol_type = genomic DNA
cggcacctcctctaccccaactgccctgtcacgcgcttcc

SEQ ID NO: 1321 - DNA, 40 bp, Homo sapiens
  misc_difference 20: note = G->A
  source 1..40: mol_type = genomic DNA
ccccgtgcccaacgagaaggtgccctgggaggtgagcgcc

SEQ ID NO: 1322 - DNA, 40 bp, Homo sapiens
  misc_difference 20: note = C->T
  source 1..40: mol_type = genomic DNA
gctgtaccccatggtcacgcggtgagttcatgtgtgccgg

SEQ ID NO: 1323 - DNA, 40 bp, Homo sapiens
  misc_difference 20: note = A->G
  source 1..40: mol_type = genomic DNA
ggaagcaaagtaccaggccagccacccaaaccttagaaag

SEQ ID NO: 1324 - DNA, 40 bp, Homo sapiens
  misc_difference 20: note = T->C
  source 1..40: mol_type = genomic DNA
gctgctggccgcgtacttgttgttgctctgtttggagggc

SEQ ID NO: 1325 - DNA, 40 bp, Homo sapiens
  misc_difference 20: note = G->A
  source 1..40: mol_type = genomic DNA
agaggacggcgggaacagagtgaccgagggggtggccttg

SEQ ID NO: 1326 - DNA, 40 bp, Homo sapiens
  misc_difference 20: note = G->T
  source 1..40: mol_type = genomic DNA
cccgctgccaaacacatgcgtcactgagttatgcttggat

SEQ ID NO: 1327 - DNA, 40 bp, Homo sapiens
  misc_difference 20: note = C->T
  source 1..40: mol_type = genomic DNA
tgaggataacataagaaggctccgtgcccttgcagatggg

SEQ ID NO: 1328 - DNA, 40 bp, Homo sapiens
  misc_difference 20: note = G->T
  source 1..40: mol_type = genomic DNA
gatcatgtgtgagctaaatgttcttccattagcattgcag

SEQ ID NO: 1329 - DNA, 40 bp, Homo sapiens; identical to SEQ ID NO: 1328
  misc_difference 20: note = G->T
  source 1..40: mol_type = genomic DNA

SEQ ID NO: 1330-1499 - skipped (170 entries)

SEQ ID NO: 1500 - DNA, 39313 bp, Homo sapiens
  source 1..39313: mol_type = genomic DNA
cgcaagtccccccaccgttcagcgcaaccgggccctcccagccccgccgccgtccccctcccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtgagagggagcccagcggtgcggtggggctggaacatgggtattgtggtgtcggagcagggggccctgggccaaaaataggtgcggccgggaggagtgggaagtcgggctgaggaaggagccagcctaggggcccccaacctgctttcacgcctcctaccaccggacggaacgtagcctagcgtttcattttccgtatcctcccgtcaggcgaccccgttatagccggcatcctctctttagaatatcgtttttctttctctggtaaaccctccaaatatttaccgcgggaatcccacctttttccaaagtgaccccgtctctgtgtcagaaccacgggaaaaagaaaaatggagcagctactccttgaaatacttaatgtttaataagcttttcgttgtaacgtttccacgttgcttacgggaaaaaaaaaagtaaaaaaaaaacctgcagaattttatgtgaacttgtgtgtatattctagtattggatcttaatagattctaaataagtttgtcactagatgaattttggtatcttaaatattcttgatatgttcacaccactgccatttagatgtcacttaaaattaagttaaagttatgtcttggaccaaaaaagctgcggttttagaataatcctaaagaattgctgcccatgttttgctggtgttatgcaagttaatgtgcagtgaaggcagaaattgggagatttcagctatttttaactcctacaccagaaaagcagatttctcaacctccaaggaaggatctaaaaaaaacctgatatagaaaacttacaccctttttctcttctttaacccataaaactgacactcttatattcccaagaaatgcacaaaagtgttcaattctagtggtgctgtttcgatatttggaatttcattgttctagacagagagcccgaagtaataaaaccaatagttatatagcattaggctttcaaaacattatcgtactttaatcgtccgaaaatacgcagtgagattagtcccattttttggttttgaacggaagctataagcagtttgtaaacctgtctacggccacaaatatggttgtggaacctagattcacattcagcaattataactccagatcccgtgctgtttctgttttctatttgcaaaccacctctctaattaactggctaactttgttatgtaattaacaggttgatgggcattgtattctggtaatagcaacctttgcactttgttctatgtaacatattttcctgaacagtcacatgtgaagtgactttttccctatttaaattccctcggttggccaggtgcggcggctcacggttgtgatcctagcaccttgggaggcctcggcgggttgatcacttaaggccaggagttcgagaccagcctggccaaagcagggaaaccctgtctttactaaaaataggaaaaattagctgggcatggtagcatatgcctgtaatcccaggaggctgagtctgcagtgagcggagatctctccaccgcactctagcctgggtgacagagggagactctgtcaaaaaaaaaaaaaagtccctcagtagaccatttaacctggtttgagttctgacttttgtgcatggtatttaaaaacgcatttataatagagtcaggttttttgttctgatttttgtggaatgttttcctttgttatggaacctagtgaccaattaggatactaacagaaagatcagtatagcaaggtggttaatagcatgcgctcttgatagtaaatgttagaatcctggttgcactaatagtagagtgactttgcctaatttagttgactttctgagccttcgtttcttcacatgcgaaagtggaataaaagtaatggcttaatcctagacttgacctgggattcagtgaattaacctgtgtaacgcgactgtaaatcagagtagatttggtctgtgactgctggacaataagcaccagagaaactgtttcacttttttttttttttttttttttgagacggagtcttgctctgtcacccaggctggaatgcaatggtgcagtctaggctcactgcaacctccgccttccgggttcaagcgattctcctgcctcagcgtcccgagtagctgggactacaggtgcgtgccaccacacctggctaatttttgtatttttagtagaaatggggtttcaccatgttggtcaggctggtctcaaacccctgacctcgtgatccgcccacctcagcctcccaaagtgctgggattacacgcatgagccaccccacctggcactgtttcactttcaaaataaaattaatgaagatgcaaagaaaatgcgagttttcatactctgtatgtttttattactgtagtatgaggtatgttatttggaaagcactgtttcaattacaaatatttgacactcttaattatattgtcaccttacatgtaggaattcgtcttttataagttgaaattgtcatctacaaagacagtttctttttacggattttgaaaaacataagaatttaaataaagaaactttagtatattcttcagctgctcttttctcttagtatctaagcttgttaaaattgctggatagttcaattaaaatcttttacagtgaaaattgtgtaattttgactgtcctgaaacctttactcaagaacaccattgtggttcccagtttggcagctttaataaatgcaaatttttacttttgtatccattaaactgtcatgaatataaaaatgggttgcaaaacaataatatatgtatatttgattgtttgtttctttatatgttcctttgaagaaatatgactatatttcagatcctaagacaagtagtgtattagtagtttagaagagggatggcaaacgtgtttgtaaaggaacggatagtacatgtttttggctttgtgaaccagatggtctctgtggtaactacttagatctgctgtgaaagcggcaatagacagcatgatgtggctgcactggtttggtgactccttgctcagaacattgtaagaatccctgtagacagcagaaaatacagaacatggttttatgctaatttgttttgttagagtggggtatcctaaaaaatgagatcctctgaggggaaggtttccagaggcatgcatgggaggctcacagtgacagggtatcaaagttgatggactaggcaactcttgaacacagtatgttcacttccagcctatcgttctccccaccccaactctccaaccattaatgtcctaggagcttgtaagatacccagaatagtggtcctacatctactactacccttgactgttgtttgtcctaaaccctccacttcagtagtataaataccactgactttattttcattactttttaaaaacatctcctctgtaataggaatttatataactgataattggcttatttaaattatgattgaaggcatttaaatagtgatgactttaaaaactatgagtatggtcaaaccagttgctgtactcacttatgattatcagtagtctcttatctgattaatgtttaacttatcaaatttattttaataaaagtgttctttacaggtcctgagaagtatttctcgttttcattggagatcacagcatacaaaagccaatcgacaacgtgaaccaggattaggatttagttttggtatatgttcggttctatcttttgactttaaacttatacatatgaagctttatatgttttgtttggaatatgtttgtaaataaacttaataatgtctttcaatgagtagaaccagtccactgtccacagataatttacaataactcacactccattcttcctgatctcattttcttcctcagtatactacactgtacattagatctgttttagcagcatacatacacttaaattccttcctttttttctgagtgtttagcccaaaataaatgagatttactgatatatatgaatagtcttcaacttacatatctgaatgccacaaatacattttaaaaacacttgttagattacaattctaggtgcctggtaataagctaaagcttgtttttgctataatatatccaaattgcaattttggtactattagatgaagttctcactcctgggaccagggagccatgattttttttcctctgccctctataaaatgaaaactacacacaaaaaatttgaaataatatctatctttggcattcttggccttctaaagtgcttcttcaaaatttttattttttctctagttaaaaaccatttactcaatttatttggtctcagaaaatagttaaaggcagctgcgataactcacagctaggtacaaatgacaatctcaaagctctccagagttattttttttattatttgttgtgttttttaaagatttttcccttttctttataaaggtttttttttttcttaccagaatttaatgaaatttttcttttctttttctttctttcttttttctttttttttttttttttaagatgaggtttcattgtctcattatgttgcccaggccgatcttgaactcctaggctcaagcagtcctcttatttcagcctcccaaagtgctgggattataggcatgagctactgcacccagaccaaatgaaaagtttctgtgttttttttttttttcctgtgacttctagccaaagactggatgaaaattttctcttttcttttttttgagacagagtctcactctgtcacccaggctggtgtgcaagtggctcactgcaacctctacctcccaggatcaagcgattctcctgccccagcctcctgagtagctgggactacaggtgtgggtcatcatgcctggctaatttctatatttttagtagggatggggttttgccacgttggccaggctggtctcgaacagctgaagacaagtgatccacccacctctgcctcccaaagtgctgggattacaggcatgaaccactgtgcccaacctaaatgaaaattttttttcttttctctttctgtagccaaagactaaatgaaagttttcaagcactgtgaggatagccatttgggatggtggatttttttttttttttttttttttttttgagactgagtcttgctctgttgctcaggctggattgcagtagctccatctgggctcattgcaacctctgcctcctgggttcaagcgattctcctgcctcagccacccaagtagctgagattacaggtgtgggccaccatacctggctaatttttatattattagtagatatgaggtttcgccatgttggcaacgctggtctcgaactcctggcctcaagtgatccacccgtcttgtcctcccaaagtgggattatgggcattagccagcatgcccagccagggtagtggatcatactgagataattagcattaatttggtatgattgcttgtcactttaaatttctctctcagtagtaagagacttgcaggagaaatctatggtggttcactgagtgacagaggatgagttagatataattgtttgggagggagattgtgaagttcaatacgggtctattccttgaaccagttgcatctggttctttatctgtaaagtggaaataatatctataacacagaatttctatgaagattaaattatatgctgtatttaaagcccctagcacttagtgactggatcaaagtagtttctcaataaataatacataatacatacttgtcatttttccttttttttttttttaagagacagggtttcactctgtcacccaagctggatgcaaccttgacctctggggctccatggattctctcgcctcagcttcctgagcagttaggacaataggtccatgtcaaccacacctagctgattttttaaatttttaaatgttttgttgagacaggatcttgctatattgctcaggctggccccaaactcctggcctcaaatggttcacctgcctcagcctcccaaaattctagaattataggcatgagctaccgtgcccagactttctctaccctctatctacctgcaagattgctatcaactggcaccaatcttagaagtaaagctgtgatagagagaacactggactgaaattcttaagtatacttctgctaattcattgtgagactgatactagaatttccttactctgcattagtttatcaataaaaagagagatttggctgggcgcagtggctcgggcctgtaatcccagcactttgggaggccgaggtgggcggatcacgaggtcagaagatcgagatcctggtgaaaccccgtctctactaaaaatacaaaaaaaaaaattagccgggcgcggtggcaggcacctgtagtcccagctgctcaggaggctgagacaggagaatggcgtgaacccgggaggcggagcttgcagtgagcctagattgcgccactgcactccagtctgggcgacagagcgagactccgtctcaaaaaaaaaaaaaaaaaaaaaaaaaaagagatttgatcttatgctcttcaattcagcaccagaattcagcttttatgtattgtttctcacatccccatacaaatgattactgtagtcttaaacattcctctgtgcatttgctctcatttttcttgcttgaaataccctattatctcttaaattttacctaatctttgacgttagatgcaaccacattaaaacacaaggataccatggatttgaaaagatgcagttagcaattgactcctctcctcaatcaagccaccatactaatttcattaattttaaaacaatcccttattttatgtaaacaaattgttggacaccatttattagcattgcagcaggattttatgttattatcttttgaaaaacctttctaccacttttaccagttgctttgtgctaatttataagcttgtctgagtttaaaggagctgtaagcctaggcatggtgtctcatgcttgtaatcccagcactttaggagaccacggcaggaggattgcttgaggccacgagttcaagaccagcctggcatcatagtgagaccctgtctctgtgaaaacaaaaaaaatgaaatagatagggtgaggtggctcccagcactttgggaggccaagatgggagaatcatttgagcccaggagttctagacccatttgggcaacatggcaaaaccctgtatctacaaaaattacaaaaattagccagatatggtggcatgtgcctgtgatcccagctagttgagaagctgtggtgggaagatcatttaaggccaggaggtcgaggctacagtgagtcgtaattgcaccactgcactccagcctgagtgacaaaatgagactgtctcaaaaaaaaaaagcaaaattatgatattgatattcttatatgacactttgaaataagttttattgctttatgtcactgagtgtgtttcatctatttcgttagattgattcttgtcgtcagggagatgtcttgtatattagtttcacttcagtgttagcaaacatttgataaattggcttaggaactaataataagttaaacgttttttatatcaccaattggaaaagaaaaactcacttgagctctacaggttaatatctattactcatttgtaaaagttaaaaatcttacctatttcctttagcatttgtattgacataggtttatttatattgtgtagtgaactcttgattagtcaaaaaatgcactgtagtctgagtttctgataatcaaggatttaagtccccacaataaatacacatttctacatactgacttcataggacatttttccttgttatccagttttaacttttctaaataattttcccttagagttcaccgaacagcagaaagaatttcaagctactgctcgtaaatttgccagagaggaaatcatcccagtggctgcagaatatgataaaactggtgaagtaggtatatacattttaaagagggaaaaatcttttacattttttacaagattatgtaatcaaactatctggatttcaaaatatattttaactcagttctttttcttctagtatccagtccccctaattagaagagcctgggaacttggtttaatgaacacacacattccagagaactgtggtaagctttctttatatttttaatactggaatgcatatgagtaagaaaaattgtggaactctactcagtcatttttttcaaatatttcttgccattaaatgactttctacctttgtcttcctgctcagactacagtgtttgcccacttttggaagcttgcactctatacctagatgcgtttttccttcttctaactggttccaaccttaacttgcacctaaaccttggtaacttccgtttctagagttggtcaatttgttgtgttttattcctatcttctatattacattttattgagtcttttttgtgaaccatgattcttttcctcagacccagttttagagttgaattgagttttaacaaaatcaagttagaacaggaatacaggttcaaattacaaatagtaaaataattttttgaaaattttagagctttaagaaagtataatttcttattgtgccagccagaacacatgtagatattatattgcaaatttccttttaaaacaaattttggtcatattgaaagcaattaaaatagtttacctttatttctattgtgatgtactacatattacaatgtgttgaaacattttgatactgtaggaggtcttggacttggaacttttgatgcttgtttaattagtgaagaattggcttatggatgtacaggggttcagactgctattgaaggaaattctttgggggtaagtgacttagaaaattaactacctaactcagctcttgttaatgagatagttactcctgaagaagttggatttttagaagaaaaaaaaaggaaagtcagttactactaggtaaggttagtgggtacacacagttttctttaaagaggaacacaagattcagcagtgaagcctggagttctgatttcgaggcttgataactctggccttgtctctagtactcggagttctgactgtcctttggaggaaactgtatactttggctgcagcttcagtggcaattcttaggtaaagccaagggctaaatccagaattcaggagcaggattgggatggtttgctgccactatggcagtactgaaatttagcaagcaattcttttttttctcactctgtcgcccaggctggagtgtagtagcgcgatcttggctcactgcaacctgcacctcctgggttcaagcaattctcctgcctcagcctcctgagtagctgggattacaagtgcgcaccaccacgcccagctaatttttgtatttttttttttttttttttttgagacggagtctcactctgttgcccaggctggagtgcagtggcgcgatctcagctcactgcaagctccgcctcccaggttcacgccattctcctgtctcagcctcccaagtaactgggactacaggcgcccgccaccatgcccggctaattttttttttttttttttgtatttttagtagagacggggtgtcaccctgttggccaggatggtctctatctcttgacctcgtaatccgcccacctcggcctcccaaagtgctgggattacaggcgtgagccactgcgcccggcctaacaagcaattcttaggcctgatcatacatactgtgtcacatattctaaacataattttttattagtgcatttcactatagtagattttcacagattataatgccacaggtcctacatataacctaattttatgaaaatacttagattagcagatttatttcctcattctaacttagaggcaaggtataggccagttctttggacttacctgttaggtgaaaaatagttattttttcattttgaattatagcatctctgaatttacatatccaataaaaatgacttgattttttaatgtcaattttcttcggtagcaaatgcctattattattgctggaaatgatcaacaaaagaagaagtatttggggagaatgactgaggagccattgatgtgtgtgagtatgtgtaactgccgctttatttcacacttaagaagggaacaaaggtgctatttctccttttcagtctatatgtatatattgggatatttagcattgaaacaaaacttagcaacatattattacaatgatgtgtcaaggatgccaagaaagtatcataataggccgagggcaatggctcgcacctgtaatcccagcactttgggaggcggaggcgggcagattacttgaggttaggagttcacagcctggctaacgtggtgaaaccccatctctactgaaaatacaaaaattaaccaggcgtgatggcgcctgcctataatcccagctgctcaggaggctgaggcataagaatcgcttgaacccgaaaagtggaagatgcagtgagcagagatcacaccactgcactgctacctgggcgacagagtgagtgagaccctgtctcaaaaaaaaaaaaaaaaaaaaggtgtcatcataattttgttgcttatttccaggagaagagagatctacttgtgatgtttttgggatgtcaaaaagtgtcataataatcctcttacttcaggagagagagctctatttagtggagcattctacactttaagaactgagtcattgtgtcaggaagttcagattgaatgtagggcaatgtgtgtttgaactagtagtgttttgaattagtaaaaaattaatgttggctggtcgtggtggctcacgcctgtaatcccagcactttgagagtctgaggcaggtggatcacctgaggttaggagttcgagaccagcctagccaaaatggagaaaccccatctctactaaaaatacaaaaattagctggatgtggtggcgcttgccagctacttgggaggctgaggcatgagaatctcttgaacctgggaggcagaggttgctgagtaaagatggcggcactgcactccagcctgggcaacagagtgagactctgtctcaaaaaaaaaaaaaagcaattaatgtgggctgggcatagtggctcacacctgtaatgtcagcactttgagaggctaaggcaggagaactgcttgagcccgggagttcaagaccagcctgggtaacacagtgagaccctgtctctaaataaataaataaatgaataaataaataaaaattaatgtgaacctgtaactgaagaaatagcaacttatttgttgaatgactgaatgacttgggaagaatagttgtagagtttatttaaacctctgaaagcaactcaacaaatttttaaattagatttttttaacaagataaatacacacacagacatacacacacacacacacacacacacacacacacgctctattctgaaactgttgtttacctaaggatttttacttcttgtttactcaaacatatttcaatctaaggtgtggttgttatactgaaatacagtagatgtattagttttgagctaatgatgagaattcatcttaaagaacagaaaataatatttgaaaataaatgttttttatttcagatacctaaaatttcaagcaaactgtttaataaaggaatttgtacatatttgctaggaaatttgcaattttttttaacaattgagaggttagctaaacattctcactattgtctataagaactgtgtgaaacgtctagattgttctcctgtagcatatacagtcagctctccatatccatgagggaatagtttaggacaggttgccctccatatcaaaatttttggttgccaagtctgttatacaaaatgtacagttagccctttgtatctgtgggttttgctccacagttggttaaattccaaaattcgtggatgccaaaggcaaacttttaaaaaattaaaattttataacttttctaattataaaatactgagtatagaaaatttagaaatgttttaagtagaacaaaaatatctgtaatccctcagatatggagttaattagtattacttccttattgtagtgcctaccacatttttaaatatgtaattgtgtttttaacagttagcccccattatatacatgtagttttatgtacatctttatttaacaacatgaacattttcttatgccttccttctttttacatgctgtaacaatactgcataatttgctatctaatggatatgctataaattgtttcacttttctgtactgttgaatgtttaaactccttgggtttttactttggaaaataatgttatggtaaaaaataatacagaaaaaaaataaataaaaatgatcaaataagaagccaagaacaggccaggcatggtggctcatgcctgtaatcttaacactttgggaagccaaggcaggaggatcgcttgaggccaggagttcaagaccagcctggacaacgttgagagactgccaccacacacacacacaaatatatatatatatatatatatatatatatatatatatatatatatatgaaaccaaaaagaagaaaagaagacaaaaacaactctgaggaaccagtagtgacaagccattttgtatagaaaaaaacaggctcatttacttcacaggctctaaaaacttcactgtattatgaaacagacagatgtctaatagcatatttcagggaaaaaaataccttaaaggtggttaaaacaaaattttggtacttaaaaggggcatcttttatggacaactccttaatttgtcatgatgctgaatacatcaaatctccaggtagcagagtaatctagttcagttaacttgagtgacacctgaatcccctctacagaatccctgtcaaaagaccatctggctgacatgtttttatacctcaggtgcctgggaatcaacaccttctgaaacagcatcatttgcgagcatctgttatcattagaaaaatattttggattacataatgcttaagcacagaacctgtcatttttttttttataattttaccagttcatactgtaataggtgttcaataaatgttagagtgatttcactgtacttttctttggctatattgcccttcagatgtttgagtatagttatatttatttatttatttattttttgagacggagtctcgctctgttgcccaggtcggagtgcagtggtgtgatcttggcccactgcaacctctgcctcccaggttcaagcgattctcctgcctcagcctcccaagcagctgggactacaggtgcgtgccaccacgcctgcctaattttttgtatgtttagtagagacaagatttcactgtgttagccaggatggtctctatctcctgacctcatgatctgcccaccttggcctcccaatgtgctggaattacaggtgtgagccaccatgcccagccaagtattgttattattttttttttctgaaatggagtctcgctctgttgcctaggctggagtgcagtggcaccatctcggctcactgcaacctccacctcccaggttcaagcaattcttcctcagcctcccaagtagctgggattacaggcgcccgccaccaagcctggctaagtttttgtatttttagtagagacagggtttcaccatgttggccaggctggtctcgaactcctaacctcaggtgacccacctgcctcggcctcccaaagtgctgggattacaaacctgaagcctcagccaccacgcccggccctaagtaatcatttctagtgcccctatatatgcttactactttgaattaaaatgtatatagtttctttcttttttgttgtatatttttaaaaaataaattgacatgggttctcggcatgttgaccaggctggtcttgaactcctggtctcaagcgatcctcccatctcagcctcacaaaatgctaggattacaggtggggggccaccatgctcggcccagtttctttcttctttggactgtaagtaccttaagggcaagtaacttgtttctttagtatccacagtaccggccactcttgaattaacttgcactaacacttgccttctaccacccccttttatccattactgcttgtgtcttgtcactcctctgtttaagagctctaagaggctcccctgtttctaccagataaaattttaaatttgtaatgtgatataaaagattctcgtcgaccatttccttcctttctttccagactcatgtcttaccattcccttacatgcacagaatttacatactgtggaactctggtactttcagcattagaaacactgggtaactctgtttcttatcttagtgtcatagcatatgccattacttgtacctggaatgcatattcttcctctttttccctcctcgcaaagaagccattttcctttttgagacttaatttaaacatcctctgccctgggaaactagtttctcaagccccttgtctgactttcacacatagagttgcagtatagttatttatcttcactgttacattgtgaaaatctctaggactgaatgtcttttacctctggtttccccatatcctaatttacatcgtggtacatagtagatattcaatacatgtttgcatgaatgaatacatgtgaaattgaatttaatgaacttgtttaaagctatctaacattttcactttttattaaatatatgatttgttgatatacctatgcctaatttgaattatatattaagtgtttttaggccaggcactgtggctcatacctgtagtcccagcactttgggaggctgaggcagaggattgcctgagcccaggaggttgagaccagcctaggcaacacagtgagatgccatgtctacaaaaaatttaaaattagctgggcatggtgatgtgtgcttgcagtctcagctattatacacgggaggctgaggcgggaggatttcctgagtccaggaagccaagactgcattgagcctctgcattccagcctgggcaagagagtgagaccctgtctcttacaaacaaaacagaaaagtttttacatttgagtggtttctttgattttgtaagaacattttaattttagatatttaaaaatatttaaaatacagcttaaaaaataaaacaatcctgtttccaaacagtcaaaatttaatcactaacatttaatttcatttctcttgtttttatatattcaaggcttattgtgtaacagaacctggagcaggctctgatgtagctggtataaagaccaaagcagaaaagaaaggagatgagtatattattaatggtcagaagatgtggataaccaacggaggaaaagctaattggtatgttgttcaaaacatctttgtatattttttcttaattgttttatcttcaaatctctctttctttctgtatatttttaaaccactacagttaaggtatgtttgtggaactggaaggcctaaaggagattataaacagttcagtgattttcaaaaactaattttaagcccctgcactgttttttcaaattaactctcagaagtttaatgtgtaaaataaaatacaaatgcgtgctctgtttgaatctgattaggaaggctagcactctgtctacttggcttattatctccactcctcatctcctataccagccgctccttggaatccctaaaaccctaaggaaaaaggagaacctttggtatagtgcctgtctccagatgtcagaaataaacagagtcagtcttaaaacaggttatctattagagaagacagaatttgactttaataaaatctgaaattttctaatatatggtcaaaaaatatgaagttcaacaaaggatcaaaaataatttgtataaatataaaatactaaaaaaaaacactcgattatttgttgataaaagatgaggaaagttcaataactgttaagttcaataagaatcaatagtatgagcctttaaaaagccaatgtaattttaagccaaagtaatagaagtacagcatcaaatagagaaaaaatggtgacagttctgggcaacacattttaaaacatgtattgaaaaacttgactaaatctagaagcatgtaagtatcttgcattaggaggagcctacaaaacatgttctgaaaagcaaagccttggttattttggaagaatcttgaagtttttcaaatattattacacagaaagatgatcaggcttatatgtttacttcaggatgccagcttagaattaatgagtgaaagttagaaaaatgtagaatttagcttaacataaggacaggctttctatcagcagtgctgttaagttgtcatgggaaatactgtatttacccatcactacaagtatatagagagtttctagaataactttttattgattggaataatgtactaaatgacctgtctctctttgtaaaaaattcagattcaatatatttgtgtgccatatactacagttttctagcaaataaaacatcattttttttcagagtgagcctactaaaaagttacttagattaaacatatcagtcaattccttatgagcatcctaaatatattcagtattatggagtgctatatctttacctttaaccaattcctggtaatatcagcaactaataaaaagtgaagaaactattaaaatttaacaagttgagagaaatctaacaatgcagtttgaagttttcgtaattttaaaaacggattagccaggtgcaatcactcacgtctacaatcccagcagttttggaggctgaggcaggaggattgcttgagcccaggggttcaagaccagcttgggcaacataacgagaccccatctttacaaaattaaaacaaaaagaaagaactgattacaactgttcactgttcatatagtaaggcaaattaggtaatatatgaaaccagataacaatttttacgattttgttactattattaaataaaactatagaatgagtggtaatgtattggttttaaccaaagaaaataagtttgtgttgtttagggaagaatatacctttttaaaagaatttttcgtgtaccaggatatatagaacatgaattagacagatgcttggatatttgcatttttttcttatgttgcacttcaagatctttctgagaaattcttctgtaggaaaaaatcagcaaatattcataataactcagctataacaaaaacactgacttgctgcataaagaaacagtagttggaacatatggatctccattttatttatttatttttttgagaacatctgccctttaatttgcatttaaaatcagtttctttaaatactttagttacaagttctgaatagtgaagacagagtagtagatgctgcaggcactcagtattggctcccaccccttcccccctccccacccccaggcctcacttcttggctcaagatacaaaaaggcactctctactggccctagtgtcaaatgtcagcagcctcaggcctggatgcagttggatacaaagccatgaatcccagtagctccaaggaattccaatgattgtgcccagatccaccggcaacacatcttagaaatgacctcatccattacaccactatctactaacaccctcagggtggtttcctaccccagtccacgtcctccaaatctgtgtcctgcagaggaagagacaaggccccactataacgcaggaaggaacaagaactgcctcctcagcccacgggcttacagcaacttacttgaaaagctcaaggcaatctgagtctagaggagacctcccttccctaatctctaccaggctctggcccttcttcgggactacgcttggttccactgccatgatgtgctagaatctgctctaagtaagaacaaggtgctagaatgaggcccagcaaccaggaaagggttgctacagccccagctgtgtgagattgtgccaagatgagtcttcttggtgtgagcctatgatggagagcgtgagggcagacctgggctctccttctatgatgattacaacacgtgacctcagggaacctctgctctctcctcccattcacacacccagatcccctggcctgtgcttcctggtagaggtagaagaggcatcttgaagtcaatgacaatggagaatgaaggtgccattgaagaaggaaagcagcacctctttgcctgtgttcaatccctccatacaagtggaatcgagaatgtgcacagccaggacagaggctgctctgagcttgggaggcacagcatcctcctagatgtctctgcagaacaaactttcaaaagataggaacttaatcacatggtcctcgggggtttctctatagtataccagcactagggagaagcaaaatcatctttgcagagagctgatggaagaaaggcaggaatatgaatgagcatccattaaggctctctctctcaagcctaaggaattaagatattcgagggtatgagacaggtgcagagagggagagagccaggcaggaacaccaagaaaaaagctgtgactgctggttacatagtgctctgcttccttgcttgaggccaacagcatgtgcctgtcaccaggctaacctgggacccatgaggggacagggagaagactggttttcagttcctgcatgatcaatttgtagggtgtgtgggttcctcctaaagatcaaagaggaggactctgggatcctctaccgctgccttgattttgcggaggaaagtcacagcctctctgccatcaatcagccggtgatcataggtcagtgccacgtacatcatgggctgcacctctaccttgcctcctatagccactggcttgtcaaagatgccatgcatccccaggatggcagacaggggggttgataatgggtgttcaaagagtgagccaaaaacacctccattgctaatggtgaaggtaccaccatccatatcttcaatggcaaattcattctttcgggccttctctcccagttcagtgatggtctgttcaatatctgcataattcatagcttccacattcctgatgactggaaccaccagaccctgtggggtggccactgcaacactgatgtcaatataatccctatataccacctctttggttatatcatcaatcactgcgtttacaacaggctgttcctgcaaggcaaaggctgaggccttcacagatgccgacatgaagcctagtttgaggttatgtttcttcaaaaaagcctctttgtgccgagccctcatcttctggatgttactcacatcaatctcattaaaaattgtcagcattggcacatgtattctgggcctccttcagacgctgagcaatgcactgccgcatcctgttcattttctcctgatgttctgaatgcagacctttgccagctcctggctcagctagtggtgggacagcagtgggttttactgcagacacaggtttgctagaaggaggttgtgagggcgagggcactggtggcatcgagtgggtatgggtgctgcatggggaggaactgccgctgctataggttctgcttttggggctgcagcagcaggagcttcagccggcttggccttagcaggagcagcaccagttttcctgagtgtgaaaagcggagtgcctccttcgacttttcccccatcaggtacgaaaagagcttcaatcatgccatttgctggtgatggaacctgcaccaatgtcttgtcagtttcaatctcacaaaccacttcatcttctgcaactgtgtctccaacagctttctcccacctgacatctccctctgtgacaggttctgcaaacgctggggttttgactgtaaccaagtcatacttgcatacagttgtagttctgaagaagcgaacactgaagacactgttgttaatgacaaccttcctgctgttagggtaacctggtccctggcataaggagaccccaggcagggaatgtctccctagagggcagttccccttctggaaggcagagagcgagtggctgaacgcccgggacacagtgggaccgggacagcatcacggcggccgggtctccgttttatattattccttttcacaggcagctctatttgccctccttttcaagatagcatgccccttaaagaataaaattagttttgggaaagaaaaagtgccagtttcaacaggcatagactgtcttgttgtaataataatactataccaggaatttttacttgcaactcatattactaaaagaaagttaaatagcatactatagtccctccttatccttgcaggatacattccaggacccctaatggatgcctgaaacctcagaaataccaaaccctgtatatactatgtttttttcctacacatatatacttattataaagtttaatctataaagtgggcccagcaagagattaacaacaactaataaaatagaactataacaatgtattgtaataagttatgtaaatgtaggccaggcatggtggctcacacctgtaatcccagcactttagaaggcccacgtgggaagatcccttgagtccaagagtttgagaccagcctgggaaaggtagtgagacttcatccctacaaaaaataaacaaaaaattagctaggcatggtggcacatgcccatagtaccagtgactcagaagaggtggaaggatggcttgagctggggaagtcgagactgcagtgagccaagatcatgccactgtactccagcctgcgcaacagagtgagatcttgtctaaaaaaaaaaagttatgtaaatgtcctctttgtctttcaaaatatcatatatactgtactgcgggtaactgaaaccacagaaagtgaaaccccatggaatgggggagggcctactgtgttattaagacatagacctcaaatactagctcttccatatactaggtacgtgactaggcaagtttttaaacctgattatttatttcctcatttgtaaaatgtaggtaataataattgggattgttaagagaattaactgagagagcaatcaccatgtgttatttgccgatattatcaccattatccggtatgtgtatctcttaggtattttttattggcacgttctgatccagatcctaaagctcctgctaataaagcctttactggattcattgtggaagcagataccccaggaattcagattgggagaaaggtaaagtatttattaatgattagggccccaaatattattttaattataaattgcaaaattacttaactttcctttaataaaaacatttgtttgtattaagttggagtaaaaataaagctatgttttgatgatattagatcaaatagtctatatactactgaagattttgtgaacagtcatttcaagtcattttgaaagagtagtaccaacctgtggagaaggctaataacagctgtgaggaataatgaagtaaaatcaagctatcatttatattacctgaccaataataagaattctggatatttcaagggactttcccactcttttccccattggatcctcacagcaaccttttggtaggataagtggcattatgcccattttacagataaaaacaatgtgacataactgagattttactaggtcatacaacactaagaaaaaagtctatgcctgaaaagagtgtagaaaatagcaaatagccttgaatatggaaaggcaagaaaatcttacttaaataagaaaaggtaatttaacatatttgaaaaggtttgtattctgaatatgtggagataaatttggcatttaaagtagactaaagagaaaagagtttaaaattttataaatcacaatttaaaattataaattttataaagaaggaaagaaatgaagtcaataaagtaattttttttttttttttttgagacagcgtctcgctctgttgcccaggctggagtgcagtggcaggatctcagctcactgcaacctctgcctcctgggctcaaacaatcatcccacctcagcctcctgagtggctaggattattggcatgcaccaccacacctggctaatttttgtattttttgtagagacagggttgtgctgtgttgcccaggctggtctcagactcctgggctcaagcaatcctcccaccttggccccctaaagtgctgggattacaggcatgagccactgcgcccaaccaaagtcccaaagttagaggcagagttgaaatcaatatgaaggtatcctaggaccttacccagtatagtttctgatactgtattgtgctatattttcaatcagatattaaaggtagactgcacttgacaaaacagatgatactgttgtatgtaacaaaatataagaattaaaaattattgtgcttttcccaagaaattgttttttatttgtataacagatcatgtttctgtcttagggatagttgctagcaaacttggccaaatgtatggcccatctttagaaagtataaaggacctaacagcttatactttttttagtagtaaactcactcctgattttatcttgctatttctagtttttttctttgcctaattttctcacttaaaaaaaaatctacttcaataaatatttatgtagtgcatactatatacagtattctatctattagggatacagtatggatcaaaatagacaaaaatccctggccttaggtaaattactttctggtgagtgatagagataattatattgtgtatatttaagcctccttaaatctttattgaaacaaatggatatttacaaatttgtgaaatttaatgttttcaggccaggtttggtggttcatgactgtaatcctagcactttgggaggttgaggtgggagaactatttgaacccaggagttcaggaccagcctgggcaacatattgagactttacctctacaaaaaaatttgaaaattagccagtggcagtggcgcacacctgtagtcccagctacttggaaggctgaagtgggaggatcacctaagcccaggaagtcaaggctgcagtgagccatgctcctgttgctgtctgtactgcagcctggatgacagagtgagacctaatgttttcaaatcttttgtgttttagaaattatatggtttgagatgagcccaggaagcattttggttttaaatgttgtggggtttgggataaatctggtagggtgttttctcattatatatgcatggtggtccaagattctagtttattaacttttaaagacaaaataaagggatgttggcttctttctaggtcaaactatcgttattatttcttcaaactcagaagcagactattaaaaccagcaaattaaagggttagtttatagctctttgtttccattgctcctgtttcttattctgcttattaaacatgagatcaagtttttttccttattaagagttatgtctgcaacttcctctcatgatttagcataacactaatagtcatatacaaagagaaagagaaataaaaaataaagcaaatgtatcaaaatgttaacaattggtgaatctattatagatgaagggtgtataagtacttacatgcctgttacaactcctccattggtttgaaaatttttaaaacaaaaagttgagggaatgtagctagtttagtagtttcttataaagtcaaacatacacttatcacataaccagtgcccttaaataaatacccaagagaaatgaaaataaagacctatatacaaatgtttattgtaattttattaatgattgctaaaaaggaggggagtatccgtcaactagtgaaaagataatggatatatggtacatccaagagtgggatactacttagcagtaaaataaatgaattattgatcatgcagcaacatggatgaatctcagaagcactatactaagtgaaaagtcagacacagaaagcggactttattatttcacttaaatgacattctggaaaaggaaagactacgcggagagaaatcacacagtggttgccaggggataagtgtagaataaggaaattgactataaagggagaacaaggtaactttttggggttctaaagtactctgtatcttgagcatggtggtggttacacacatatacatttgtcagagctattagaaatgtatacataaaaatggtgacttttctacatgtaaattatacctcagtaaacctaattttaacagagtcaaaggaaaacaaaatcaatttttattcagtagattattttactagctctattaagattaaaggtctcaaatcagattgtgtttactaaatgttttttctgacatggtaaaatagatagctttcaaacatataatgagatttgtctttgttgataagatgtacttgtagacctttagactagtgttggtttcaaaatttgtgaaacattgttttagattatggttggcaaatttttttgtaaagatccaaattataaatatttcaggctttgcaggccatatctctgtcacaactactcagttctgccattgtagcaagaaagtaactgtagatgatatatgaacaaataggcgtgactgtattccaatcaggctttctttgcaaaacaggcattgcagactacagtttgttgatccctgttttaggtaattgcagaaagtcatgaaacagtgattaaagcaaaaattgatgctggctcaaaaaaaattccttaaaatatatcaattttcttattaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtaagtaatatgggttcataatctttataggatcttttatttattacattaaataagtatttttactttaaaattgtatgttcagtgtgtttctctttttaatatctgcttattttattaaggatataggaaaaatactgttacttttctttctttttttttttttttttttgagacagagtctcactctgtcaccaggatggagtgcagtggtgcaatctcagctcattgcaaccttcacgtcctgggttcaagagattctcctgccttagcctcatgagtagctgggactacaggtgcacaccactctgcccagctaatttttgtatttttagtagagatggggtttcatgatgttggccaggatggtctcgatctcttgacctcgtgatctgcctacctcggcctcccaaagtgctgggattacaggcgtgagccaccgcgcctgaccatattgttacttttcttaattttttaaataattcttcaagttttcttactatacattatagaaattattttagcaactgcaaaattactgtagttggtgctagatttagagaggcagtccaccctaaatatgatcatcctgttaatatgtactcattttctgtttttactcattaagaacatttcccctagtaagatttctcttgttaaacaaaagcaatgacttttttctagagtatgatactatgcctaacaaatgcctcttactacctttaattaacaaataatataaacttacgtgcctattccctgttccccaccagtttcttgttgctgtacatcaccttctctttgtacactccctaacatagacacttaggcagatattgtgtgttttaaagataacatgaacttttgctttataatatcttaaaatactaggtagctgctggtgctgttggattagcacaaagagctttggatgaagctaccaagtatgccctggaaaggaaaactttcggaaagctacttgtagaggtaattttaatactgcttgctttgttcaaatgtaaagacactcattttcatttaatatttagaaatgatttttaaaccacaaactaatcaatttctactttgatagcaagaagataatgtggttttatcaagatgagtttcaaagacatttctttttagagtgtgccactattggttacttctgaacctgacactgtgctatgcatttttttttttttttgagatggagtctcgctctgttgctcaggctagagtgcagtggcacaatctcggttcaccacagtctccgcctcccgagttcgagtaattctcctgcctcagcctcccaagtagtgggaactacaggtgcgcaccactatgcctggctaatttttgtatttttagtagagatggggtttcactatgttggccaggctggtctcgatctgcccgcctcagcctcccatagtgctgggattacaggcatgagccactgggcccggccttgtgctatgcattttaaatatattttctagccgggcgcggtggatcacgcctgtaatcccagcactttgggaggctgaggcgggcggatcatgaggtcaggagatcaagaccatcctggctaacacggtgaaaccccgtctctactaaaaatacaaaaattagccgagcatggtggtgggcgcctgtagtcccagctactcgggaggctgaggcaggaggatggcgtgaacccaggaggcagagcttgcagtgagccaagatcacgccactgcactccagcctgggcgacagagtgagactccgtctcaaaaaagaaaatatatatatattttctgattctctcagtaacccttttttgggtggtgttatctcttttaaggatcaagaaactgaagctcagaggtattaaatgatttgtccaaggccacacaatttataagtcacagatccaggatccttgcttttttttttttgcggggggtgggagacaaagtcttgctctgtcgtccaagctgaagtacagtggcatgatctgggctcactgaaacccccacctcctgtgttcaagtgattctcctgcctcagcctcccgagtcgctgggactacaggcacacaccaccacacccagcaaattttgatatttttagtagagatggggttcccttatgttggccaggctggtgttgaactcctggcctcaagtgatctgcctgcctcggcctcccaaagtgctaggattacaggcctgaaccactgcgcctggcctatgttatactcttaattcttgttacttcccatgtcctcttgagtatcagataattttagtactataaagagtcgtgtcttccatgaatttccagggtaattcttaactcttacccctttaaatattgatgctcccccattatctgtattctttcctgcaactcactatgagttgtatagtgaacctcctatttctctttttttttttttttgagacagggtcttggttgcccaaatgcgagtgcaatggtgcagtcatggcttattgcagcctcttgggatcaagcaatcctcccacctcagcctcctaaataactggaactataggggcacactaccatgcctgcctaatttttttatttttgtagagatgaggtctcactatgttgcccagactggtctcaaacacctgagctcaagcaatctttccacctcagccccccatgagcctcctattcctatctccatttgtcagtggttctcaaactatttgtggtgaaagaccagtttgttttaatttccagttaatgtggaccattatttttgtaaaatataagaatgtcacaacaatgttaaattgctgtaaaagtgtctaaatgcttattctcatcttctgtaccatcaaccagtaacagtttgtgaattggcactgtggacaaacttggattagcactgctctgtgtcccttaaccttagtttcataatgtatctttctacactatattctagataattttttcagatctgctttctagttctcttatcttgtgcctaatctatttaatctgttgattttttattaatgactacttttcatttccagaagttatatttggttttttccattataccttctgttcaacatcataccgccttttccttttttctcattaatcatgtaaaaattcttcatttataatcaatttcagatttttttgttatcttcaattctttgggtgctaatctttcaaggtgtattgtgtcttctaactcttttatggtcaattattttgcttttattttttatttgtaaacaacttacctgcaggaagtactctatttctcagagcattatggaagcattttagaaattggcttttgtacttttttggcacttttgttaggtactccagagatttcaccattctaagagctgttattttacattaatttcttgacttggagaatcctgtatcacagagctcgtacattgatctcacacattaagaaactccgtacattccagtctgggcaacagtgtgagaccctgtctcaaaacaacaacaataacaaaagtccttttttttcttgttctttttttaaccctcctgggcaagagatcagcttctttgtggccctcctatgctgatgagcccagacttttaattgcccctttggaaagcaaagcttttacatgcagtgattctcagttttagccccttagattgttcatgctcacatcgaaatctcctgttcttatgtgtttcttaaaactctggttcctatcctgctgagcccaaatctgagtctgatttttcttttcctccatgttatctcttctcaggatttaaattcctttttagaggcacttagagatttctgtttctttcctatgagctttttttttttcttaaccaagtatttctttgttaactccttcatgttgccagaactacatatgtacattttactaaatgttagtttatcttattcataaacaaatttcaacctaatgcttttcagtgaagatctgtcatcgtcttccaggtcctccttacccaagtatctgatgataactgtatttttggctttcaactcaatatagaatcttctccttttatgttctctttcttataaattctaaagatttttttcttattaaatattgaaaaatcttagtttttccttactgcttaactcaaaatagtcttttatcatttgatttctactgaagatttgcttatcttttaagcactctgcaaaatgctgatagcttctttttttttttttttttttgagacagggtctcactctattgcccaggctggagtgcaatggtgtgatctcagctcactgcaaccactgcctcctggcttaagtgatcctcctaccttagcctcctgagtagctggaactataggtgtgagccaccatgctcagctttttttttttttttttgtagaaatggggttttgccatgttacctaggctggtctcgaactcctgagcttgagtaatccgcccatcttggtctcccaaagtgctgggattacaggcatgagtgactgcgcctggcctagtttttcatttttaattggtaggtacagtgatatgacactgtaattccttgtcactcctttgctaggtgtctctcaacccatttgtgtgccctttgaaacttcagttttttgttttttttttttttttgagacggagtcttactctgttgcccaggctggagtgcagtggtgcgatctctgctccctgcaacctctgcccccggggttcaagtgattctcctgcctcagcctcccgagtagctgggtttacaggtgcccgcaactgcacccggctaattttcttttgtacttttagtagagatgaggtttcaccatcttggccaggctggtcttaaactcctgaccttgtgatccacccaccttggcctcccagtgttgggattacaggcgtgagccaccgtgtccagccacttgtctttcagtctgtgtactctatgtatagcattatgaatgaaaagggtcaggttattcttggaatccacaattaaataattgtttagccatttcatgtgtggtattagaaaatatacaatgatctgcccaagggttccaagatggctgaataggaacaactccagtctacaggtcccagcatgagtgacacagaagacgggtgatttctgcatttccagctgaggtaccgggttcatctcactgggatttgtcgtacagtgggcgcagcccacagagcatgagccgaagcagggcaggtcatcacctcacccaggaagcgcaaggggtcggggaattccctttcctagctaagggaaactgtgacagatggtacctggaaaactaggacactcccaccctaatactgcgcttttccaacagtcttagcaaacaacacaccaggagattatatcctgcgcctggcttggagggtcccacacccatggaacctcacccactgctagcacagcagtctgagatgaaactacaaggcggcagcaaggctcagggaggggcatccgccattgctgaggcttgagtaggtaaacaaagtggccgggaagctcgaactgggtggagcccactgcagctcaaggaggcctgcttgttgctgtagactcccctctgggggcagggcatagctgaacaaaaggcagcagaaacttctgcagacttaaacctccctgtctgaaagctttgaagagagtagtggtcctcccagaatggagtttgagatctgagaacagacagactgcctcctcaagtgggtccctgacccctgagtagcctaactgggagagacctcccagtaggggccgattgacacctcatacgtccgggtgcccctctgagacgaagcttccagaggaacaatcaggcagcaatgtttgtcattctgcaatatttgcagttctgcagcctctgctggtgatacccaggcaaagagggtctggagtggacctccagcaaactccaacagacctgcagctgagggtcctgactgatagaaggaaaactaacaaacagaaaggacattcacaccaaaaccgcatctgtacgtcaccatcaccaaagaccaaaggtagataaacccacaaagatggggagaaaccagagcagaaaagctgaaaattctacaaatcaagagtgcctcttctcctccaaaggaatgcagctcctcgccagcaacggaagaaagctggatggagaatgacgagttgagagaagaaggcttcagatgattggtaataacaaacttctccgagctaaaggaggatactggcaaactgaatccagcagcacatcaaaaagcttatccaccacgatcaagtcagctttctccctgggatgcaaggctgattcaacataccttgaatcaataaatgtaatccatcacatacagaaccaacgacaaaaacttatgattatctcaatagatgcagaaaaggccttcagcaaaattcaacagttcttcatgctaaaaactcaataaactaggtattgatggaatgtatctcaaaataatagctatttatgacaaacccacagccaatatcatactgaatgggcaaaatctggaagaattccctttgaaaactggcacaagacagggataccttctctcaccactcctcttcaacatagtgttggaagctctggccagggcagtcaggcaagagaaggaaataaagggtattcagttaggaaaagaggaagtcaaattgtccctgtttgcacatgtcatgattgtttatttagaaaaccccatcatatcatcccaaaatctccttaagcagataagcaacttcagcaaagtctctggatacaaaatcaatgtgcaaaaatcacaagcattcctatacaccaacaacacacagagagccaaatcatgagtgaactcccattcacaattgcttcaaagagaataaaatacctaggaatacaacttacaagggatgtgaaggacctcttcaaggagaaccacaaaccaccactcaatgaaataaaagaggacacaaacaagtggaagaacattccatgctcatgggtaggaagaatcaatatcgtgaaaatggccatattgcccaaggtaatttatagattcagtgccatccccttcaagctaccaatgactttcttcacagaattggaaaaaactactttaaagttcatatggaaccaaaaaagcccacattgcccagacaatcctaagccaaaacaacaaagatggatgcatcatgctacctgacttcaaactatactacaaggctacagtaaccaaaacagcatggtactggtaccaaaacagatatatagacaaatggaacagaatagagcccttggaaataataccacatgtctacaaccatctgatctttgacaaacctgacaaacacaagaaatgggggaaggattccctatttaataaatggtgctgggaaaactggctagccatatgtagaaagctgaaactggatcccttccttaccttatataaaaattaattcaagatggattaaagacttaaatgttagacctaaaaccataagaaccctagaagaaaacctaggcagtaccattcaggacatagacatgggcaaggacttcatgtctaaaacaccagaagcaatggaaacaaaagccaaaattgacaattgggatctaattaaactcaagagtttctgcacagcaaaagaaactaccatcagagtgaacaggcaacctacagaatgggagaaaatttttataatctacccatctgacaaagggctaatatccagaatctacaatgaactcaaacaaatttacaagaaaaaaatcaaccctatcaaaaagtgggtgaaggatatgaacagacacttctcaaaagaagacatttatgcatccaacagacacatgaaaaaatgctcatcatcactggccatcagagaaatgcaaatcaaaaccacaatgagataccatctcatatcatttagaatggcaatcattaaaaagtcaggaaacaacaggtgctggagaggatgtggagaaataggaatacttttacactgttggtgggactgtaaactagttcaaccattgtggaagacagtgtggcaatttctcaaggatctagaactagaaatgccatttgacccagcaatcccattgctgggtatatacccaaaggattataaatcatgctgctataaagacttctatgaccaaagatgtaggaggatttcccacccacaccaagcaacagacactagctgggtatcctccaacttagttctgacactacctacccagagatagcatcagatcccacaggcttagtctcacaagactgccccttcttttcccctagttgcaagtcctggactccagaacttctggctgactggcttcaagttggggttcccatgacctcatctgtgaattccagtaatttgctaaagcagctcacagaactcagggaaacacatttaccagtttattaggaaggatatctaatttttttactttttttttaattattatttttttcatacagagtctccctcttgttgcccaggctggagtgtaatggcgtaatcttggctcactgcaacctctgcctcctgggttcaattgattctcctccctcagcctcccacatagctgggattacaggcacctgccaccatgcctggcctttttttgtttgtttgttttttaagtagagacagggtttcatcatgttggccaggctggtctcaaactcctgacctcaggtgatccacccaccttggcgtcccaaagtgctgggattacaggtgtgagccaccacgcccagccaggaaggatattttaaaggatacagatgaagagatgtgcagggtaaggtatgagggaagatgcatatggcttccatgctctccctgggaatctcaccctgtaggaacctctggaagctctccaaaccctgtcctcttgagaggtgaagccagctggacttcctgggtcgagtggggacttggaggacttgtctgtctagctagatgattgtaaacacaccaatcagcactctgtaaaaatgcactaatcagcactctctgtctagctaaaggattgtaaacacaccaatcagtgctctgtaaaaatgcaccaatcagtgctgtgtctagctaaaggattgtaaactcaccaatcagcactgtgtaaaaatgcacgaatcagcgctctgtgtctagctaaaggattgtaaatgcaccagtcagcactctgtaaaatggaccaaccagcactctgtaaaatggaccaatcagcaggatatgggtggggacaaataagggaataaaaactggccaccccagcctgcagcggcaacctgctttggtccctttccacgctgtggaagctttgttcttttgctcttcacaataaatcttgctgctgcttactctttgggtccacaccacctttaagagctgtaacacttgccacggaggtccgcggcttcattcctgaagtcagcaagaccacgaacccactggaaggaagaaactctggacacatctgaaggaacaaactccagacacaccatctttaagagctgtaacaccgcgaaggtctgtggcttcattcttgaagtcagcaagaccaagaacccactggaaggaaccaactctggacacactcttgggtgttcatggaggcttcattacataggcatgattaattaaaccattggtcattgatgatttaacttgacttgtagcccctctcccctccctggaggttgtagggttggggctgaaactcccaaccctctaatcctgccatcgtctttccagtgaccagcaccacgctgaacctagcagacaaaagacagcacgttggagatcccaaggaatttaggagttgtatgccagggaacaggaacatatttccatcctataacatatcttggccatataactaactcatagagcacttactatcccttattgaaagtatttgttttatgtcttctatttaattctgagcctctagagtctaagaagcatcttttagttgtcctttcctctgtcttggtatctgatacagtgccacattatttttctctatctgtagcaactttcttttttttttttttttttttttgagacagagttttgcttttgttgcccaggctggagtgcaatggtgtgatcttggctcaccacaacctccacctcccaggtttaagcgattcttctgcctcagcctcctgagtagctggtattacaagcatgtgccaccatgcctggctaattttgtatttttagtagagacggggtttatccatgttggtcaggctcgtctcaaactcccaacctcaggtgatctgcccgcctcggcctctcaaagtgctgggattacaggtgtaagccactgtgcccagccagcaatttcttctagaaagtcccagcagaggctgggtatggtgaatcacacctgtaatcctagcattttgggaggccgaggtgggtggatcccttgagcccaggagtttgagaacagcctggaacagcctgggcaacatagggagggacctcatctctatttaaaaagaaaaaaaagaggccgagtgcggtggctcacacctgtaatcctagcactttgggaggctgaggcgggtggatcacctgcgatcaggagtttgagcagcctggccaacatggtgaaaccctgtctctactaaaaatacaaaaaaaaaaaaaaaaaaagcctggtgtggtggcacacgcccagctactcgggaggctgaggcaggaaaatcgcttgaacctggggggcagaggttgcagtgagccgataacgcaccacttcaccccagcctgggcaaaagagtgaaactttgtctcagaaaaaaaaaaagaaaagtcccagctactttgggggctgaggcgggagggtcgttgaggctgcagtgatctgagatcatgccattgcattccagcctggaaaacaaagtgagaccctgtctcaaaaaaaaaaaaaaaaaaaaaaaaaaaaaaaaaaaatcaggcaaactgaaattgaaggacattttacataaaataaccaatcaacattcttcagaagtgcaaagacgtaaaagataaggaaggattgaggaattataatagcctgggaaagaataagaagaaataactaaattcaacgtataatggtggaaaaagaacattagtagaaaacttgaccagatttgagtaaggcttatagtttagttgttaatactataccagtgttaatgtcctgttctcgatcatggcactatggtttggtaatatgttaacattagaggaagctgggtgtaacttctataaacctaaaattcgttaatgaaaagtttaaaaaataaaaaggtcaggcacagtggctcacgcctgtaatctcagcactttgagaggcctaagtaggaggattgcttgaggccaggagttgcagaccagcctgggcaacatagcaagaccccgtcactataaaaatgaaaaagccccaggaaaaaacttttaagttttctcaataaatatcctttaatttttttctttttaattctagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcaggtaaggttaaagatgatttttttggtttgcaaggagagagaatattcataaatgacaacgtggatttctgattatttagaaattttatgtccctagtagcaataaatgactgtcatatatggctgtgagccagtttttggaattaattaatagaaagaagaatgttatttgtgattaagtataagtctgaagagagaataggctaaaaaaaatggtacagacatgtgtattacgtttggattagatttctttgagttttaacagattggctaattgtaacccaaacttttctctccaaaaagtatgcatgtcatttaaaattaattattttgatttgaatcttgcctgacaactatttaatttattgtaactatacttggagtcaaaaaccaacatcaggagacagtgatgtagattaattccaaattaaattggtagtcaaaaaaacttaggaggaattcagtaaaaggaaatataaatgtgcatgttctctacatgtggcttaagtaattacttaataattaccacattcttgctcctcagtatctcttcccttgttccccctacacctagcaaattatttgactcatccagtcattggaaatactgagttcgaatcaaaatgctggagtgagaaggaatgttacacgtagtgcagcctctccatgtagacatgaaaaaactgaggtccagaatttgtgccttatccaaagtcacaggtttatgtggtgatactcttcctctcctagagcctttaattataattattactattattatcatcaacagtttagcttttctctgccatctgagaagatgaactaacgaatggctaaagttagaagtttagaatggaaataaggtctgactcttgaaatccttccagcatctttttctttagcaactctgttccacaggcagtgggagaaaaaaaaaaaattaagggtaagaataaaagactgaaggagacagctagctaagaacagttcagaaaattagacaaatattttggccacattaaactttagttttcccaaactttctgaaatgtaaatatcttttctttttttatattttgaagactcttctccaaaattttgataaatggctttttataataacttaaccaatctttagagaattccatattttcagactttcacaaaatcaggttttggaatctgtagaggctacagaccctatatatggtttgattcggttttatattacaacacagcttatgctactgtctaaaatgttgaataaatcaaagtatttatgtactaaagatatttaacctacacttatatttttcttgcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatcatatctttctgtattttttccaggaaatttcattacttcgtgtaatagtgtatatttcttgtatttactatgatgaaaaaaggtcgttttaattttgaattgaataaagttacctgttcattttttattagatattttaaagacttcagaaaatataaatatgaaataatttaa

SEQ ID NO: 1501 - DNA, 39313 bp, Homo sapiens; identical to SEQ ID NO: 1500
  source 1..39313: mol_type = genomic DNA

SEQ ID NO: 1502 - DNA, 2488 bp, Homo sapiens
  source 1..2488: mol_type = genomic DNA
cccccagtagaaatatgaatagaaatcaccctgtgggcaatggtcccattttaaaatatgctgtcccattgtcccctagagcctactttaacttgtcagaccatgtattccacttcatatgcaagaggcatgcactgagcccataggtggctaggcaaacacccaatagctccctgaaatggcttcattatgcagcctcgacagccaccccaaccctcccactctcacactgaaacacccagacctagagatagctagacacacccagacacccgccaagcccctcacatacagatatgtgcacaatgatacacagcaaacgtacacagagttcagtacacacaaagagctcacgcccacgtgcacacacccctcagttgggacagagttgaccaccaccacctttctcccaaacacatggcttttgaactgcctttccttggatccagttcaaggggatggaggagcagtgagagtcagccgcccttccactccaatttcccagcacctcccttatctctgcctcacaagtcacccagcccccctctcttccttccttgtgcttgaagaatctctccttgctggaaagccccctgttttctcaatctccctttccacttcggtaaaatctctacttgctggaaagccccctgttttctcaatctccctttccacttcggtaaaatgcccactttctggtccccacctttttcctgagtgtagtcccaaccagccaaatccaacctcaaaacaggaagacccaaggccagtgacccccataggcctgaggcttgtgcaggcagtgggcgtggggtaaggcttcctgatgccccctgtccctgcccagaacctgatggccctcattagtccttggctcttatcttggaagcacaggcgctgacagccgtcccagcccttctgtctgcgggcctgaaccaaacggtgccatggggaactgtctgcacagggtgagtatggggccaggccccagagtcccttatccctatgcccctcatttcccgtgctgtttgcccctcagtctttatatctcttccttttcctcctcatcttttctcccttcctgcttttttcctcttccttcaaagtctttttccttctctccttcctatgctagcctcctagctccctcttgtgtccctccctttgcctttgagtcagttccatcctggtctcttggtgccttttccttctgaccttgcactgctcctccagccccagctgccctggcttccccaggactgttcctgctccggctcttcaggctccctgctttgtccttttccactgtccgcactgcatctgactcctgcagagaccttgttctcccacccgaccttcctctctgtcctcccctcccacctgcccctcaattcccaggagactcttccggtgtaactctgatggcctcctctgggtatgtcctccaggcggagctctccccctcaactgagaactcaagtcagctggacttcgaagatgtatggaattcttcctatggtgtgaatgattccttcccagatggagactatggtgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtgaa

SEQ ID NO: 1503 - DNA, 1242 bp, Homo sapiens
  source 1..1242: mol_type = genomic DNA
ggcttccccaggactgttcctgctccggctcttcaggctccctgctttgtccttttccactgtccgcactgcatctgactcctgcagagaccttgttctcccacccgaccttcctctctgtcctcccctcccacctgcccctcaattcccaggagactcttccggtgtaactctgatggcctcctctgggtatgtcctccaggcggagctctccccctcaactgagaactcaagtcagctggacttcgaagatgtatggaattcttcctatggtgtgaatgattccttcccagatggagactatggtgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtgaa

SEQ ID NO: 1504 - DNA, 3079 bp, Homo sapiens
  source 1..3079: mol_type = genomic DNA
ttcagccttggcaactattcttttattgaacatcagtaacagaaagatgcttgatttaggaggaagctttccctccctccctcccccattgcaccccggaactcagcaaaggtgagccagccacagagcataacactgtggctgggacacatgtccatgtgtgtttcacatacgtgggcatctgtgccacaagggtcatgtggcaccacagttcatcagctgtgtttccccttcctgccctgctgcagcgccacaggttggaggaaaagcctgcctgtgagcagggtcccggcagggcccacccacccaacagtggagatcgggcctcagagctgggcagtcatgggagttcagggcctggctcgcctcggcagcctggtcttaaagagggacttgcccgaggcctcgatgtaagtgacagtcatctctttggagctgatctccacataggcaaagccacccagtgagtcttcagtcccatagtggaagcgcagatagccgttggggaccttgcgctggtgccgctttgaggggtccatgaaattcccagccccactcagcacgtagcccacgccattctcatcttgcaggtactgaggatggaggacaaggggtcagtggagacccagctttgagcagagccctgcctaaggtccagggctcgatctggccctaaccacagagtcaccttgaggtatgtaacccctcctggcttcaatttcctgacttttaggagtgtattaatcctatttcataggtagagcacttagtaagaaattggtggccaggtgtggtggctcatgcctgtaatcccagcactttgggaggctgagggggtggattgcttgagcccaggaatttgagaccagcctgggcaacatagtgagaccttgcctctacaaaaaaaatgcgcaagggccaggtgcagtggctcatgcctataatcccagcactttgggaggccgaggcgggcagatcacttgaggtcagaagttcgagatcagcctggccaacatggtgaaaccccgtctctactaaaatataaaaattagcaaggtttggtggcccatgcttgtaatcccagctacttgggaggctgagacaggagaattgcttgaacccaggaggcggaggttgcagtgagttgagatcgtgccactgcactccctctcaaaaaaaaaaaaaaaagcaaaaattagctgcatgtggtggcccatgcctgtagtgtcagctactctggaggctgaagtgggaggttcacctgagcccgggagattgaagctgcagtaagccccgattgcaccactgcactccagcctgggtgaaaaacaatgaaaccttgtctccaaaaaaaaaaaaaaaaaagagcttaaaaaagaaagaaagaaagaaattggcaattcgaagatattattctggctttggagtgttttcctggttagacagcaagatttgagggacagtctagacattctgaaggccacaggagaccctcaaacagcaggaggaccccagccatgtggacatcagctgggatggggacccccctcacccagctcccaccccacccacagggccctcacctgcagattgtgatcgtggccgcacaggtaggcagtgaccccgtatgtggccagcagtggccgtagctgcttgaccaggcagtgggtaggcccgtgctcggctatggaccacacggggtagtggccagccaccagcacgtagtcctccctggccgccgccagctgtttcttgagccaggacagctgtgtgcgggccagcttcacgtctcggggcctctcaggctgctggctgaggaagtcatctgagttgccacatagtgtcactgtgtccagcataaaaatggccacagacacattggtctgtgggatcttgaagtgcaggcggtagaaagggctggggaagttcctgtggaggggatagaggtcgtgggtgcacatcttgggcgcagaagtcccagggtcagctcaagccacagggcccctgtgtccctgctatgtgaggatctcggaaggcagggctgagggtggctcaccagcgcttggagatcttagagtatgcaatctgggcagagacattgccaaggtggtcatggtttccggctagcacgtaccagggcactttgcgaagggagcggtcagagaatacgtcctcaaaggtctcctgtagcaaacagatagggcaggcctcttccctggggtcagtggctatgccgatcctcccaccaagtcaggataagggagacactgaatgctcccggcgcccaaaggtgccccatcaccttccctctgccctcaccaaaggaaggtcactaggtaaggcggcttctccccactgcccgcccccacctcctgccccactctgttgggcacagacctggaacctcttgtcattgatgtcttgcacaccagtgaagtaaaaattgtcccctagagacaggatgaagtctgcacccaggatctgcacagtccgagcgatctccttggcattggccatttcccgggccgtgtggaatggggcattggggacccctccccagtcacccacggctacaaagcgcagggcaggggtggcaccatcagccagggagggtagcaacaaggcttgcaggatgagcagcgccgtccacatgtccatctgggagaagagagacaagcataggtggcccgggctgtgacaagggcagggaggccttgagacccccgcctgccctgagatagagggagactgcttgctgcaggctgcccctgcgggaaccccttggtgccctaattctcaggacacacaagctgcacaaggctgcacaagctggcttagggaaggggggcgcggtctgtgagagggcgagctgtaccaagatggccctgcaggcccatttcaccctccttccacctagcctgcccagcactcacccagggggagacacaggccagtcaccggaggctctgagaggctggtgggctctagagtagaactgccggtccctgagcctttattccctgaggaggaagtggatcattagtgaggatgatgcagtttctccgagggctgtcccggg

SEQ ID NO: 1505 - DNA, 4118 bp, Homo sapiens
  source 1..4118: mol_type = genomic DNA
ttcagccttggcaactattcttttattgaacatcagtaacagaaagatgcttgatttaggaggaagctttccctccctccctcccccattgcaccccggaactcagcaaaggtgagccagccacagagcataacactgtggctgggacacatgtccatgtgtgtttcacatacgtgggcatctgtgccacaagggtcatgtggcaccacagttcatcagctgtgtttccccttcctgccctgctgcagcgccacaggttggaggaaaagcctgcctgtgagcagggtcccggcagggcccacccacccaacagtggagatcgggcctcagagctgggcagtcatgggagttcagggcctggctcgcctcggcagcctggtcttaaagagggacttgcccgaggcctcgatgtaagtgacagtcatctctttggagctgatctccacataggcaaagccacccagtgagtcttcagtcccatagtggaagcgcagatagccgttggggaccttgcgctggtgccgctttgaggggtccatgaaattcccagccccactcagcacgtagcccacgccattctcatcttgcaggtactgaggatggaggacaaggggtcagtggagacccagctttgagcagagccctgcctaaggtccagggctcgatctggccctaaccacagagtcaccttgaggtatgtaacccctcctggcttcaatttcctgacttttaggagtgtattaatcctatttcataggtagagcacttagtaagaaattggtggccaggtgtggtggctcatgcctgtaatcccagcactttgggaggctgagggggtggattgcttgagcccaggaatttgagaccagcctgggcaacatagtgagaccttgcctctacaaaaaaaatgcgcaagggccaggtgcagtggctcatgcctataatcccagcactttgggaggccgaggcgggcagatcacttgaggtcagaagttcgagatcagcctggccaacatggtgaaaccccgtctctactaaaatataaaaattagcaaggtttggtggcccatgcttgtaatcccagctacttgggaggctgagacaggagaattgcttgaacccaggaggcggaggttgcagtgagttgagatcgtgccactgcactccctctcaaaaaaaaaaaaaaaagcaaaaattagctgcatgtggtggcccatgcctgtagtgtcagctactctggaggctgaagtgggaggttcacctgagcccgggagattgaagctgcagtaagccccgattgcaccactgcactccagcctgggtgaaaaacaatgaaaccttgtctccaaaaaaaaaaaaaaaaaagagcttaaaaaagaaagaaagaaagaaattggcaattcgaagatattattctggctttggagtgttttcctggttagacagcaagatttgagggacagtctagacattctgaaggccacaggagaccctcaaacagcaggaggaccccagccatgtggacatcagctgggatggggacccccctcacccagctcccaccccacccacagggccctcacctgcagattgtgatcgtggccgcacaggtaggcagtgaccccgtatgtggccagcagtggccgtagctgcttgaccaggcagtgggtaggcccgtgctcggctatggaccacacggggtagtggccagccaccagcacgtagtcctccctggccgccgccagctgtttcttgagccaggacagctgtgtgcgggccagcttcacgtctcggggcctctcaggctgctggctgaggaagtcatctgagttgccacatagtgtcactgtgtccagcataaaaatggccacagacacattggtctgtgggatcttgaagtgcaggcggtagaaagggctggggaagttcctgtggaggggatagaggtcgtgggtgcacatcttgggcgcagaagtcccagggtcagctcaagccacagggcccctgtgtccctgctatgtgaggatctcggaaggcagggctgagggtggctcaccagcgcttggagatcttagagtatgcaatctgggcagagacattgccaaggtggtcatggtttccggctagcacgtaccagggcactttgcgaagggagcggtcagagaatacgtcctcaaaggtctcctgtagcaaacagatagggcaggcctcttccctggggtcagtggctatgccgatcctcccaccaagtcaggataagggagacactgaatgctcccggcgcccaaaggtgccccatcaccttccctctgccctcaccaaaggaaggtcactaggtaaggcggcttctccccactgcccgcccccacctcctgccccactctgttgggcacagacctggaacctcttgtcattgatgtcttgcacaccagtgaagtaaaaattgtcccctagagacaggatgaagtctgcacccaggatctgcacagtccgagcgatctccttggcattggccatttcccgggccgtgtggaatggggcattggggacccctccccagtcacccacggctacaaagcgcagggcaggggtggcaccatcagccagggagggtagcaacaaggcttgcaggatgagcagcgccgtccacatgtccatctgggagaagagagacaagcataggtggcccgggctgtgacaagggcagggaggccttgagacccccgcctgccctgagatagagggagactgcttgctgcaggctgcccctgcgggaaccccttggtgccctaattctcaggacacacaagctgcacaaggctgcacaagctggcttagggaaggggggcgcggtctgtgagagggcgagctgtaccaagatggccctgcaggcccatttcaccctccttccacctagcctgcccagcactcacccagggggagacacaggccagtcaccggaggctctgagaggctggtgggctctagagtagaactgccggtccctgagcctttattccctgaggaggaagtggatcattagtgaggatgatgcagtttctccgagggctgtcccgggagccctccccttgggtcatgtgagccctggacttccctggagcaggacacgggattggggtgggggtgggaggatctgggcacacgtgtgcagcagcctcggcccacacagcctccgggtggacctgcaggggcctgtttgtgctgtaggcttgacacgtccaggtatctctgtgtgtctgtgtatctcagtgtgagtgtgtgtgtgtgtgcacacttgagaggctgtggctgtgattacccaagacacatctcctgcaccttctttctctgagtaagggcttacctgtgtgtgtctgggtgtgtcttgcttcctgcgtgcagctgagcatgcctacctgggcctcggctctgtacctgatggtgttgctgcagacatgtatgctgagcctgcgaggcctgtgtggcttgtctgcgatgcacgcctgtgttctcacgtggcactgggtgggaatccctatggatggagttttgtgtgtgtccatgtgtgtgtgcctgggttgcatctctaggatgggttgcgtgtctggtgtgggagctgtgtttgacaacatctgggtgggggactccgcgtgtgtccccgtcctccccctgccctctctccatcccacacataaacaccaacgggcttcccttttccaggaagtcctgcccacaccctcccctccccccagactcccattcctgcaggaggaaccaggcaggaggcagctagctggtgatagcgcgcgtgaccacagacctctgaccctcatagtctcagcagctgtctgcaggccctccacgggaccgcagcctgggagggcaggaggccctgcacctgcggccggtctgacctgctcctcacctccctgcctgcctcctccgtgctgggcgccgccgcgacacgtcccgcggacattcaggagtcccttcagtccctgcgagcgcggacccgggagagagctctcattcaacgctgaggccactggctcacagatctccccgggtcaccctgcgaagtgcttggtcccccccattcccagccctgcagcagcaac

SEQ ID NO: 1506 - DNA, 4327 bp, Homo sapiens
  source 1..4327: mol_type = genomic DNA
ttcagccttggcaactattcttttattgaacatcagtaacagaaagatgcttgatttaggaggaagctttccctccctccctcccccattgcaccccggaactcagcaaaggtgagccagccacagagcataacactgtggctgggacacatgtccatgtgtgtttcacatacgtgggcatctgtgccacaagggtcatgtggcaccacagttcatcagctgtgtttccccttcctgccctgctgcagcgccacaggttggaggaaaagcctgcctgtgagcagggtcccggcagggcccacccacccaacagtggagatcgggcctcagagctgggcagtcatgggagttcagggcctggctcgcctcggcagcctggtcttaaagagggacttgcccgaggcctcgatgtaagtgacagtcatctctttggagctgatctccacataggcaaagccacccagtgagtcttcagtcccatagtggaagcgcagatagccgttggggaccttgcgctggtgccgctttgaggggtccatgaaattcccagccccactcagcacgtagcccacgccattctcatcttgcaggtactgaggatggaggacaaggggtcagtggagacccagctttgagcagagccctgcctaaggtccagggctcgatctggccctaaccacagagtcaccttgaggtatgtaacccctcctggcttcaatttcctgacttttaggagtgtattaatcctatttcataggtagagcacttagtaagaaattggtggccaggtgtggtggctcatgcctgtaatcccagcactttgggaggctgagggggtggattgcttgagcccaggaatttgagaccagcctgggcaacatagtgagaccttgcctctacaaaaaaaatgcgcaagggccaggtgcagtggctcatgcctataatcccagcactttgggaggccgaggcgggcagatcacttgaggtcagaagttcgagatcagcctggccaacatggtgaaaccccgtctctactaaaatataaaaattagcaaggtttggtggcccatgcttgtaatcccagctacttgggaggctgagacaggagaattgcttgaacccaggaggcggaggttgcagtgagttgagatcgtgccactgcactccctctcaaaaaaaaaaaaaaaagcaaaaattagctgcatgtggtggcccatgcctgtagtgtcagctactctggaggctgaagtgggaggttcacctgagcccgggagattgaagctgcagtaagccccgattgcaccactgcactccagcctgggtgaaaaacaatgaaaccttgtctccaaaaaaaaaaaaaaaaaagagcttaaaaaagaaagaaagaaagaaattggcaattcgaagatattattctggctttggagtgttttcctggttagacagcaagatttgagggacagtctagacattctgaaggccacaggagaccctcaaacagcaggaggaccccagccatgtggacatcagctgggatggggacccccctcacccagctcccaccccacccacagggccctcacctgcagattgtgatcgtggccgcacaggtaggcagtgaccccgtatgtggccagcagtggccgtagctgcttgaccaggcagtgggtaggcccgtgctcggctatggaccacacggggtagtggccagccaccagcacgtagtcctccctggccgccgccagctgtttcttgagccaggacagctgtgtgcgggccagcttcacgtctcggggcctctcaggctgctggctgaggaagtcatctgagttgccacatagtgtcactgtgtccagcataaaaatggccacagacacattggtctgtgggatcttgaagtgcaggcggtagaaagggctggggaagttcctgtggaggggatagaggtcgtgggtgcacatcttgggcgcagaagtcccagggtcagctcaagccacagggcccctgtgtccctgctatgtgaggatctcggaaggcagggctgagggtggctcaccagcgcttggagatcttagagtatgcaatctgggcagagacattgccaaggtggtcatggtttccggctagcacgtaccagggcactttgcgaagggagcggtcagagaatacgtcctcaaaggtctcctgtagcaaacagatagggcaggcctcttccctggggtcagtggctatgccgatcctcccaccaagtcaggataagggagacactgaatgctcccggcgcccaaaggtgccccatcaccttccctctgccctcaccaaaggaaggtcactaggtaaggcggcttctccccactgcccgcccccacctcctgccccactctgttgggcacagacctggaacctcttgtcattgatgtcttgcacaccagtgaagtaaaaattgtcccctagagacaggatgaagtctgcacccaggatctgcacagtccgagcgatctccttggcattggccatttcccgggccgtgtggaatggggcattggggacccctccccagtcacccacggctacaaagcgcagggcaggggtggcaccatcagccagggagggtagcaacaaggcttgcaggatgagcagcgccgtccacatgtccatctgggagaagagagacaagcataggtggcccgggctgtgacaagggcagggaggccttgagacccccgcctgccctgagatagagggagactgcttgctgcaggctgcccctgcgggaaccccttggtgccctaattctcaggacacacaagctgcacaaggctgcacaagctggcttagggaaggggggcgcggtctgtgagagggcgagctgtaccaagatggccctgcaggcccatttcaccctccttccacctagcctgcccagcactcacccagggggagacacaggccagtcaccggaggctctgagaggctggtgggctctagagtagaactgccggtccctgagcctttattccctgaggaggaagtggatcattagtgaggatgatgcagtttctccgagggctgtcccgggagccctccccttgggtcatgtgagccctggacttccctggagcaggacacgggattggggtgggggtgggaggatctgggcacacgtgtgcagcagcctcggcccacacagcctccgggtggacctgcaggggcctgtttgtgctgtaggcttgacacgtccaggtatctctgtgtgtctgtgtatctcagtgtgagtgtgtgtgtgtgtgcacacttgagaggctgtggctgtgattacccaagacacatctcctgcaccttctttctctgagtaagggcttacctgtgtgtgtctgggtgtgtcttgcttcctgcgtgcagctgagcatgcctacctgggcctcggctctgtacctgatggtgttgctgcagacatgtatgctgagcctgcgaggcctgtgtggcttgtctgcgatgcacgcctgtgttctcacgtggcactgggtgggaatccctatggatggagttttgtgtgtgtccatgtgtgtgtgcctgggttgcatctctaggatgggttgcgtgtctggtgtgggagctgtgtttgacaacatctgggtgggggactccgcgtgtgtccccgtcctccccctgccctctctccatcccacacataaacaccaacgggcttcccttttccaggaagtcctgcccacaccctcccctccccccagactcccattcctgcaggaggaaccaggcaggaggcagctagctggtgatagcgcgcgtgaccacagacctctgaccctcatagtctcagcagctgtctgcaggccctccacgggaccgcagcctgggagggcaggaggccctgcacctgcggccggtctgacctgctcctcacctccctgcctgcctcctccgtgctgggcgccgccgcgacacgtcccgcggacattcaggagtcccttcagtccctgcgagcgcggacccgggagagagctctcattcaacgctgaggccactggctcacagatctccccgggtcaccctgcgaagtgcttggtcccccccattcccagccctgcagcagcaacaaacgggaaggaagtgggtgacgaggacaggcagagacccctcccacggggccgcccgcatctcacctgccgtcgcggggcgggcgttgcggccggtgcccagctgcagatccgcaggcgatcgcactcctggcggccccagctttaagcaggcagcggccgatccgccctgctcgagggctcagggctgacccaggtgagccccggcg

SEQ ID NO: 1507 - DNA, 4327 bp, Homo sapiens; identical to SEQ ID NO: 1506
  source 1..4327: mol_type = genomic DNA

SEQ ID NO: 1508 - DNA, 26191 bp, Homo sapiens
  source 1..26191: mol_type = genomic DNA
ttctaagaattcagattcttgttttttttttatttatgaggaatgtatattgttaagtcactgttatcaagggacacataaaagcagaatcataaaactggactgcagccatcatcacagtacccgagtctatgcttgggggtcttcctcactctgctcttggagtcacaaccaagactccaaaaaaccaacgaagtcccttcaatgtgagtaaaggaaacagcttcaagcactgacaatttttacaagtgattattcaaggaatgcacagtagccacagttcagacaaatcaactacaaaaatcattaaaaagaagagtagggagggtcactgcttattaaaaacaaaagactggacaaagaaagtgaagataacagtgggcagaagctctgcctcctctgtcctgtgtgactcagaggggcatgggggcgcagggatgtgcgatctgacacggctcgtttccagcagatgcgtggaattcagggatgcctcgctctcttcctacaacagaaactgaatactacaggcttgctagataagatcttgggggtgagtgggggttctgatcttgtgagagcctgtgttcccagttaaagaagaggcagctggccagagctctgctggagaacctaatgcccaagatggaccagagaggccaaacaacctgaggactcagcaggtgacaaccctgtagcctgaagaggagaggggctgcgctgccttctgatgctgagaaccacagacctctctgccctggatgtgggtgccaagactgatttactgtgcccccagcagacccagagccagggagcaggcctcttccactccaggagacaggcgccacttccctaccagttccttgggatgctttggtgttctgcaaaggcatccttagtctatttttagaacttgcattttcttactttggtcaatttttggtcaaaagtacagagagcatagaataaaagcaaagatgtgaatgtctctaccagacagaggatgacctagtcagcagtttggagggaaatcatctgagggtgctggctcagcacgttcccagatgaaggtctgtcatctaaaggagagaggcaggctcagctcctgaaggtcgcagagcctcagtagtcctcctgagtgtgtctagctgactgttatcgagggacacgtaaaagcagcatcacaaaactggactgcagccatcaccacggcaccaagtctatgcttgggctcttccctgctctgctcttggagtcatgaccaacactctaaaagccaacaaagtcccttcaacatgagtaaaggaaacagtttcaagcactgacagtttttacgagtgactattcaaagaatgcacaggagccagagagccagactccacagagaggccaaaggctctgaacacacgagtcaatgttcatggaggtatagacaaaggattctacctcacagagtttgaagacaacctgccctttcacccacaactactgctttctatgtcaaccctataaagatcaggtctgcgccctgcccacgagcctacttctgaagccatctggaaaaatgaaagcacttggataaatggaaaagtatgcctgaattttaaatctgctcaattacaggttatctgtagcagttaagaatcaacatctatggcattctttaaaacactcctaatttacatgtgacttagtcaacttcccttggtgtcactgtcatgagagatattacaccgggtggaacagtgacgttaagccaacaggattttttgcccttattcttgctaagtcatgattatctgagcagagatgattttataccctctaggatttgtcccgttggctagggtgtacgcccagcattggcggggaaaatattcctaggaatgctttaggagaagaggcagctggaagcttggcaatattccaaggcatgcccgtgctccctgggaagtggtctgtgtcatcctgccgggtgaaacctctgctattgcttgagcagctcccttaacccagtctggctggttctagacttcccagctgccggagaaagtgatacacttccagggaagcagctttccttgccttgcccgccctgcagctggctaaagtgcaggatgggaggatggctgggcattatctgcaggctccaatcacacttccgtggcactgggaactgcagttttcaactcctacccttacaaatgtttcaccaaatcctttatgttcacctctttgccctctgagggggaaaaggagacattcagatcacaaggaaagaatctcagaagggaaagaggggaagtagaggggtctgcgtaatccacaaatgaaattatcagtccctgacatgatccagagttgactgaaacctaatcaagaccgcaagaggtcagtgtagcaaacacaaagggaaaggaaatggaaacaaatcaaaacaaaacttttaagaggaaatggaccgcaggtgctcagtgactatgtatgctttgggtagaaagaaaagataacttcttaggtttctgcctcttcacttgggggaaaaaaggggggcctggccagaccttgcctagcaatcccaaagaaagcaggataaatgggaacccaaagttttcagtatcaccaattatggcttaaaaagaaaaaaaaaggagaaaaaaaaatcccctgaccatgtgatgaggaatgctacgacctacctctctcacaccctagtatgacacaccctaatccatctgtcactggagcatactatactgggcagagataaaagttcttttcctcctggggtttgctaatccagttcccatagcccatatccttcaggccttttttgaagtagttcttggccgtctcgtagtcacgggcagctttcttggcctcaccataggagagtctcagtagatccctgcggtaacggaaggagcagagcttcttaaatagaagaaaaatgttctttttggagacccgggacaattcattccgtggcctagagaaacaaaagcactcattattcacctgggacctgtaagataaggagctcacagtggagacaccgtgggaggggaggcggctctcaagccctgagactgcagaggtatgatgcacccttgcaagtcagggcagaggcttggtcctcactgcgctctcctgtctccttacccatccacagtgcctctggtaccgtccaggatctccaggtcatagccatcagccagacaccagttgacgcttgtctccttagtcttcccggattgccttttggaatcatatatgctgactctgccaacctaggaatcccagaagcaacgggagaaagatggaaacctttcaggaataagattctgaagcagggactcaagactcataggagagaggaagtgtggggtcatgatctttcccctgtatttagggttctgtttggctaagactgagcaccctctagacatactaactccacctcgattcagattaattccagactaagagaagaaaagcccttggcatccaaaaggaagaaagtttaagttcttgggagaccaaccaatgttggtggtgggccactgtgggcaatgttcccttgtgggctaccactgtgggcaatgttccccttgcccacagtgtacatttttcctctgtttacatgactgcttgaaaaggaggaaaatgtcagggaaaatagaagggggttatagcaccttggggtggttgacaataaagggatgtcgtagtccatcctcaaatgcactcccatctcttgtcacacgacagcaaatagcacgggtcagatgcccttggctgaaaaggtaacctgagtacaaaaaagagaaacatatatacctgtgtttgcaccaaatgctgttaagaggcagaagcatgtggggattttggaggtacaagatatagttgtcaagaaagagaaacagctgccttgttaggaagcaccttctgactggggctaccaggatcttcctaccacagcagactggacactcaatcaattactgaggagtgaatcatgctcactttgataagggagacaaaacacctggcaataaagcatgcagtttgggatctgggcacaagaaggacagaccagttccagatcccaaggcaggccccttacccaatgtgacagatttgagataaatgggctgcaggaagtgggtcaacagtgccccttgcaggcccagcacgttccagcgtaggattttgtcactacaggacatggtacggagtctctccccgagccgaatgccatcccacgtaggcacaatgtcactggattccacagggattgtgccttctcctgtgtgagagacttgggtcagacccacaggcgccaatggaccaaaccactccctggcgtggtttctatcctccttaagcttgggccacaggctacattcattcattcttcacatatttcacagcccctgctatgcgccaggcactatgcttggtgctgggaaagaacggtgagcaaaaccaagtaagatctttgtgctcttaaaacatctatggtggtgaggagattgaaagggaagagaatagacactaaaccagtagccagtacatacggaagaattccagatgctgacagtgctctgaaggctctgaggcagctatgacggaggaccacaggggacacctcctgggacagcagcagcaggggagcccagacatggaggaggacagctggagtaagtgtttcaggcacacaggacaaaagcaaaggccccaaggcagccagcggattggctgttcaggcgcctgacagagagccagtgtggacagagcatatgcgagggatggggaaagtggcatgagaggaggccgggtgatcacagcaggttttgcttgtatatgcagtgcagtgggaaaccactatcgggtttaaaaaaaaacaaaaaaaaatgctttactgagatatagttcatatgccatacagttcacccatttaaagcatacaattcagtcatttttagtatattcacagagttctgcaactgtcaccacagtcaattttagaacatttcatcgctccaaaaagaaaccttctacccattggcgcagtcactcctcatctctccaactctcccactcctggccctggcaaccactcatctactttctgtctctatggatttgtctattctggacatttcatataaatggaatcatacaatatgtgatcttttgtgactggcttttttcatttggcatcaagttttcaagtgcatccatattgtaagcatgtatcagcacttcacttctttttatggccaaaataatattcaatttatggatatatttgatgttttatttatgaatccatcagctgatggacgtctgggttgtttccacttttttggctcttgtgagtaatgctgccatgaacattcacatattagtttccgtgtggacacagatctccatctctctgcagcatatacctaggagtggagcaccggctccatggtaactgtgtctatactttagggtatttagcaaggtttcaggaccaccatgatgactgctgacgtggcctgaacgcaatggagtggatgcgaagagacagtaaggagacaggagaggataggagagaaggagccagtggacaaggcagagtcaactgccagctagacaggaggggaccccagcatttggcatcctcatctgtcaactcctcagggcttggttgtgccgcactcttcatttcctccccgctttcttgaggtaatcctatgcattctcatggccatgaagaccctatagggggatgactcccatatttctatttccagccaagctccctcctctgagctccacatgggaacccccacctcctatttgacttggggatctcccagatctcccaaactaacacattcaaaatagaaccctgatcttaccacacagctccctgacccaggtcttccctttcctgtaaacagcacctctgtgcccagtgactaatggtaaaatcctagcagccttgtagagacttggggtccctggaccttgcagagccttttgaggaaaggaggcgggggcatgtatcactcaccgttctccaccttggtgcggagctttccttgtttgggattctcgaagacagggtagtggcgggattctgtgctttccatagcacggtcgctgcaggacttgtcaaagagggcgccatctccacacggagcagtgctgaaaaacaggggtggctgttaaaactcacctgtgggaaatctgcaatttcgtggggctccaaaacagtcagatgtgacagaagcaagggatgttttctaaggcctaccatgggagactggaggtggacagcagtacatgtgagtcatctacacctgaatatggacctcaaacccacagtggagtgtggcttattgtatcaggttcgatttacaggccaggagagcatttggatacccaattctaacagcctggcagggcccaccctggcagcaacaggaactgtacagacctgatatacagatggaatgacacagtcttttttatttggagcttttctcctcccttagcaggttcaaatatactatccttcgcagtctgggagttgtatttcattaactcactgtagagaaacctacaaaaagaaagtctggttaggaaggcaggttcaattctgggaaaagcagttgtttctataatctgacctccaaatgagaaagtaaggaaaagtctcaatgttgcagacgtttcacagtttatcaggtggaaattctccaggggagacctcagcatttcataaagcatagttagccttttgggtctccttcatttctgctgagggctcctcgctatggcggctacagggattctagagcagagcaaactgattcaaggactacaggaagctgttgctcctttctaagtctctcccttcataaattaaagaaaaggtgagctagaggagaaagctggcaggggcatcaaggttgtgtaggtcctcaaacggaaatggaaagctgcctcatcctcaaggccctgaggactaaaaggtcattttgtgtttttagaaaagaacatgaagcagcagagttagcagaaaaaaggacagcatttaaaaacaggccgagcagtgggaggcagctcagctcacagaggggatggattccatcagacaggttcaaatggacgggtgaaaagcaaaggctgccactgccacatcatgacccgtctgtctgagggggattcagaggccgtgtcagagccatgtggggcagggaactggagctctccacagccgggcagccgggccacagctctgacctcgctcacctgatgaagcctctccgggagattatttctgcatggcagtcattgacagtttctccttttaggctgagagaatctcctttcacacagcgattccctaggaaggtgtttaaaacagaaatagaataatggaaggaaaccgatggaaaacaggatgaaggctatttgttctgaaagcttcaaggcagaaacagcctcagtttctcagatcctagactcccatattctctcctctaggaactaagaactcattcctcactctgaattgactgtagctaaaatgaagtctcttctccctgccttggacttacatgcatggactccaggggaggatgagaggcacccgctttcaggcgccatgggaggcggcatgtctcagagcctcactcacctgttcccaagctgacgacgacacccatgtcctcagagtcttttttcataatgatggcggccagaatcttgcggccgagcaaggagggctggaagctgttagtcagagtgttgaagcaccggtggctcagcatggctatctggtcatggaaggtgctgccagtgagagggagctgtggggaaaagaggctgtgtcagcaccacaaagctgaggctgtgtccaccatattcaccgtgggcagggagatcaagctctacttgtcgtgtgagtcatcttttccttcttacatctagtgtcccagttactgctctctcgaggctaagagtaaagcctaggaataactcgcatgacagcaagagccacctccacttaggagttaggaggacccccccgccccaaaaaaggcaccaaaagtagacgtcttaactgtctttggctgtgcttctggggaccttgagaggaggagcatagttcttctgagactggcccctgtcactggggttacctctgtgaaacccatgcgttctgccttctcgttctccccaatcaagacacggagagccgcatctgctgcttcctgcttgccttgcttcttgctgtgtgcgcagacggctgggaaccagcgacccccaacttttgcttggtaaacgaacctttgggatgagaaacagagaatgaagacaagtgccagaccctgacattgttccaaggaagggttagttttgctgaagatgtggccagtcttgcaaacatatggacccgtcaaacagaagctgtttctaaggcagcatttcctagattttggtcattcatgaatcaccacatgatttgtgccacatccaggtattacttggactattaattaatatttttctctaaattgacttcttagagccagccattgtggctcacacctgtaatcccagcaacttgaggagctaaggtgggagatcacttgaggccaggagttcaagaccagcctgggcaacatagtaatcccccaggcaacatagcgagacccctgtctcttaaaaaaaaaaaaaaaaatttagctgggcacggtggtctgtgcctatagtctcagctacttgggaggctggggtgagaggatcacttgagccctggaggtcaaggctgcagtgagctatgaccatatcactgcactccagcctgcgcgagacagcaagatccccatctctaaaataaacaaacagactctaaaaatgtaaatatccgtaatactaggtatgaaaaaagagataaaaatgtaaacacactgaaataggaaactttgtttcactactgtaaatggaaaaccagtatcacttgccacatattgaaggtggctgtaaaacagaatatgataaaatcatgttataaaattctgactagatactgttacctgcaaaggctctgagcctgtccttactataaaggaagattatgaagtatgaggaaggcttaacgaaatgctagcaccaacttggactctcttcttaagcagaaatcagaagggactacctttctccccacaagtcactgttacttcatacactgtctgatttttaaagcgcccaactccattccctcatttacttcctattagctcaaggggacttgacctggagaggtcattaggtcaaggtcggccttaggccagggacccaggttttgctgggagttgtttttttgactcctggcaggcttaagctaactctggggtaaggaatggatcttgggcgcatgagctgcgctgacaataaagtgcccaagtggagcagggaggtggcttctaccgctccggctggtaatttccaaacacagagggaagagcatggtggagcaaaacagcttggaaatgtaccagacaaggcatcaagaatcctagctttcaaccagatcctaatctactggctgagaacccagctttggatactctaactgcatataacagaggcttcagtttcaagacttagcagctcaggcagtaaaaggaatcaacgtttatgttcaaccacatggagtttctcactgttccttgatgatccgaagcaactaaatgccttcactcttttctttgtccatgctggcaggcccgtgcaggccagtgggcttaagttcagaatgagagggacagtggcatgaaaagaagatggtgaaggcggtcaggagggacagattgtgtagtatctttacctcagggatccaggagaatttcatgactgccccatgtgtttgaaaagaatatgaactcttacgtgcaaagttttatactgatatatttacatatatgataaagtttgttaattatgcaactagaatcctttagagctgtgctatccaatatggtagccactagccaaatggggctattgccataagtgcctcctctcagcctctttgccagctctgcgcttctcccaccacaggatttaacagtgtccttcgcctagaaccctcagtctttctctcttcatcatccttaaagtctcagctcaggcagtacttcttggggaagcccttccccctctccttcctaagtcaaactgtgctataattgattctcgctgcaactccagccctttggaatacttatcaaatatgagatcttacatttctttaggtgactattggttaatgtttggttcctgttctaaaaaaaatagaagatactccataaataagtgttgagtaaataaagtataaagatcagttaggaggctattgtgacagtctagatgagacagtggcttggattagagtgctgacgctggaggtggaaagaagaggaagggatttgggatagaaattctaagtataaccaataggacttaaggatgagttgacgaaggaggtaaaggagatagaggaaaagatgatcctcaggtttctgacttgagccactgggtagacagtggtatcacttactaagctgggaaagacttgggggaaatgaagcgaagggggcaaaacccaagagttctgctttggacatgtcatattagggatgttaatccaaacagaggtgacaagtaagcaactagatggaggaatcgggagctctgagtggtctccagcatttagatattaaaggtcatggctgtcgcggtggttcatgcctgtaatcccagcactttgggaggctgaggcgggtggatcatctgaggtcaggagttgaagaccagcctggccaacatggtgaaactctgtctctactaaaaatacaaaaatagtcagatgtggtggcagatgcctgtaatcccagctactcgaggagctgaggcaagagaattgtttgaacccaggaggcggaggttgcagtgagctgagactgcgccactgcactccagcctgggtgacagagtgagactccatctccaaaaaaaaaaaaaaaaaaaaacagaaaagaagtcataaaattagttaacgtcaccagccacagtagacagaaaggaaaaaaagacccagcataattcacattaagaagcaactaaagtatattattgtacgagatagttaataaacgtagttactcaattagcatttcccctctctatgcaaccttcctcagctccctggcagacagtggcagcagtgtcctctgtgtccccacagcactctgcattcacctccaatggcacatttcaatactgctatggctatatgtctgctacacactcaggggcagcaattttttgtatcttccatctagttcatagtaagttcttacattctcaatgaatggctgacttgaagtcctagaaaggatttcacagaagatttcacagaagagaaagaggaaatgcactgaacctatcatctgaaggactgtgcttaaagataaggaggtgcttattgagatgaaggatatgaattagtagaagagcagctggagggagactgggcctctccttttccagatggcttaaacagtgggcagatgtgtgttctaaattgggtcatgttgggcaaagggctacttttaaaaattatgttaaaagttcttacatatccatgagagtaacaatctgaaagaaaactggaaaaggacaagaacaggtggttcacagaaaaggaaatgcaaataacacataaatatgaataaatgaaatgccattacttctgatttttttgtttttttttttgagacggagtctcactccatcacccaggctggagtgcagtggcacaatctcaggtcactgcaacttccgcctcctgggttcaagtaattctcctgctcagcctccggagtagctggcatacaggggcataccaccatgctcagctattttttgtatttttagtagagatggggttttaccatgttggccaggctggtctcaaattactgagctcaaatgatccacccacctcggcctcccaaagtgctgggattataggcgtaagccactgcgcccggctgacattacttctattaaggagagacaaatttaaagtaacaagatagcatttttataagcttttttccttaatgactttaaaatggacaagttggatgccaaacatgtgaaaattcaaacagttaagagtgtacaataaaagtgtccctccttccccagaagcaaacacagttgccagttttttcgatccttcaagaaaatattctagacatatacagacaatcttcacctctcccctcactttacaccttgcttttccactttgtgatagaccttagagattaagaaaacatgccggttgcatggcaagagtgatgccatcttgatgcaaaaccactatgaccaccaatatctgactcccgcatcccaaagtgttgggtagcataaataattccacacaaagatgtctaccaagcctccccaccagctagtgctcataagtttcacaagaaagtataatgtgtgaccagctgcatgtttaaccaaaaaagcctctatagaaagcatactttctggagggtaagtgcagggatccaccatcttgcagccacccaagacatcatttctgttcctaagtccctattaaatgtttacttctgagaaactgaatttgtcagcttctattcaatgaaatactatgcagctatgcaagaagtctggtaagtaaaggagtcaacgtataaaacagaagatatacttgtttaaaaagacaaaagggaaaatgtgctagttatgcacagcaatttctagaaggactcaagaaactggtatagtcatgtactgcataacagtgttttgttcaatgataaatcacacatatgacaggggccccgtaagattatgatggagctgaaaaattcttatcaccaagtgcagggctctgtaacctgttaggaacctgggcacacaggaagaggtgagtggcgagcaagaaagcattctggtccgagctccgcctcctgtgggatcagcagcagcatgagattcttgtaggagtgtgaactcgactgtgaactgtgaatgcgagggatctaggctacacgctccttatgtgtttactatatttttatcattatttcagcgtatactccttctacttctagaaaaataagtaactaaaaaaagcctcaggcaggtattccagaaagcactgttaccataggagatgacggcccccatgcatgttattgcccctgaacaccttacagtgggacaagacgtggaggtggaagacagtgatactgaggatcctgaccctgtgtaggcctaggctaacagctaatgtattttcatcttagctttcaacaaaaaagtttaaaaagttaaaaaaataaaaaaatttacaaacagaaaaaagactatagaattaaggatataaacaaaggaaatatttttggatagcagtacaacatgtttgtgttttaagctaagtattattacaaaaggaacaaaaaataaaaaagttaataaagtaaaaaataaagtaaaaataaagtaaaaaagttacagtaagctaaggttaatttattaaagaaaaatattttaaataaatgtagttagcctaagtgaacagtgtttacaaagcctacattagtgtacagtcatgtcctaggccctcatattcattctccactcactggctgactcacccacagcaacttctagtcctgcaagctccattcatggcaggcgccctatacaggtgtagtatttttttaatcctttatgctgtctttttactgtatctttttgctgtttagatagacaccaatacttaccagtgtgttgcagctgcccacagtattcactacagttacatgctgtacaggtttgtagcctaggagcaaccggccataccatacagcctgtacgtgtgtaggagcccatgccatctaggtttatgtaaatacacactgatgttctcacaacaacaaaaccatgcttctcagaccgcatcccagttgctaatgcagggctatagtaatatatgggtctagggagggaaactagaagtctgagacggaaatgagacttttcattgaaatgactactttttcaatcagcttgaatgatttttttcaagatggagtcttgctctgttgctcaggctggagtgcagtggtgcgatctcagctcactgcaacctccgcctcccagcttcaatcaattctcctgtctgcctcccgagtagctgggattacaggcacccgctgccacgcccagctaatttttgtatttttagtagagacagggtttcctcatatggtccggctggtcttgaactcccgacctcaggtaatctacctgcctcaacttcccaaagtgctgggattacaggcgtgagccaccatgtctggcctgaatgattttttaatgtacctatacatttctttaaaaattaaaactagtcaaaaaattaaaaaggatcatgcttactggaagagtgaacgcattcactcttggcaggtctattgtcttctaagaggccgtggagacagggctggacttgtttccctcaactcgccccttctgtcctacacagctaaagcacacccttgttttccctgggttacagaccatccccaactggtgacacatgcattagccaggactaggacactcacttgggctcgtgaggaggtccggactggtcgaccaacttgaattcagcagcaaagccatgggagcgggcgtactccaaaaggccacccacagggttggtgttcaggtatctcacgagctcgccaatcttcctgaccttgttgggcatcatggattccaagttatcaagtgactctgagatcataccttcaggctaaaggagaatccatcaaacagaggagccataaacacttcaggaaatgttgagggagtcactggcaatcttaaaccactcagttgctaaaaatgacctgtatcttttgagtaggaaaacgccctacctggttatcagaagccatggagttggtcgcctccccatgcagggccttcatggcttcctctgcggccatctgctttgccactttcttgctgggagcactcacactggggaaagtttgggctcccactgcaacacagtattggaacctgacaggagatgaagcacgtagaaggattaaaatggttttgactgaggagcctgacctagcctctgccaggctgccatcctccactactggtaatttccttgaacacatcacctctgtgcagtcacatctcatgcagtcacttctgccttgaacagccagtgtctcttagcctggctgacccctttcaacatttaagcatcaacctagtttcacctcttccaggaacacttctcttgaacatgtgagtctatagacccacaggcagagagcttctcaggtcctgtacctttctgtcccaccaacagtgagtgacctccaagccgtgaacctccctagtgcttatagaggagatagagggtgggccaggaattccctttgaattcctaatccctaattgtctgcctcacaagcagcaaccaggacctcagagccctcctttccccattttgaaacaggagaaattggtcaatctgccatccctgaggaggcaaggaagaaaatgtgtctctttttctttctgagaaaacctcagctggacagaggacacgtaggacatacttgggttcatgggcagggccttctttggacaggagacggaattcgcaggagttccccaatttgtgcatacactcaagcagtgtggtgacggggctcttcccagaaaagaaggatgtggctgaaggggtgggggtctgggactctgcagtctagagaaaatgagagacaagaagaaaacaaaactaagaaaacactggttagtccatcacagaagaagggatggggatgggggactttattcccaccacctgtcaaggggttggcttcccaaagttaaaggggctgctggagctctcattccgcatcttccaagagaggagattggcctcaataaactttcaggtctctttcaagtccgaaattctgtaaatccaattatgttgggacaggagcagacagaggagctgggtatgagaggaggaaaggtgggctggcgagatagggtagagggaagagtgggaagctgactccgagatggtgtcagttgtttaggctgggattgcctcaagggagtcagttacaatccagacactgacagggaactgatcctcccagatggcaggaggacacctaccttctctgattctttctctgtggaatagtgggatgattcttctgattttccactgtccttggctttggcttcctctagcagaattgtcatggctttcatagctgcatcctgcttggccactttcttgcttccagcttcagctgggggaaactctcggccattgatgacaacctggaatttaaatcttgacggaaagtgattagatgtgtgaacaggagtctaggtcactccttctgccttctccaaagagaccttcaacctggaattttctgctacgctaaggggcttttcacttgtggagatgaagggtaggccaaggaactccttcctactccttaaggctcagcctgtcctttctttttgtaaacaaagcagccagtgactctttccccatagctcagtgaagcaaacataggcacagatgataggaaactagctcaggggaaacccactatctctttaacaatgaattaagataaaacccacacacacaaaaatgatgagccaaaaattaccattatagtcttgtgagcaaccaaaagaccttcattctaaagcaattgtggtagactggcctcctcaagggagggtcctaaaagatagtgaaggcttcttataacccagtctcacactccccactacctagggggatcaggcatctgccacttatcagtggcctgcttttgtccctagacctatatcaccgtagtttgttatgagtcactctatagcaccatttgtctccagctattttctacataacaaggaatttccccttgttatgtagaaaataaaaaagcatttgttctaggcctctggacttagcctaggccccctttgttcaagctttcaaatgtggtgagctctttgctcagtctgggatttcatttagaaaagtaggtcaaatttcttatttcctaggtcttctgatatatttgaacatggcaccaatgtttcttttagtgtgagtccaaagaatgactaaccacaaaatccactgctttcctccaactctggggaggagggatggaggcaaaagagaatgacggccatccagtctctaccccaaacaatccagctctggccttgccagcttttggacagacacaactccttttcttaaccgctctcctgaaatgccaaattggtgtcatgaagacagtcaagacaaggaataagggccctagccaggaatctacacccctagaaaccaggctaggtaaacataaaggtcagtggaattctcccccatcctactggctctttccctggctgcagctgcagccactcagcttcagtggttttgctctctgttatgcccttcagaagctcctgttttcctcaatctgtccactggcctattaggacctacagtgcagggcctgaccagctatctgagtgaggtaaaggctgacttcacagctcaggagtggcagcaagtgctagcctacccatctgtgcagaggaggtttataaaattagaaccaccaccttcaacaggcaggcagccgtgcacacgctcctccatcctttccccccaggagctatgcagaggggggattgtggacctgctgctgcttagcagcacaacccacccccactgtgtatgcagcctgccccaacccacctgctcctgcacctctctcagaaaacggcttagggaggaggggaaggcctacagaagggaattaagtcttcattacctctgccttaggaggcaggcatgatattgatgcatggagatcaatcatgtttttcttttttctttctttttccaagatggagtctcactctgtcgcccaggctggagtgcagtggcgccaatctcggctcactacaacctccacctcctgggttcaagtgattctcctgcctcagcctcccgagtagctgggattacaggcaagcaccaccacccccagctaatttttgtatttttagtagagatggggtttcaccatgttggccaggctggtctcgaattcctcacctcatgatctgcctgccttggcctcccaaagtgctgggattacagtcgtaagccaccgccccggcccccaagaccaatcatttctttcttttttttttttgagatggagtcttgctctgtggcccaggctggagtgcagtggcgcaatctcagttcactgcaacctctgcctcctgggttcaagtgattctcctgtctcagcttcctgagtagctgggactacaggtgcacgccaccacgcccagctaatttttgtatttttagtagagacagggtttcaccatgttggccaggctggtctcaaactcctgacctcgtgatatgcctgcctcggcctcaaaaagtgctgggattacaggcatgagccaccgcgtacggccaaaaccaatcatttctaaagaagcttcattacagccaacagagtcaacctcccccttgttcagccaagattctggctggtccaaggtctatattccctgctcaatatctggagaaagggccaatcaaggggaatttagctaaaaggcagaagggaaggaggaaaagataggcgccaccaaacagcactgctcacaaatcagccaagactgcgtcaggagcaaaagcacctgaccccaaccctaggtacagttcctgggtggtctcttaccgaggttcatggggtggtccactctgctctatcatgttgaactcacaggtttgactagcgaactgggcatattctaacagcccgctgatggggttcttcagctggcactctgtcagtttcttgtagggtgaacaccgtggcaagccatgactgtagaaggagggcatctccatgatggctcgaaactcacctggtgctgcgcggatactattcaagtcatctgggatgtcatctgtggcccactggccattttcaaagtcaacataccctgcttttgaggggccattgtaatgaacaggtggtttcagtcttgctggttctggtctggcctcttgcctgttttctaactttatgacaggttcctgcccattctccactttttctgtggttaccatgttatttgaggcatttgatgtgggtatattacaggtgaggaactctgcgtttcttttggtctcagggattgcagctggagcggtttcaggaacactgttcgtatttctcttgatttgcatcctctctcgcttcttgtctgtcaaatgccatatgggaggggttgtcccttgtctatagacatccccctgcctttccatgtcaattagcacagcatttatatctcgggccttggtaaggccaatatttttagccaaattcagggcagaggagtcagacacattgaagagatagtcgcagattttctccttgatctcggccatgtctaaaaactcaagaggatcttccaaggcagatgtggagttgctgtcttcaggttccaaacctgggtctgagtttggggatccttggctatgactgtctggtcttaccactccgctgtgctggttccaagcctgagctgagactgcaataaaaggctcaagaagatcttctgagacagatgtggagtttctgtcttccggttccaaactcgggtctgagtttggggctccttggctatgaccgtctggtcttaccactccgctgtgctggttccaagcctgagtggagaccgcgattttccacaaagggggtgttcctgcctctttctgtagcttgcccttctttgccagggagtataaaactcgattgatttctttcttcggagtcccaagtttcccagacagatcatgtgctgtggtggccttcccttccccaagctcttccaggaactttaagatcctttgttcctgatcttggtagatactcagttcctggaaatgtgaggaaaggcaatcaacacctctctgtggcagactcctgccacgtggtgaaggatgctggaaccctctctggagcccctgacttctgagatgcacgcccctggggacacccctgatgtccacttgcctgcctctggtactggaggcaagtagtactggaaaccttggccggagtcctgggagggaaggtggcagtgacggtgtctgctttccaatcaccggtgcttctgggagctgccccttgagaaattctatttgcttaagcaggaaactactgggggaagatcctggcccaggctgctggtacctgagctgtctgtgctcatagccttgaaatggatgggtgtagtatccgctgagggaatacccctgcagaataagacagtggaaaaagaaaatgaattagggctgcagtggtgaacctgtggaggcccctccctttgctgcctgtggaacagcccttgaagggctgagaaggcaattgagccatgggcttatgacttggctagggtgacttgcctacctcctaaatcctgcctaggggcctgccaacaggaacacagagaggggagcaggaggcaaagcacgcagaacttccaggaatacagaggttctgaggcctcagcatagcctctccagcaacctaacttacttttccctttgacagaatttaagggagttgagaaggtaattttctagttaccaaaacaattacccctttaaaatcagaacaacaaatatatgttattgttttgaaaacaaaaacagaataacctgaaataaccagaacaatcacatgaaataacaataaccaagggagatgggactagggaagggacgagatgacctctccttaagtcaggctcaccagtgcaccccttgcccacctgtctctaagatctatcgtttagatgactatgacaaaagaagaaatgtgattggatgaaactgaaccccagtcctccaaggctgtaacagcgcagtaacgaaaacaatctccaggtgggaaaaggccacgggacctcagagtcatctctgtggctcttcactgccatcccaggaggatcagaatttggtcttcagggagctggagggtttcctgataaaaatggcacactgtcctcactcttcagtgtggtacccaggctcagaagggatgccagagacttttgcccaaaccacccaggctctcctggatgtgtggagctggcagcatctgctcctcaccacctcagaccagtcctaccttccctagctacttccccatagctgcttccactgcacgttcttctgaaccctgacggacagggcacaagcaaccccatgttctcatatgcacatttaccagaacaccaagcacctgtgacccctttccccacccacccacctgcaaaccagtactgtcttctccccagggctgttcactggagggtgatggagccaggaagtacttataagcctgggggtgtcagtaaacaccttgcttcctttccctggggcttgtagactgggaggagggattctgacaacatttactcacactcaccgccccctcctcagactctcctggaggctgcacaggtagaggtgggaccctttcttccataactctagccttctactcttccacatcctgacacacttaggggatttcagcattcttgtcaatcactctcatggtgtcctggctacaaggatccttaacccagtgatctccatccctacctttctgccacacaattggcttgtctagctactccttcaatctcactatgactctaacctaggccatcacaccaagacctcaaatcctgcaactcttttccagtggctgataaactttttctataaagggccagacagctctgccactgtagcacaaaaacagcctcacacaatatgcaaaactttatttacaattcatttaccatgaagctttatttataaaaacaggtagtttgtacctgtgggccatagtttcttgactcctgctcttttctgatggtgacttccctgtgtttctacaacttcactccttactctggtggaacctgctcctcgcatgaccccggtgaagctgccagtaagccaccctgattcttccccactctgacttcacacacctcctcaccccacctggatctcatggtcagttcccttctccacccaaggcccactgtcccccttttcttctccaaagcttcccagtggtactggagaaggaccttgacttgtgctaacagggtccataaaaattccttctcttgaacctcatttgggtcttcgctgtgtggtggtcaattgtgtttaacaaacatgccttagttcactgtggattgagtactcttcttttaaaaaattctcctcccagggtttggtgacacagcaaaggtctttcacctcttttttcttctttgtccctttttcccaccccttataattttttaatagctactgtattaacggatccaccctttatataatcagtctccaaggttttaaggacctcttcttcctttataatttatttcctaggttgctttaatcactgccccaacctaaactagccctctgaagcaagagcactcaaatctactatgtccagccactaccttgtgtgggagcttaagatctgaatttccaactatgtcgacagtctgtccacttaaatatcctgccataactcaaacagcacatattctgaaccaaattaatagttccctcaaactcagctccttctcctgtagttcttattgctaatggcatcactctcctcctagcctattaaggctagaaacctgcgtcatctttgctgcccgcctcctggcctcatctcctggatctcatcaggtagttgccaagtcccaccttgtctgccacctctgtactgtgtcttaaatgtgttttcttccagttccagcccctcattacctcttactgggccattgcaaaggcctataatctttctatccctctacatgccaatccaggtggcacatctccctccacagccacctatcacaactctgaccctttccttatagagctccttaaatgccacttgcttcaggagactcctgactcccaccttcttcagcccttggggtttcctctccttgagcttctcctactcagcacctgttaaaccatttactttccctcgtatcagagctactggattttttttttttttatggcacacacacattgcagtgtctgaaaggtaattaacattaggtgtcctataagttatactcaactctccactctcaatattcccaacacagtactgatgaggggcttcagttgattccatggtgagctcttgggggtcaaggactatgcttcaatcatctcaacctctctagcacttggcacaaagctgattctcaacaaacatttgttgaattaatgactgcatgaacaagacgccactatgcaagcaatcatttctttcttgttcctcttgctgcaccctcacgcccaccatattgctagggacagaggcaaatgtgtgtacagagtgagtgctggctcccagagctgaattatgggacttaggggttctcctattagctctttgagtgaccttgggaaaaaaaaattgtgtttcaaagtggctagagtcagttaaaagctaaatgttttttaaactgctactcttggcccaaatctggaaaatattttaatgtctgtctatagaagaattaaattatgaaacattcattctatggaatagtactcacacggttattttttttcttgtgagacggagtctcgctctgttgccaagctggagtgcagtggcatgatctcggctcactgcaatcaggctggagtgcagtgtgatctcagctcactgcaatctccgcctcccgggttcaagtgattctcctgcctcagcctccggagtagctgggattacaggcgcacgccaccacacccagctaatttttgtatttttagtagagatggggtttcaccatgctggccaggatggtgtcgatctcctgatccgccctcctcggcctcccaaagtgctgggattacaggcatgagctaccacgcccggccagttattttatttttttaaaatgtgtcatatctatttgtattcacctggggataatttaggaatcatataatgttcaataaaacaacaaaaagttgtagaatagtatgtacattataatttttttccctaaacaaaaagagaaaatccatgaatgtgtatgtgtgcgcacaatggaatgaacacagagaaaagaaaggagatgtaagtttgctaaggatatcttagggcagtagggttagagggagaggaggagattattaatctttctttttgccccccttaaatcccctaaacaccaagccaccgttgagtacagccatttggaaagctacggaataggagagcaagaaagtgagcaagcaacccacagtgatcctttctaaatctctcagcatcacctctatgcaaattacataacaactcatttaacattcattgcctcccagatttcactttaatctggtctcacatatttaggatcaagagataagcactaccccctttgcctttaccacacaggttccacagtgcaatacactgacacctgtgcagaaatgcttttccttcaagttaggcgtccttaatcctttcaaaggagtgcttaaaaaaaaaaaaatatatatatatcttaacaaaattgaggtatataatttagatacagtaaaatttatccttttaagtgtataaatctatgaatttcgacaatcgccaccacaatcaagatatagaacatttctatttccctaaaaagctttttcatgccactcaacaatcaatttcttccacgatacccagtccctggcacccacggatccactttccatccctataactgtggttttttttttccagaatgtcatataaatggactcatacagtatgcagccttttgagtctggcttctcgtgcttagcataacgcacttgcgagtcacccgtgttgttacttgtaacagtatttcctcttcactactaagcagtatcccattatgtggatgtatttcagtttatctgttaacctgctgaaggccatttgtgttttcccagtttttagctataaagtggttaacaagctttctcctacagcttaagtgccatttttaactcccagaaggccttcaggaggtggataaggtgagctgaggatagtgtgcgctgctcaaagtccgaacgttgttcaagtggggctaaagcgggggtagggggttccacaaggggccctagcagaaagggagacgatgtgtctgccttgacatgggctcaggccttcctactcagacgggggcgcattttcccccaagccctcttcacgcactgctccattctgcagaattaatgagcaggatacaaattcacaaattcctaaaccagcaatgctgcttggcaagactacacacacacgcacacacacacacacacactctcacaagacgcacaaattcctaaaccagcaatgctgcttggcaagacgacacacacccacacacacacactcacaagacgcacaaattcctaaaccagcaatgctgcttggcaagacgacacacacacacacactctaacactcacaagacgcacacgctacgcactgcaacacaaagcctgtgaggttgtaaacgaacccagacggcggcgaaggtccaaggccggcccggcttacctgccgcggattcattgcgcccgcgaggcattgcccggcccgacccgccggcggcacgaccctggcccgaccgctgggccgcgccagcccctcgaggcccccacgcctccgctactccgcactggaagtggccccggggcgtcggcacgggaaactccgcgggtctgcgcgccgggcccaagatggctccggttcaatttcgctttcgtttcctcggaaagccttcccctccggaaagtttggccaagaggaggggc

SEQ ID NO: 1509 - DNA, 26191 bp, Homo sapiens; identical to SEQ ID NO: 1508
  source 1..26191: mol_type = genomic DNA

SEQ ID NO: 1510 - DNA, 26191 bp, Homo sapiens; identical to SEQ ID NO: 1508
  source 1..26191: mol_type = genomic DNA

SEQ ID NO: 1511 - DNA, 45923 bp, Homo sapiens
  source 1..45923: mol_type = genomic DNA
ttctaagaattcagattcttgttttttttttatttatgaggaatgtatattgttaagtcactgttatcaagggacacataaaagcagaatcataaaactggactgcagccatcatcacagtacccgagtctatgcttgggggtcttcctcactctgctcttggagtcacaaccaagactccaaaaaaccaacgaagtcccttcaatgtgagtaaaggaaacagcttcaagcactgacaatttttacaagtgattattcaaggaatgcacagtagccacagttcagacaaatcaactacaaaaatcattaaaaagaagagtagggagggtcactgcttattaaaaacaaaagactggacaaagaaagtgaagataacagtgggcagaagctctgcctcctctgtcctgtgtgactcagaggggcatgggggcgcagggatgtgcgatctgacacggctcgtttccagcagatgcgtggaattcagggatgcctcgctctcttcctacaacagaaactgaatactacaggcttgctagataagatcttgggggtgagtgggggttctgatcttgtgagagcctgtgttcccagttaaagaagaggcagctggccagagctctgctggagaacctaatgcccaagatggaccagagaggccaaacaacctgaggactcagcaggtgacaaccctgtagcctgaagaggagaggggctgcgctgccttctgatgctgagaaccacagacctctctgccctggatgtgggtgccaagactgatttactgtgcccccagcagacccagagccagggagcaggcctcttccactccaggagacaggcgccacttccctaccagttccttgggatgctttggtgttctgcaaaggcatccttagtctatttttagaacttgcattttcttactttggtcaatttttggtcaaaagtacagagagcatagaataaaagcaaagatgtgaatgtctctaccagacagaggatgacctagtcagcagtttggagggaaatcatctgagggtgctggctcagcacgttcccagatgaaggtctgtcatctaaaggagagaggcaggctcagctcctgaaggtcgcagagcctcagtagtcctcctgagtgtgtctagctgactgttatcgagggacacgtaaaagcagcatcacaaaactggactgcagccatcaccacggcaccaagtctatgcttgggctcttccctgctctgctcttggagtcatgaccaacactctaaaagccaacaaagtcccttcaacatgagtaaaggaaacagtttcaagcactgacagtttttacgagtgactattcaaagaatgcacaggagccagagagccagactccacagagaggccaaaggctctgaacacacgagtcaatgttcatggaggtatagacaaaggattctacctcacagagtttgaagacaacctgccctttcacccacaactactgctttctatgtcaaccctataaagatcaggtctgcgccctgcccacgagcctacttctgaagccatctggaaaaatgaaagcacttggataaatggaaaagtatgcctgaattttaaatctgctcaattacaggttatctgtagcagttaagaatcaacatctatggcattctttaaaacactcctaatttacatgtgacttagtcaacttcccttggtgtcactgtcatgagagatattacaccgggtggaacagtgacgttaagccaacaggattttttgcccttattcttgctaagtcatgattatctgagcagagatgattttataccctctaggatttgtcccgttggctagggtgtacgcccagcattggcggggaaaatattcctaggaatgctttaggagaagaggcagctggaagcttggcaatattccaaggcatgcccgtgctccctgggaagtggtctgtgtcatcctgccgggtgaaacctctgctattgcttgagcagctcccttaacccagtctggctggttctagacttcccagctgccggagaaagtgatacacttccagggaagcagctttccttgccttgcccgccctgcagctggctaaagtgcaggatgggaggatggctgggcattatctgcaggctccaatcacacttccgtggcactgggaactgcagttttcaactcctacccttacaaatgtttcaccaaatcctttatgttcacctctttgccctctgagggggaaaaggagacattcagatcacaaggaaagaatctcagaagggaaagaggggaagtagaggggtctgcgtaatccacaaatgaaattatcagtccctgacatgatccagagttgactgaaacctaatcaagaccgcaagaggtcagtgtagcaaacacaaagggaaaggaaatggaaacaaatcaaaacaaaacttttaagaggaaatggaccgcaggtgctcagtgactatgtatgctttgggtagaaagaaaagataacttcttaggtttctgcctcttcacttgggggaaaaaaggggggcctggccagaccttgcctagcaatcccaaagaaagcaggataaatgggaacccaaagttttcagtatcaccaattatggcttaaaaagaaaaaaaaaggagaaaaaaaaatcccctgaccatgtgatgaggaatgctacgacctacctctctcacaccctagtatgacacaccctaatccatctgtcactggagcatactatactgggcagagataaaagttcttttcctcctggggtttgctaatccagttcccatagcccatatccttcaggccttttttgaagtagttcttggccgtctcgtagtcacgggcagctttcttggcctcaccataggagagtctcagtagatccctgcggtaacggaaggagcagagcttcttaaatagaagaaaaatgttctttttggagacccgggacaattcattccgtggcctagagaaacaaaagcactcattattcacctgggacctgtaagataaggagctcacagtggagacaccgtgggaggggaggcggctctcaagccctgagactgcagaggtatgatgcacccttgcaagtcagggcagaggcttggtcctcactgcgctctcctgtctccttacccatccacagtgcctctggtaccgtccaggatctccaggtcatagccatcagccagacaccagttgacgcttgtctccttagtcttcccggattgccttttggaatcatatatgctgactctgccaacctaggaatcccagaagcaacgggagaaagatggaaacctttcaggaataagattctgaagcagggactcaagactcataggagagaggaagtgtggggtcatgatctttcccctgtatttagggttctgtttggctaagactgagcaccctctagacatactaactccacctcgattcagattaattccagactaagagaagaaaagcccttggcatccaaaaggaagaaagtttaagttcttgggagaccaaccaatgttggtggtgggccactgtgggcaatgttcccttgtgggctaccactgtgggcaatgttccccttgcccacagtgtacatttttcctctgtttacatgactgcttgaaaaggaggaaaatgtcagggaaaatagaagggggttatagcaccttggggtggttgacaataaagggatgtcgtagtccatcctcaaatgcactcccatctcttgtcacacgacagcaaatagcacgggtcagatgcccttggctgaaaaggtaacctgagtacaaaaaagagaaacatatatacctgtgtttgcaccaaatgctgttaagaggcagaagcatgtggggattttggaggtacaagatatagttgtcaagaaagagaaacagctgccttgttaggaagcaccttctgactggggctaccaggatcttcctaccacagcagactggacactcaatcaattactgaggagtgaatcatgctcactttgataagggagacaaaacacctggcaataaagcatgcagtttgggatctgggcacaagaaggacagaccagttccagatcccaaggcaggccccttacccaatgtgacagatttgagataaatgggctgcaggaagtgggtcaacagtgccccttgcaggcccagcacgttccagcgtaggattttgtcactacaggacatggtacggagtctctccccgagccgaatgccatcccacgtaggcacaatgtcactggattccacagggattgtgccttctcctgtgtgagagacttgggtcagacccacaggcgccaatggaccaaaccactccctggcgtggtttctatcctccttaagcttgggccacaggctacattcattcattcttcacatatttcacagcccctgctatgcgccaggcactatgcttggtgctgggaaagaacggtgagcaaaaccaagtaagatctttgtgctcttaaaacatctatggtggtgaggagattgaaagggaagagaatagacactaaaccagtagccagtacatacggaagaattccagatgctgacagtgctctgaaggctctgaggcagctatgacggaggaccacaggggacacctcctgggacagcagcagcaggggagcccagacatggaggaggacagctggagtaagtgtttcaggcacacaggacaaaagcaaaggccccaaggcagccagcggattggctgttcaggcgcctgacagagagccagtgtggacagagcatatgcgagggatggggaaagtggcatgagaggaggccgggtgatcacagcaggttttgcttgtatatgcagtgcagtgggaaaccactatcgggtttaaaaaaaaacaaaaaaaaatgctttactgagatatagttcatatgccatacagttcacccatttaaagcatacaattcagtcatttttagtatattcacagagttctgcaactgtcaccacagtcaattttagaacatttcatcgctccaaaaagaaaccttctacccattggcgcagtcactcctcatctctccaactctcccactcctggccctggcaaccactcatctactttctgtctctatggatttgtctattctggacatttcatataaatggaatcatacaatatgtgatcttttgtgactggcttttttcatttggcatcaagttttcaagtgcatccatattgtaagcatgtatcagcacttcacttctttttatggccaaaataatattcaatttatggatatatttgatgttttatttatgaatccatcagctgatggacgtctgggttgtttccacttttttggctcttgtgagtaatgctgccatgaacattcacatattagtttccgtgtggacacagatctccatctctctgcagcatatacctaggagtggagcaccggctccatggtaactgtgtctatactttagggtatttagcaaggtttcaggaccaccatgatgactgctgacgtggcctgaacgcaatggagtggatgcgaagagacagtaaggagacaggagaggataggagagaaggagccagtggacaaggcagagtcaactgccagctagacaggaggggaccccagcatttggcatcctcatctgtcaactcctcagggcttggttgtgccgcactcttcatttcctccccgctttcttgaggtaatcctatgcattctcatggccatgaagaccctatagggggatgactcccatatttctatttccagccaagctccctcctctgagctccacatgggaacccccacctcctatttgacttggggatctcccagatctcccaaactaacacattcaaaatagaaccctgatcttaccacacagctccctgacccaggtcttccctttcctgtaaacagcacctctgtgcccagtgactaatggtaaaatcctagcagccttgtagagacttggggtccctggaccttgcagagccttttgaggaaaggaggcgggggcatgtatcactcaccgttctccaccttggtgcggagctttccttgtttgggattctcgaagacagggtagtggcgggattctgtgctttccatagcacggtcgctgcaggacttgtcaaagagggcgccatctccacacggagcagtgctgaaaaacaggggtggctgttaaaactcacctgtgggaaatctgcaatttcgtggggctccaaaacagtcagatgtgacagaagcaagggatgttttctaaggcctaccatgggagactggaggtggacagcagtacatgtgagtcatctacacctgaatatggacctcaaacccacagtggagtgtggcttattgtatcaggttcgatttacaggccaggagagcatttggatacccaattctaacagcctggcagggcccaccctggcagcaacaggaactgtacagacctgatatacagatggaatgacacagtcttttttatttggagcttttctcctcccttagcaggttcaaatatactatccttcgcagtctgggagttgtatttcattaactcactgtagagaaacctacaaaaagaaagtctggttaggaaggcaggttcaattctgggaaaagcagttgtttctataatctgacctccaaatgagaaagtaaggaaaagtctcaatgttgcagacgtttcacagtttatcaggtggaaattctccaggggagacctcagcatttcataaagcatagttagccttttgggtctccttcatttctgctgagggctcctcgctatggcggctacagggattctagagcagagcaaactgattcaaggactacaggaagctgttgctcctttctaagtctctcccttcataaattaaagaaaaggtgagctagaggagaaagctggcaggggcatcaaggttgtgtaggtcctcaaacggaaatggaaagctgcctcatcctcaaggccctgaggactaaaaggtcattttgtgtttttagaaaagaacatgaagcagcagagttagcagaaaaaaggacagcatttaaaaacaggccgagcagtgggaggcagctcagctcacagaggggatggattccatcagacaggttcaaatggacgggtgaaaagcaaaggctgccactgccacatcatgacccgtctgtctgagggggattcagaggccgtgtcagagccatgtggggcagggaactggagctctccacagccgggcagccgggccacagctctgacctcgctcacctgatgaagcctctccgggagattatttctgcatggcagtcattgacagtttctccttttaggctgagagaatctcctttcacacagcgattccctaggaaggtgtttaaaacagaaatagaataatggaaggaaaccgatggaaaacaggatgaaggctatttgttctgaaagcttcaaggcagaaacagcctcagtttctcagatcctagactcccatattctctcctctaggaactaagaactcattcctcactctgaattgactgtagctaaaatgaagtctcttctccctgccttggacttacatgcatggactccaggggaggatgagaggcacccgctttcaggcgccatgggaggcggcatgtctcagagcctcactcacctgttcccaagctgacgacgacacccatgtcctcagagtcttttttcataatgatggcggccagaatcttgcggccgagcaaggagggctggaagctgttagtcagagtgttgaagcaccggtggctcagcatggctatctggtcatggaaggtgctgccagtgagagggagctgtggggaaaagaggctgtgtcagcaccacaaagctgaggctgtgtccaccatattcaccgtgggcagggagatcaagctctacttgtcgtgtgagtcatcttttccttcttacatctagtgtcccagttactgctctctcgaggctaagagtaaagcctaggaataactcgcatgacagcaagagccacctccacttaggagttaggaggacccccccgccccaaaaaaggcaccaaaagtagacgtcttaactgtctttggctgtgcttctggggaccttgagaggaggagcatagttcttctgagactggcccctgtcactggggttacctctgtgaaacccatgcgttctgccttctcgttctccccaatcaagacacggagagccgcatctgctgcttcctgcttgccttgcttcttgctgtgtgcgcagacggctgggaaccagcgacccccaacttttgcttggtaaacgaacctttgggatgagaaacagagaatgaagacaagtgccagaccctgacattgttccaaggaagggttagttttgctgaagatgtggccagtcttgcaaacatatggacccgtcaaacagaagctgtttctaaggcagcatttcctagattttggtcattcatgaatcaccacatgatttgtgccacatccaggtattacttggactattaattaatatttttctctaaattgacttcttagagccagccattgtggctcacacctgtaatcccagcaacttgaggagctaaggtgggagatcacttgaggccaggagttcaagaccagcctgggcaacatagtaatcccccaggcaacatagcgagacccctgtctcttaaaaaaaaaaaaaaaaatttagctgggcacggtggtctgtgcctatagtctcagctacttgggaggctggggtgagaggatcacttgagccctggaggtcaaggctgcagtgagctatgaccatatcactgcactccagcctgcgcgagacagcaagatccccatctctaaaataaacaaacagactctaaaaatgtaaatatccgtaatactaggtatgaaaaaagagataaaaatgtaaacacactgaaataggaaactttgtttcactactgtaaatggaaaaccagtatcacttgccacatattgaaggtggctgtaaaacagaatatgataaaatcatgttataaaattctgactagatactgttacctgcaaaggctctgagcctgtccttactataaaggaagattatgaagtatgaggaaggcttaacgaaatgctagcaccaacttggactctcttcttaagcagaaatcagaagggactacctttctccccacaagtcactgttacttcatacactgtctgatttttaaagcgcccaactccattccctcatttacttcctattagctcaaggggacttgacctggagaggtcattaggtcaaggtcggccttaggccagggacccaggttttgctgggagttgtttttttgactcctggcaggcttaagctaactctggggtaaggaatggatcttgggcgcatgagctgcgctgacaataaagtgcccaagtggagcagggaggtggcttctaccgctccggctggtaatttccaaacacagagggaagagcatggtggagcaaaacagcttggaaatgtaccagacaaggcatcaagaatcctagctttcaaccagatcctaatctactggctgagaacccagctttggatactctaactgcatataacagaggcttcagtttcaagacttagcagctcaggcagtaaaaggaatcaacgtttatgttcaaccacatggagtttctcactgttccttgatgatccgaagcaactaaatgccttcactcttttctttgtccatgctggcaggcccgtgcaggccagtgggcttaagttcagaatgagagggacagtggcatgaaaagaagatggtgaaggcggtcaggagggacagattgtgtagtatctttacctcagggatccaggagaatttcatgactgccccatgtgtttgaaaagaatatgaactcttacgtgcaaagttttatactgatatatttacatatatgataaagtttgttaattatgcaactagaatcctttagagctgtgctatccaatatggtagccactagccaaatggggctattgccataagtgcctcctctcagcctctttgccagctctgcgcttctcccaccacaggatttaacagtgtccttcgcctagaaccctcagtctttctctcttcatcatccttaaagtctcagctcaggcagtacttcttggggaagcccttccccctctccttcctaagtcaaactgtgctataattgattctcgctgcaactccagccctttggaatacttatcaaatatgagatcttacatttctttaggtgactattggttaatgtttggttcctgttctaaaaaaaatagaagatactccataaataagtgttgagtaaataaagtataaagatcagttaggaggctattgtgacagtctagatgagacagtggcttggattagagtgctgacgctggaggtggaaagaagaggaagggatttgggatagaaattctaagtataaccaataggacttaaggatgagttgacgaaggaggtaaaggagatagaggaaaagatgatcctcaggtttctgacttgagccactgggtagacagtggtatcacttactaagctgggaaagacttgggggaaatgaagcgaagggggcaaaacccaagagttctgctttggacatgtcatattagggatgttaatccaaacagaggtgacaagtaagcaactagatggaggaatcgggagctctgagtggtctccagcatttagatattaaaggtcatggctgtcgcggtggttcatgcctgtaatcccagcactttgggaggctgaggcgggtggatcatctgaggtcaggagttgaagaccagcctggccaacatggtgaaactctgtctctactaaaaatacaaaaatagtcagatgtggtggcagatgcctgtaatcccagctactcgaggagctgaggcaagagaattgtttgaacccaggaggcggaggttgcagtgagctgagactgcgccactgcactccagcctgggtgacagagtgagactccatctccaaaaaaaaaaaaaaaaaaaaacagaaaagaagtcataaaattagttaacgtcaccagccacagtagacagaaaggaaaaaaagacccagcataattcacattaagaagcaactaaagtatattattgtacgagatagttaataaacgtagttactcaattagcatttcccctctctatgcaaccttcctcagctccctggcagacagtggcagcagtgtcctctgtgtccccacagcactctgcattcacctccaatggcacatttcaatactgctatggctatatgtctgctacacactcaggggcagcaattttttgtatcttccatctagttcatagtaagttcttacattctcaatgaatggctgacttgaagtcctagaaaggatttcacagaagatttcacagaagagaaagaggaaatgcactgaacctatcatctgaaggactgtgcttaaagataaggaggtgcttattgagatgaaggatatgaattagtagaagagcagctggagggagactgggcctctccttttccagatggcttaaacagtgggcagatgtgtgttctaaattgggtcatgttgggcaaagggctacttttaaaaattatgttaaaagttcttacatatccatgagagtaacaatctgaaagaaaactggaaaaggacaagaacaggtggttcacagaaaaggaaatgcaaataacacataaatatgaataaatgaaatgccattacttctgatttttttgtttttttttttgagacggagtctcactccatcacccaggctggagtgcagtggcacaatctcaggtcactgcaacttccgcctcctgggttcaagtaattctcctgctcagcctccggagtagctggcatacaggggcataccaccatgctcagctattttttgtatttttagtagagatggggttttaccatgttggccaggctggtctcaaattactgagctcaaatgatccacccacctcggcctcccaaagtgctgggattataggcgtaagccactgcgcccggctgacattacttctattaaggagagacaaatttaaagtaacaagatagcatttttataagcttttttccttaatgactttaaaatggacaagttggatgccaaacatgtgaaaattcaaacagttaagagtgtacaataaaagtgtccctccttccccagaagcaaacacagttgccagttttttcgatccttcaagaaaatattctagacatatacagacaatcttcacctctcccctcactttacaccttgcttttccactttgtgatagaccttagagattaagaaaacatgccggttgcatggcaagagtgatgccatcttgatgcaaaaccactatgaccaccaatatctgactcccgcatcccaaagtgttgggtagcataaataattccacacaaagatgtctaccaagcctccccaccagctagtgctcataagtttcacaagaaagtataatgtgtgaccagctgcatgtttaaccaaaaaagcctctatagaaagcatactttctggagggtaagtgcagggatccaccatcttgcagccacccaagacatcatttctgttcctaagtccctattaaatgtttacttctgagaaactgaatttgtcagcttctattcaatgaaatactatgcagctatgcaagaagtctggtaagtaaaggagtcaacgtataaaacagaagatatacttgtttaaaaagacaaaagggaaaatgtgctagttatgcacagcaatttctagaaggactcaagaaactggtatagtcatgtactgcataacagtgttttgttcaatgataaatcacacatatgacaggggccccgtaagattatgatggagctgaaaaattcttatcaccaagtgcagggctctgtaacctgttaggaacctgggcacacaggaagaggtgagtggcgagcaagaaagcattctggtccgagctccgcctcctgtgggatcagcagcagcatgagattcttgtaggagtgtgaactcgactgtgaactgtgaatgcgagggatctaggctacacgctccttatgtgtttactatatttttatcattatttcagcgtatactccttctacttctagaaaaataagtaactaaaaaaagcctcaggcaggtattccagaaagcactgttaccataggagatgacggcccccatgcatgttattgcccctgaacaccttacagtgggacaagacgtggaggtggaagacagtgatactgaggatcctgaccctgtgtaggcctaggctaacagctaatgtattttcatcttagctttcaacaaaaaagtttaaaaagttaaaaaaataaaaaaatttacaaacagaaaaaagactatagaattaaggatataaacaaaggaaatatttttggatagcagtacaacatgtttgtgttttaagctaagtattattacaaaaggaacaaaaaataaaaaagttaataaagtaaaaaataaagtaaaaataaagtaaaaaagttacagtaagctaaggttaatttattaaagaaaaatattttaaataaatgtagttagcctaagtgaacagtgtttacaaagcctacattagtgtacagtcatgtcctaggccctcatattcattctccactcactggctgactcacccacagcaacttctagtcctgcaagctccattcatggcaggcgccctatacaggtgtagtatttttttaatcctttatgctgtctttttactgtatctttttgctgtttagatagacaccaatacttaccagtgtgttgcagctgcccacagtattcactacagttacatgctgtacaggtttgtagcctaggagcaaccggccataccatacagcctgtacgtgtgtaggagcccatgccatctaggtttatgtaaatacacactgatgttctcacaacaacaaaaccatgcttctcagaccgcatcccagttgctaatgcagggctatagtaatatatgggtctagggagggaaactagaagtctgagacggaaatgagacttttcattgaaatgactactttttcaatcagcttgaatgatttttttcaagatggagtcttgctctgttgctcaggctggagtgcagtggtgcgatctcagctcactgcaacctccgcctcccagcttcaatcaattctcctgtctgcctcccgagtagctgggattacaggcacccgctgccacgcccagctaatttttgtatttttagtagagacagggtttcctcatatggtccggctggtcttgaactcccgacctcaggtaatctacctgcctcaacttcccaaagtgctgggattacaggcgtgagccaccatgtctggcctgaatgattttttaatgtacctatacatttctttaaaaattaaaactagtcaaaaaattaaaaaggatcatgcttactggaagagtgaacgcattcactcttggcaggtctattgtcttctaagaggccgtggagacagggctggacttgtttccctcaactcgccccttctgtcctacacagctaaagcacacccttgttttccctgggttacagaccatccccaactggtgacacatgcattagccaggactaggacactcacttgggctcgtgaggaggtccggactggtcgaccaacttgaattcagcagcaaagccatgggagcgggcgtactccaaaaggccacccacagggttggtgttcaggtatctcacgagctcgccaatcttcctgaccttgttgggcatcatggattccaagttatcaagtgactctgagatcataccttcaggctaaaggagaatccatcaaacagaggagccataaacacttcaggaaatgttgagggagtcactggcaatcttaaaccactcagttgctaaaaatgacctgtatcttttgagtaggaaaacgccctacctggttatcagaagccatggagttggtcgcctccccatgcagggccttcatggcttcctctgcggccatctgctttgccactttcttgctgggagcactcacactggggaaagtttgggctcccactgcaacacagtattggaacctgacaggagatgaagcacgtagaaggattaaaatggttttgactgaggagcctgacctagcctctgccaggctgccatcctccactactggtaatttccttgaacacatcacctctgtgcagtcacatctcatgcagtcacttctgccttgaacagccagtgtctcttagcctggctgacccctttcaacatttaagcatcaacctagtttcacctcttccaggaacacttctcttgaacatgtgagtctatagacccacaggcagagagcttctcaggtcctgtacctttctgtcccaccaacagtgagtgacctccaagccgtgaacctccctagtgcttatagaggagatagagggtgggccaggaattccctttgaattcctaatccctaattgtctgcctcacaagcagcaaccaggacctcagagccctcctttccccattttgaaacaggagaaattggtcaatctgccatccctgaggaggcaaggaagaaaatgtgtctctttttctttctgagaaaacctcagctggacagaggacacgtaggacatacttgggttcatgggcagggccttctttggacaggagacggaattcgcaggagttccccaatttgtgcatacactcaagcagtgtggtgacggggctcttcccagaaaagaaggatgtggctgaaggggtgggggtctgggactctgcagtctagagaaaatgagagacaagaagaaaacaaaactaagaaaacactggttagtccatcacagaagaagggatggggatgggggactttattcccaccacctgtcaaggggttggcttcccaaagttaaaggggctgctggagctctcattccgcatcttccaagagaggagattggcctcaataaactttcaggtctctttcaagtccgaaattctgtaaatccaattatgttgggacaggagcagacagaggagctgggtatgagaggaggaaaggtgggctggcgagatagggtagagggaagagtgggaagctgactccgagatggtgtcagttgtttaggctgggattgcctcaagggagtcagttacaatccagacactgacagggaactgatcctcccagatggcaggaggacacctaccttctctgattctttctctgtggaatagtgggatgattcttctgattttccactgtccttggctttggcttcctctagcagaattgtcatggctttcatagctgcatcctgcttggccactttcttgcttccagcttcagctgggggaaactctcggccattgatgacaacctggaatttaaatcttgacggaaagtgattagatgtgtgaacaggagtctaggtcactccttctgccttctccaaagagaccttcaacctggaattttctgctacgctaaggggcttttcacttgtggagatgaagggtaggccaaggaactccttcctactccttaaggctcagcctgtcctttctttttgtaaacaaagcagccagtgactctttccccatagctcagtgaagcaaacataggcacagatgataggaaactagctcaggggaaacccactatctctttaacaatgaattaagataaaacccacacacacaaaaatgatgagccaaaaattaccattatagtcttgtgagcaaccaaaagaccttcattctaaagcaattgtggtagactggcctcctcaagggagggtcctaaaagatagtgaaggcttcttataacccagtctcacactccccactacctagggggatcaggcatctgccacttatcagtggcctgcttttgtccctagacctatatcaccgtagtttgttatgagtcactctatagcaccatttgtctccagctattttctacataacaaggaatttccccttgttatgtagaaaataaaaaagcatttgttctaggcctctggacttagcctaggccccctttgttcaagctttcaaatgtggtgagctctttgctcagtctgggatttcatttagaaaagtaggtcaaatttcttatttcctaggtcttctgatatatttgaacatggcaccaatgtttcttttagtgtgagtccaaagaatgactaaccacaaaatccactgctttcctccaactctggggaggagggatggaggcaaaagagaatgacggccatccagtctctaccccaaacaatccagctctggccttgccagcttttggacagacacaactccttttcttaaccgctctcctgaaatgccaaattggtgtcatgaagacagtcaagacaaggaataagggccctagccaggaatctacacccctagaaaccaggctaggtaaacataaaggtcagtggaattctcccccatcctactggctctttccctggctgcagctgcagccactcagcttcagtggttttgctctctgttatgcccttcagaagctcctgttttcctcaatctgtccactggcctattaggacctacagtgcagggcctgaccagctatctgagtgaggtaaaggctgacttcacagctcaggagtggcagcaagtgctagcctacccatctgtgcagaggaggtttataaaattagaaccaccaccttcaacaggcaggcagccgtgcacacgctcctccatcctttccccccaggagctatgcagaggggggattgtggacctgctgctgcttagcagcacaacccacccccactgtgtatgcagcctgccccaacccacctgctcctgcacctctctcagaaaacggcttagggaggaggggaaggcctacagaagggaattaagtcttcattacctctgccttaggaggcaggcatgatattgatgcatggagatcaatcatgtttttcttttttctttctttttccaagatggagtctcactctgtcgcccaggctggagtgcagtggcgccaatctcggctcactacaacctccacctcctgggttcaagtgattctcctgcctcagcctcccgagtagctgggattacaggcaagcaccaccacccccagctaatttttgtatttttagtagagatggggtttcaccatgttggccaggctggtctcgaattcctcacctcatgatctgcctgccttggcctcccaaagtgctgggattacagtcgtaagccaccgccccggcccccaagaccaatcatttctttcttttttttttttgagatggagtcttgctctgtggcccaggctggagtgcagtggcgcaatctcagttcactgcaacctctgcctcctgggttcaagtgattctcctgtctcagcttcctgagtagctgggactacaggtgcacgccaccacgcccagctaatttttgtatttttagtagagacagggtttcaccatgttggccaggctggtctcaaactcctgacctcgtgatatgcctgcctcggcctcaaaaagtgctgggattacaggcatgagccaccgcgtacggccaaaaccaatcatttctaaagaagcttcattacagccaacagagtcaacctcccccttgttcagccaagattctggctggtccaaggtctatattccctgctcaatatctggagaaagggccaatcaaggggaatttagctaaaaggcagaagggaaggaggaaaagataggcgccaccaaacagcactgctcacaaatcagccaagactgcgtcaggagcaaaagcacctgaccccaaccctaggtacagttcctgggtggtctcttaccgaggttcatggggtggtccactctgctctatcatgttgaactcacaggtttgactagcgaactgggcatattctaacagcccgctgatggggttcttcagctggcactctgtcagtttcttgtagggtgaacaccgtggcaagccatgactgtagaaggagggcatctccatgatggctcgaaactcacctggtgctgcgcggatactattcaagtcatctgggatgtcatctgtggcccactggccattttcaaagtcaacataccctgcttttgaggggccattgtaatgaacaggtggtttcagtcttgctggttctggtctggcctcttgcctgttttctaactttatgacaggttcctgcccattctccactttttctgtggttaccatgttatttgaggcatttgatgtgggtatattacaggtgaggaactctgcgtttcttttggtctcagggattgcagctggagcggtttcaggaacactgttcgtatttctcttgatttgcatcctctctcgcttcttgtctgtcaaatgccatatgggaggggttgtcccttgtctatagacatccccctgcctttccatgtcaattagcacagcatttatatctcgggccttggtaaggccaatatttttagccaaattcagggcagaggagtcagacacattgaagagatagtcgcagattttctccttgatctcggccatgtctaaaaactcaagaggatcttccaaggcagatgtggagttgctgtcttcaggttccaaacctgggtctgagtttggggatccttggctatgactgtctggtcttaccactccgctgtgctggttccaagcctgagctgagactgcaataaaaggctcaagaagatcttctgagacagatgtggagtttctgtcttccggttccaaactcgggtctgagtttggggctccttggctatgaccgtctggtcttaccactccgctgtgctggttccaagcctgagtggagaccgcgattttccacaaagggggtgttcctgcctctttctgtagcttgcccttctttgccagggagtataaaactcgattgatttctttcttcggagtcccaagtttcccagacagatcatgtgctgtggtggccttcccttccccaagctcttccaggaactttaagatcctttgttcctgatcttggtagatactcagttcctggaaatgtgaggaaaggcaatcaacacctctctgtggcagactcctgccacgtggtgaaggatgctggaaccctctctggagcccctgacttctgagatgcacgcccctggggacacccctgatgtccacttgcctgcctctggtactggaggcaagtagtactggaaaccttggccggagtcctgggagggaaggtggcagtgacggtgtctgctttccaatcaccggtgcttctgggagctgccccttgagaaattctatttgcttaagcaggaaactactgggggaagatcctggcccaggctgctggtacctgagctgtctgtgctcatagccttgaaatggatgggtgtagtatccgctgagggaatacccctgcagaataagacagtggaaaaagaaaatgaattagggctgcagtggtgaacctgtggaggcccctccctttgctgcctgtggaacagcccttgaagggctgagaaggcaattgagccatgggcttatgacttggctagggtgacttgcctacctcctaaatcctgcctaggggcctgccaacaggaacacagagaggggagcaggaggcaaagcacgcagaacttccaggaatacagaggttctgaggcctcagcatagcctctccagcaacctaacttacttttccctttgacagaatttaagggagttgagaaggtaattttctagttaccaaaacaattacccctttaaaatcagaacaacaaatatatgttattgttttgaaaacaaaaacagaataacctgaaataaccagaacaatcacatgaaataacaataaccaagggagatgggactagggaagggacgagatgacctctccttaagtcaggctcaccagtgcaccccttgcccacctgtctctaagatctatcgtttagatgactatgacaaaagaagaaatgtgattggatgaaactgaaccccagtcctccaaggctgtaacagcgcagtaacgaaaacaatctccaggtgggaaaaggccacgggacctcagagtcatctctgtggctcttcactgccatcccaggaggatcagaatttggtcttcagggagctggagggtttcctgataaaaatggcacactgtcctcactcttcagtgtggtacccaggctcagaagggatgccagagacttttgcccaaaccacccaggctctcctggatgtgtggagctggcagcatctgctcctcaccacctcagaccagtcctaccttccctagctacttccccatagctgcttccactgcacgttcttctgaaccctgacggacagggcacaagcaaccccatgttctcatatgcacatttaccagaacaccaagcacctgtgacccctttccccacccacccacctgcaaaccagtactgtcttctccccagggctgttcactggagggtgatggagccaggaagtacttataagcctgggggtgtcagtaaacaccttgcttcctttccctggggcttgtagactgggaggagggattctgacaacatttactcacactcaccgccccctcctcagactctcctggaggctgcacaggtagaggtgggaccctttcttccataactctagccttctactcttccacatcctgacacacttaggggatttcagcattcttgtcaatcactctcatggtgtcctggctacaaggatccttaacccagtgatctccatccctacctttctgccacacaattggcttgtctagctactccttcaatctcactatgactctaacctaggccatcacaccaagacctcaaatcctgcaactcttttccagtggctgataaactttttctataaagggccagacagctctgccactgtagcacaaaaacagcctcacacaatatgcaaaactttatttacaattcatttaccatgaagctttatttataaaaacaggtagtttgtacctgtgggccatagtttcttgactcctgctcttttctgatggtgacttccctgtgtttctacaacttcactccttactctggtggaacctgctcctcgcatgaccccggtgaagctgccagtaagccaccctgattcttccccactctgacttcacacacctcctcaccccacctggatctcatggtcagttcccttctccacccaaggcccactgtcccccttttcttctccaaagcttcccagtggtactggagaaggaccttgacttgtgctaacagggtccataaaaattccttctcttgaacctcatttgggtcttcgctgtgtggtggtcaattgtgtttaacaaacatgccttagttcactgtggattgagtactcttcttttaaaaaattctcctcccagggtttggtgacacagcaaaggtctttcacctcttttttcttctttgtccctttttcccaccccttataattttttaatagctactgtattaacggatccaccctttatataatcagtctccaaggttttaaggacctcttcttcctttataatttatttcctaggttgctttaatcactgccccaacctaaactagccctctgaagcaagagcactcaaatctactatgtccagccactaccttgtgtgggagcttaagatctgaatttccaactatgtcgacagtctgtccacttaaatatcctgccataactcaaacagcacatattctgaaccaaattaatagttccctcaaactcagctccttctcctgtagttcttattgctaatggcatcactctcctcctagcctattaaggctagaaacctgcgtcatctttgctgcccgcctcctggcctcatctcctggatctcatcaggtagttgccaagtcccaccttgtctgccacctctgtactgtgtcttaaatgtgttttcttccagttccagcccctcattacctcttactgggccattgcaaaggcctataatctttctatccctctacatgccaatccaggtggcacatctccctccacagccacctatcacaactctgaccctttccttatagagctccttaaatgccacttgcttcaggagactcctgactcccaccttcttcagcccttggggtttcctctccttgagcttctcctactcagcacctgttaaaccatttactttccctcgtatcagagctactggattttttttttttttatggcacacacacattgcagtgtctgaaaggtaattaacattaggtgtcctataagttatactcaactctccactctcaatattcccaacacagtactgatgaggggcttcagttgattccatggtgagctcttgggggtcaaggactatgcttcaatcatctcaacctctctagcacttggcacaaagctgattctcaacaaacatttgttgaattaatgactgcatgaacaagacgccactatgcaagcaatcatttctttcttgttcctcttgctgcaccctcacgcccaccatattgctagggacagaggcaaatgtgtgtacagagtgagtgctggctcccagagctgaattatgggacttaggggttctcctattagctctttgagtgaccttgggaaaaaaaaattgtgtttcaaagtggctagagtcagttaaaagctaaatgttttttaaactgctactcttggcccaaatctggaaaatattttaatgtctgtctatagaagaattaaattatgaaacattcattctatggaatagtactcacacggttattttttttcttgtgagacggagtctcgctctgttgccaagctggagtgcagtggcatgatctcggctcactgcaatcaggctggagtgcagtgtgatctcagctcactgcaatctccgcctcccgggttcaagtgattctcctgcctcagcctccggagtagctgggattacaggcgcacgccaccacacccagctaatttttgtatttttagtagagatggggtttcaccatgctggccaggatggtgtcgatctcctgatccgccctcctcggcctcccaaagtgctgggattacaggcatgagctaccacgcccggccagttattttatttttttaaaatgtgtcatatctatttgtattcacctggggataatttaggaatcatataatgttcaataaaacaacaaaaagttgtagaatagtatgtacattataatttttttccctaaacaaaaagagaaaatccatgaatgtgtatgtgtgcgcacaatggaatgaacacagagaaaagaaaggagatgtaagtttgctaaggatatcttagggcagtagggttagagggagaggaggagattattaatctttctttttgccccccttaaatcccctaaacaccaagccaccgttgagtacagccatttggaaagctacggaataggagagcaagaaagtgagcaagcaacccacagtgatcctttctaaatctctcagcatcacctctatgcaaattacataacaactcatttaacattcattgcctcccagatttcactttaatctggtctcacatatttaggatcaagagataagcactaccccctttgcctttaccacacaggttccacagtgcaatacactgacacctgtgcagaaatgcttttccttcaagttaggcgtccttaatcctttcaaaggagtgcttaaaaaaaaaaaaatatatatatatcttaacaaaattgaggtatataatttagatacagtaaaatttatccttttaagtgtataaatctatgaatttcgacaatcgccaccacaatcaagatatagaacatttctatttccctaaaaagctttttcatgccactcaacaatcaatttcttccacgatacccagtccctggcacccacggatccactttccatccctataactgtggttttttttttccagaatgtcatataaatggactcatacagtatgcagccttttgagtctggcttctcgtgcttagcataacgcacttgcgagtcacccgtgttgttacttgtaacagtatttcctcttcactactaagcagtatcccattatgtggatgtatttcagtttatctgttaacctgctgaaggccatttgtgttttcccagtttttagctataaagtggttaacaagctttctcctacagcttaagtgccatttttaactcccagaaggccttcaggaggtggataaggtgagctgaggatagtgtgcgctgctcaaagtccgaacgttgttcaagtggggctaaagcgggggtagggggttccacaaggggccctagcagaaagggagacgatgtgtctgccttgacatgggctcaggccttcctactcagacgggggcgcattttcccccaagccctcttcacgcactgctccattctgcagaattaatgagcaggatacaaattcacaaattcctaaaccagcaatgctgcttggcaagactacacacacacgcacacacacacacacacactctcacaagacgcacaaattcctaaaccagcaatgctgcttggcaagacgacacacacccacacacacacactcacaagacgcacaaattcctaaaccagcaatgctgcttggcaagacgacacacacacacacactctaacactcacaagacgcacacgctacgcactgcaacacaaagcctgtgaggttgtaaacgaacccagacggcggcgaaggtccaaggccggcccggcttacctgccgcggattcattgcgcccgcgaggcattgcccggcccgacccgccggcggcacgaccctggcccgaccgctgggccgcgccagcccctcgaggcccccacgcctccgctactccgcactggaagtggccccggggcgtcggcacgggaaactccgcgggtctgcgcgccgggcccaagatggctccggttcaatttcgctttcgtttcctcggaaagccttcccctccggaaagtttggccaagaggaggggcttgagcaaatcttgcgccacgcttggtttcaggccggttacaagtcgaacccctccgctgcatgagaactacggaaggtacttttttttttttttttgaggcggagtctcgctctttttgcccaggctggagtgcaatggcgcaatctcggctcactgcaacctctgccccccgggttcaagcgattctcctgcctcagcctacggagtagctgggattacaggcgagcgccatcactcctggctttttttttttttttttttttgtatttttagtaagaacagggtttcaccacgttagccagggtggtctcgaactcccggcttcaagagatccgcccacctcggcctcccaaagtgttgggattacaggcgtcagcccccgcgcccgtccggtactgtttaggaaaaccgccgtttcagtactgagctcctaattccccgcacaggccgtaggcaggaatacacgaatagagcaaaaggaaaacaaaggcacacaaaacctcaggccagaaacagcatgacgcccggtcctccctctctccgcgccagcgcggtggtggccgcgtctccaatgtggaggggggggggaggggatgggcgggagcgcagatctcgtcaaacgaccaaggtccccaccgtgggaccttgttaatgctcctactatgttataaacttaagcaagcagatgccagccagtaaaaagtaccaagagtagcaacagcagcagtgaacaatttaggatctaggtcataaaaactaccccaccaggcaaatggttaagtactttacatgtattatctcccttaatcttcacaacagccctccaaggtaggcattattcccactttgcaggtgtagaaaccgaggcttgactaaggccacgctgctgccaaatccaggtctgaaggctttagtaaagctcagtcttcagcgcttctctacactcattcaaattacaccattactttcaaaaagataacttttgttatctagagggacaaaagtcaaatttgcttcatggtcaggcttctctaactgctggatttttgttcaaggtatctgggaaacgattattctagggttcaacaccatcctcacctgtgagaatgttctttccctgtgtttaatcttaattttacccccatgcttatgaaattacaaggcagtccctttatagcagtatctccagctgatgccctttcatggtgttagtcactccaaattaacattcccttgcaggctgggctctgtcttccttctgggcctttgcacattctattcgttggcctagcatgcacctcctccacggcttcccgtgaatcaacctttcaaatttacaagggaggccttccccacagcaggtagggggagaggagggggagcaggtgctgtttgtggtttcctactccatgcttctcgagttactgggcgcctacccctaatagggcacttgcacactgcgctaaaaacgccccattcgatcatttaacaaaactttactaagcacctaattatgtggcagatactgtgttaagcacccaggatatgacacaaataagagcgccatcctttagctagtctgctagggaagatggatgcctcagtaatcacaattatcatgtacttcttgttcatatatctgcctctagaattgtcaagtcatctcctcgggggcaggaagcatgttttgtatccttatattcgccttcagagggctggttagttgaaagaataacagacccctcagtaggtataacaatgggcaaaaacaatcgaaagacaacttcacaggagataaaaaatatcaaacatatgaaaaggttctcaaccccatcacatcagagaaatgcacagtatagctacagtgagctactgtccattcaccagacagacagcattagccatctgattagaccaggtggcagcaaggatgcagagcagctcttagtcactacaggaaaccagtttaccattatctagaaaggtaatggtaaaccccaagaagttcatggttgcattatttgtaattaatagcccccaaactggaaacaacccaaatgtccatcaaaagtaaaatggataaatggtggcatatgcccatgatggaatacaatacagcaacaaaaatgaaagatctacgcatgcaacaaggtagctaattatctaaatatgatactgagtgggaaaagccatatgtatactatatgatcccacttacagaaagtcccaagccaggcaaaaccaaactatagtatgctctgcataaaagacaaaatgaggccgggcgcagtggctcatgcctgtaatcccagcactttgggaggccgaggtgggcggatcacgaggtcaggggatcgagaccatcctggccaacatagtgaaaccccatctctactaaaagtacaaaaaattagctgggcatggtggcgtgtgcctgtagtcccagctactggggaggctgacgtggtagaaacgcttgaagcagggagtcggaggttgcagtgagccaagattgtgccattgcactccagcctggagacagagcaagacaccgtctcaaaaaaaaaaaaaaagaaaaaaaaaaaaaaaaagacaaaattgtggttaatcacttctagggagaaaggtgggagttttgactgggaagaaatcttttgggtaccggtgatgttctagctcttgacttgggtagtggctacatatgtttgctttccaataatttcattatacatttacgttttattcatgtttctgtatatatatgctgtatttcacaaatttaaaaggtaaaaacaaacaagaaccacaacaaactcttgctgttgcaattccagtccacttccccatgttttttttcctccgtttaagtaacaggagttatatcttacctctgctttcttgtcttcaggcaagacaatctgaaagcctttacccttcttcagaaatgatccagaaaagctttaatcacaactactgtgcgagggaagctgcaccgctgctccccccaccccttttaatctaacataggacacagtggcaaagcagtgaactttcctcaacagaaggtcagtttatgccttgaaagaacaacaactcctattgtcatttaatcttagcagctcaagtaactgcagacagtcttattcataaacgtttcatctcctccccctcagtaattgttttaactcccccatggttgtgaggtgatgatgtctttttttttttaactgttctattgtaggaacttgacgagttggatgaaagtctttaaaaaaattaaccaaaaataataggtttatttcagaaaatacagacaagcaaacacaataaaaatcacccattgttaattcatcattcatccgtgcctacccttcgagcattttccctgtgcgtaacttccccgtgcgtaacggcactgccaacacatgggtggtcagtcctctcaagggaggagctcttcctataaagaatggctcacctccccaggggcctgtgaaatgaccccagatgtatctataccacctaggtctacttattaaaaaccacctaaatgattaagagttactgtctaaaaatgaagtactcagaaactcagtattctcagaagtctggcttccacatagcagtgccaagctctagctctataggtgcattcagggggtgagacttccccacctataggaaaggacatgctattatcagggctcctgagttggttttgttttccaatccctgctattcttgctttttaactataagtaactgttagtctgacttagtaattgttaatttggtttgttgtggatcttctgtttaaccttactgcgtgcagggatacatgtttacaacaacagtcttttttaatctgtaatttcctataaccagactttactacacacatgggctatatccaattggaacatctatctcctgtctactgtaaagcagatgtctgcaaactccttcagtatttgctcatacagtgatactgggacagaaatgtactgcctgtgaatgtattctaaacaatttgcaacatattatcaaagaaagtaataaattactcagtttttttttttttttttttttttttttgagatggagtctggctctgtcacccaggctggagtgcagtggtgcaatcttggctcactgcaagctccgcctcctgggttcacgccattctcctgcctcagcctcccgagtggctgggactacaggtgcctgccaccacacccggctatttttttgtatttttattagagacggggtttcactgtgttagccaggatggtctcgatctcctgacctcgtcatctgccggtcttggcctcccaaagtgctgggattacaggtgtgagccaccacgcccagcctgctcagttatttttaagtaccagggcatcattttagaataactcttaggaaatgtatagtaagcaattcagagttgctaggcacaaatttattgccctccttttttgttatcgttgtttctcctcaattctttatcactgagtttttattccactacaacagttcctaacaacattaattttctttctttctttctttttttgagatagagtctcgctctgttgcccaggttggagtgcagtggtgcgatctcagctcactgcaacctccacctcccaggttcaagtgattctcctgtctcagcctcccgagtagctgggactacaggcacatgccaccatgcctgggtaattttttgtatttttagtagagacggcgtttcaccgtgttagccaggatggtctcaatctcctgacttcgtgatccgcctgcctcggcctcccaaaatgttgggattacaggtgtgagccactgcgctagtccctcaacattaatttccaaaattcacagtagcctcccacagtaaacccacttgctttgataacctgtaaagcttttggtagagaagagtgagttgcccaactggctgagtagtgctctgtggcagtatttatgctgacatatattctattgatgttaatgatcacaaatggctttttttttttttttttttttgagccagaatctcactctgttatccaggctggagtgcagtggcatgatctcggctcactgcaacctccacctcccaggtacaagtgattctcctgcctcagcctcccaagtagctgggactacaggcacgcgctatcatgcctggctaatttttatatttttagtagaggtggggtctcaccatgttggccaggctggtcgcaaactcctgatctcaggtgatccgcctgcctcggcctccaaaaatgctgggattacaggcgtgaaccattgctcccagctaaaactggcttttgaagttacaagaaagcaagaaatgtggccaggcgcggtggctcatgcctgtaatcccagcactttgggacaccgaggtgggtggatcacctgaggtcgggagttcgagacccgcctgactaacatagagaaactccgtctttactaaaaatacaaaattagccgggtgtggtggcacatgcctgtaatcctagctactagggaggctgaggcaggagaatcacttgaacctgggaggcggaggttgcagtgagccgagatcgcaccactgcactccaccctgagcaacaagagcgaaactccatctcaaaaaaaaaaaaaaagaaagcaagaaatgcctcaggtacccccagaagaaaaagaggtctccaaaagctattaagtgcatttatccactccagtaagttatctagtaacaaagaaaaaaagtggtatttatcaactagctatatgtgccaggcttaagtattatataataaagatataacatttgcaataatattacatatgtaaaataatactaataataatgactaacaggcctgtgtgcaatcttttgcaagtatgtataactaataaatgtacattcagtcggataactaccccacggggtgaccctatacaacttgtggttttatacattatattctgacacccttaagccgcttctccgatgctagattgttcttggatgcagcacctgactgacttctggcctgactctggctagcacagaggttccgctactggcctacatttgggttctattgagtcaggacccaaagggggagatctcccatcttcttcttccctaggatccagatccagcctgtagggggctgctctcagccccagcctcatgcaagagcaatgcccctatctccatggcttgtagaaagcaggaggggacagtcacagtcctgtcctgggcaggctcaaggcagccactgccctgccttctgcagtgtttctcagggaaataggctgatttcaccaacagccaatttgccgaaagtcagtttgccaaatggtcaattccttggataaccaatttacgaaacaaccaatatgttgcatttacttttttcttaaatctccctagtcttaattgaccagtttttattctgtcttcttaatagaatttagaggaaatatgctctgctgtctccctgctgctgtagagcagaagattgaggaggaaactgaggaggcaaaggggtaggatggaggggcttttgtagaactgactttcagtgaactggttttcttggaatttgacagagagccattttcaagtgaacactggtctttaaaagtgtttcttttagtgttggcaagttcaaaaaaatttccacctacacacacagaggaaaaggccatgtgaagacagagtagagaatgattcgaagatgctagccttgaagactagagcgacgcagccgcaacacaagcgatgccagcacccaccagaggttgggagaggcaaggaatggattctcccctacagcctctggagggagcacagccctgccaacatggcccagtgatactgatttcagatttctggcctccagcactgtcagataataaatttccattgttttaagccacctagtttgtggttatttttttacagcagacagccacgggaaactactacagcatctttgctggacaatacaaaccagggagctccaagtccagggctgccagaggctttgctaggcgagataggagtttctgcatttgggtacatcaaagggaaaaggccaaaacagactagctgtcatagatgtacttatgcacagccatgatgtcctttatttattttttaaaagacaaggtctctgtcacccaggccagagtgcagtggtacagtcatgtctcactgcaatctcaaactcctgggctcaagcaatcctcctgcctcagcttcttaagcagctgggactacaggcacataccaccatgcttggctaattaaaaaaattttttttcgtagaaatagggccgcactatgttgcccaggccagtcacgaactcctgggctcaagcaatctgcctgccttggcctccctgagtgctggaattacaggcgtgagccaccatgcctcaccacattttttagttaagccaaacagtacagccttctcattattgtccaacagaattagagcttttagttttatctgattttatttttttctaggaagataccattaatttatatttttaaaatgatgaaaataaatcatctgtgaaagaaataaatttccaaggcaataaaataaaatgcagacaaacttttagtaagattgtgttttgtgattacaacctccaaactggtttccccgcatgtactttggcctcttttctatccagtcttctcgacacagcttgtgtgatctctgaaaaccaaaatctgatcatgtcatgcatggaattcaagaaaattctaacctagcaattaaggggggagggggaacacaggcagatgggatccaagaggcgacaagggaggcttcagcaatacagataaggttctcattcaggggaaggtgttaggttcacgtgcattcgtttcattgttgtatttcagtgatacatatatgctgcaggaatcttttatgcatatcaaatatttacattattaacaaaaaatactttgatggcttcctaatgctcttaagataaaggcaaacatctttacacgatggctccaaagccttacgtggcctagccctgccatccttctcccttctgttggaccatgccccatctctctgtcccccagcctccctgagccttcttttcctccctctagattgccatgctccctcctgccacatacttgcccctctctctggattatttctcctcctttccactatcctatgatttgcccttcagatctcagggtagtcaacacttctggaggaagagcttgagctctaacccctaccccctcccatcgcatgatttcaagaccccctcctctcttttggagcatatttacacttgtaattttacatttcttcatgtggttttttggtaaatatctgtctctcttactacaagttccaagaagctagggctatacaagtgttttgctttcagcgtgctcaaaaatatttactgaaaaacgcaacatgcgcatttccctcaagagacagcccatagctttcagactcccagatagatctgtgtacccagaacgaaggttaagaggcactgctccaaagactttgttctttccactgttgtacttcaactctggcttatgtcttcctgacctggcccactgccctctccagcacttctgtctggagttctagtggacaatgggtatctcagaggagggctgaactttccaatatggaatacagtaaaaagttagaaactacaaagtgatgaatcccaacatggctgcctagccagtggactggacttctaccaaaacaatgactggggcactattatcctgactcatagacatagtgagagataacttatcaaaaacccctgcaagcgtcctgtcctgcttgttgcttagacaatgcctagtccagataacactggccaataagtagcatttggagactttgatttcctaatatgggatggagaccatgagttttaaaaacctacctcatccctcattgccaccctcaaggcttagatctcagagcctaacttttgcactcaactggttctctgctgggcagtaaacttctgcttagcatatcaatctttgatgccagagtctagattcttactttaacaaagaaagttcaaagaaggcaggaattgtgggcagaggtgggattctgcacgaaagtgaccctgatgatcacctttccctcctaagctgattaaaccaacacaaaacctcttccaaacaggaagatgtgtgaggaccccttaataataaagactgtctatcataaatcaacagccaatatcatatgtagaatggaacagttagacactaccactcaaacgagaaaaaggagggctaccattaccattgttattttccttaattctaagatgcactgctttttacatcctaacatttctgatattggaatatgaattacagtgtaagtatacatttaatatagtgccccccaaatctgttattaaatcaatagcaagtctttatgctcagtggtcttaaaacaaatatggtatttaacacatgttaaatatatatatttaatatcttttctacctatggaaattcttacatattctacattatgaaacaaaaataagagataaactattaaaaagaaaaatagattatttgcagatgatatcatcataaccctagttgattcaagaggatcaactgaaaaactcttagaaccaataccagtcaaggaatatggttgaatataagagaaacatataaaacacaatagcttctttatatgcatatgtatatatgcatctaaagtatatattctttatatagtaatatatacattactatagtaatatataagtataccttcttcatatagtaagtatatattctttatatactttaatgttttatttgctattaagaataccatattcttaatagcaaataaaacattaaattaaaaaaaagaagtatctaggactaaccctaagaaatgtgaagagcttacatgtggaaaattacaaaactctgctgaggaatatatgtcttaaatagaaggacataccagtctcaaatgtgatggcagaatactttatgaatactaattaatatcaaattaaataacgatttactgcaaatactatgaggttggggcagtaaggagtggatacctgacaaaatgattactctaaagttcagatgcaattaataggtcattggatgggaataaataaagttcaagtacaagaacaaacaaaacagttttttaaaaagaagacagctacgctaattaaaccaaggcagcactggtataaagcaagggtagagcttcagactaacagaaaagaaccacctccctccaaacagagcctagtatgtgcagaaatccaatgcatgatgaggaaccaaaaacagcagtgagaaaaagcgttattcaacagatggagctgggccaactgaatggctatttggaaaaaaaaaaagtctagagtctagccttatattaataagccaaaacaaattgcaaatgtattgacagactaagtgtaaaaaaattaaataaaaacaccaagaagcaggccggccgtggtggcttatgcctgtaatctcagcactttggaagtccgaggcaggtggatcacctgaggtcacgagtttgagaccagcctggccaacatggcgaaaccccgtctctactaaaaatacaaacattagccgggcgtggtggcaggtacttgtaatcccagctactagtggggcagaggcaggaggatcgcttgaacctgggaagcagaggttgcagtgagctgagattgtgccactgcactccagcctgggcaacagagtgagactccatctcaaaaaaaaagaggcagataatgttagtggcctacgctagaactatgcctccctttctgagagtgccctgattctgtccactttcctaagaaggccaggttccctccccagccccagaggaaggatgttaattaatctaatttaatccagtattgaggattctacttcttttgtcagtgatacatgtgatacatttgtggccagcaaaccacaaaaacaatctgtctggggctgtctgagaaaagggctcctcgctgggaataagtgatgtccagaggatagcaaggcagtgggctggaacaatgctgggttgctgaatcaaccatcatgggaactgttctgtctgtacgaaccaacacagcactgcctgaaagaccaaaatactcctgatgatgtctgagaggtgggctaacctgtgattttattggctttttaatagctttctataatttttaagttctttttaataataaagcatgtatcaccctcaaaataagaagaggaaggttaataagaacaacaacaaaaaaaacaaaactacttactgcatgaaccttcccttatgaagttcacagtctagtaatgggaacagacatgtaaataactgactagaacatgtaataaaaccacaatgggatgccgcttcacagctacagaatggctaaaataaaaaaagactcacaatacctaatgttggtgaggatatgaagcaaactagcatttttgtatactgtgggaacataaaatggtacgactaactattcgagaaaactgtaaggcagtttcttctaaggctagacccagcatttatactcctgggtacttacccaagaaaaatggccacaaaaagacttgtacaagaatgtccatagaaccaggggctggaggatgggggaaaagaggagttgttaatgaatatagttttagatctgcaagatgaaaaagttctggagatttgttgcacaacaatgtgactatacctaacactactgaactatacacttaaaaatggtttacgggccaggcgcggtggctcatgcctgtaatcccagcactttgggaggccaaggcgggtggaccacaaggtcaggagttcaagaccagcctggccaaggtgatgaaactccgtctctattaaaaatacaaacattagctgggcatggtggtgggtgcctgtaatcccagctacttgggaggctaaggcagagaattgcttgaacctgggaggtggaggttgcagggagccaagatcgtgccactgcactccagcctgggtaacagagcaaggctccgtctcaaaaaaaaaaacaaacaatggtttaagatggtaaattttatgttgtgtattttactacaataaaaaacaggaaaaaaaactgttcatagagctttattcttcttaatagccccaaactggaataacccaaatgtcaatcaactaatgaataaataacttgatgcatattcacacaatggatactgacacatgcaacatggttgatcctcactgaaagaagccacaaacaaaagcacatactgacatgaaattttagaacaggcaaaactaatctaatctatagtgatagatatcagacatcaatagtgttggcctttgggggtagtggtgactaccacaggggagctttctgaggtaatgaaaatgttttatttcttgatttggatagttaaatggatatatttttgttaaaatacattgaaaggtacacataaaatctgtgcacagagatacacatagttatgctcccatgaaaaaaatcttagggaaatagtgaggaagaggaactggaagaggctgaatttgtcatcttggctacatgctgaaaagctgttgccaagcacgagtgcctctttaaaccagacagccacacataaatatcttttcatgcagcaatttatggaaacgctaagaacactaaaattatgattatctatatatgtgaatcttagttttgtcaagcaagctgttcgctattctgataaattatttaaaaagaaaaaatataagtacagtaatataaacatccttaaaacaaaacatagacctttaattaaaactgattttatttaaaatattacactattttcatcaaatatcttattaaaatctgaaataaaactgaatgctagctttttaaaagtcatatgtaaaaatgcaaaccataaaaaaaactagaatatagaataaggaaaaaaacctttttatgctcacaagcaaaagaaatcaaaaagaataaaatttgtctaaaaaagaatgaaaaatagatttgtatttttaatgataaagccaaaattagatggcaaacaataaactaaaaagaattaactgcaaataaaattgtttgctttttaccatgaggataaactcatgtttttcagaatatttgtatattttaaaaatcacttaaacacaataagtgaatagacaaaacattaaccaaaaatttaaaaagtagaaataaaaatggctcagtatgggtaaaaagggctcaaacaattataataaaaaatgcaaattaaaatgagatgctatttcaaatttagctaagattttccttttttagtaaaatactcagttctggagaggagggtagggtgagggagaggcacagtaagtactcaggcattgctgatggcagtggaaactggtattcacttcttaggaagcaaatcaggactaagcactacaacagagtactgcagctaggctgaaactgccgcttggatgtttggagtaagagcggggttaaataataaccctgtcatttcaagtctctatttgtaggagaagtacttttttgttgttgtcaaaagaaagaaaggggtattttttccctttcttcatgtgttgaggtgtgggtgtggcgtggctagggttcccacagataaggcataacatgtaaccaggaagatggatgtgctctgcaggggcctgaggatgtgggtttaggccctccctgggagagggctgaagacagatgcttgagcagcctatgtcctgaaaagcagagtgggctctgagccactgattccccacctggctctgccacatatcctgcggcagagcgtggctgcgtttgggtgaagaccaaacaaaggcgatgagatgcagtatgttatatttactagctatggctgtaaaaacctgaggaaagggcagggacaagacctgtatcaggctgttagatagctctacttctggagggcaagatggactagatgcagagtagtcttatttctgttcttgagtgttttggtacttaaaaagaaaaaagttttaaagttgacaacccttggtccccaaactccagtccaagagtgagttgctatttataaaggactaagaacagtgcctgtcaccttgtaagtgcttaaataaatgttttaaaaataaatactccaaggaaagggccccaaaatatggagaaggccttaatatacaacctatcaaagttcagaaaagtttgagaggagtgaaacatcacacagggtagaatttccagctggaggctccttgggcctgacctctgcaggttcaaacacatatgggaagaggtgtgctaccttcctgggatgccatggtactcaagtttcagatctttacagtgagaagtgtatctatcatgcagactggaatgttcatcaacataatgccagtgttttcttcctgtgggaagatttccattcattcatttaataaacatttactgaacatatactatatgccagtatgaggcactgtcctaggcctcaaggtagttttgttttgctttgatcaaagaaaattcctttccacattgttctcatgaagctaatgaaagacagtcaatgaggagagacaggcaataaataaacaaataaatatacaatgtcagttatgagtgctatgaagacaaataatactagctaagggtaggagataaggaatacaaagcaaaggacactctgtcctcaaggggctctccgtctagtggagacatgaccaataaacagataattatcaaacagaaataacatctacaagggggttgtgctcaggtgtttatgggagcagagagaagggatgcctagctcattaaggaaggtgtcaaggaaggcttctgggagaagcatgacctgaatctagaaggatcagccagatgaagcaatggggaagggcaacccaaacagcagatgcaaaggtacagaaaggacggagagcacataatggatgccacagtgggagtcaaagtttgatggacaaacacaacccactggattcattccagttggaaggctctagaaggaccccaaagaagtgagataagagcacacatgtaagcacacatgtgtgcatacacacacccctgcagtagtcatgtgctgtttctgcctgcctaggacctctgaacttccccatcccataaggttatggacgggcagtttacttcctcatcccaagagtgagcctatgatgtagacctctccaattgtggtctccctatttccttgtcagcaatggttaatttacaacgctaaaagacagccatcaggtcataggcttggggttgctgacagggagctttttcagtatgcatagagaaagcagcaagaaggccgggcacagtagctcatgcctgtaatcccagcactttgggaggctgaggcgggtggatcacctgaggtcaggagttcaagaccagcctggccaacatagtgaaaccccatttctactaaaaatacaaaaattagccgggggtagtgacgggctcctgtaatcctagctacccgggaggctgaggcaggagaatcacttgaacctgggaggtggaggttgccgccagccaagatcgtgccactgcactccagcctgggggcgacagagcaagacgagcaagactccatctcaaaaaaaaaaaaagaaaaagaaagcagcaagagagaatgaagtcaataaagaaaacggagccgaaaaaggaagggccaagaaagccctcatgacatcattttagccccaggatccagccatgcctgaagcttgcctttggactttctagttaaataatcaaagggaggaaaaaacctttttttgcttaagttaatttacactgggtttgtgccacttgcaagtagattaatatacagtccttttggagaagagcttcattctgtgtgcatgtggcaaggggtggtacagaaggaaagggaggctgatgtcagagggtctcacctattaagtctgataaagtctgataaagatggtgaaataggtagcttcaaggtaaccagagggtatagaagcagcaactagacctccttgggtggaggaactgaggggggtgtaagtcacagtctatatggatgggttatataaattttgtatgttcctaatagttcactatacaactacaagtcatctttaaacatctttaagacacagaatagctcatcaaaaataccaggaatatcatctgtttaaaactagtgtactattcctacaatgaatgcacatcaatcacaggtctttcccaaatatttaattttgagacaaacttaatattttgaactctttatccctgatgtcaaacaatcatccagtgttctccagaaaactcaagcagttgtacccattaaggtccaagtctaacagatgttatagcaaaacaaattgctctatctcaagagattactacagaagcccaaaagctcagattctgttgttcacatatttgagaactctaatcagttggtcacagataatactaccaatcttggtctgaaacagggcttcaaatctttaaatccatgaatcagaaaaatgctcatattacagtgtgttatagtataaaaatagctggcttaaggagcctgtgtgtaataagcactgggcctccttctggcagaaataacaatgcctcaggatttcttttttccacaagcattttccgaatacctactttgtgcccgtcatcccagcacagtgtacccatgagcctgtcctttttctctgggtgaaaaggccaaaccttggttcatatctggacaatgctgagtaaaaaatgtaaaataaaagataatgtatcattagacaatttgagatgttattcttgcagccaatcctggcccactaaactctgtctgggcctcctttcccccactgcaccaggtttacattgctgggatactagtcactgagaaagagcaagactcaaaccacatagcctgatgagcaagggcaagagcaagacttgctagacactgagaaagagcaagactcaaaccacacagctggcttcaagttccagctttgccgttaattaatgtcaggaccttagccaagattcacttctgcatctataaaatggggataatatttagtgcactcagttgttagagggatgaaataagttagtatatgtaaagtgctcaacaccgtgtcaggtacatagcaagtgctaaagagaagcgaaaggcctggcgcggtggctcatgcctgtaatcccatcactctgggaggcctaagtgcgcagatcacttgaggtcaggagttcgagaccagcctggccaacatggtgaaaccccatctctactaaaaatacaaaaattagccgggcataggccaggcacggtggctcatacctgtaatcccagcagtttgggaggccgaggcaggtggatcacctgaggtcaggagttcgagaccagcctggccaacatggtgaaaccctgtcttactaaaaatacaaaaattagccaggcatggtggcatgctcctgtaatcccagctactcgggaggctgaggagggagactcacttgaacccgggaggtagagtttgcagtgagctgagatcgcatcattgcactccagcctgcgcgatggagtgagactctgtctcaaaaaaaaaaaaaaaaaaaaattagccaggcatggtggtgcacatctgtgatcccagctactcgggataaaattgaaaaataataaaataaaatgagaagctataattaataaagtgagtttttttttttttgagatacagtttcgctgtcgtccaggctggggtgcaatggtggatattggctcactgcaacctccaccacctgggtttgagagattgtcctgcctcagcctcccaagtagctgggatcacagatgtgcaccatcatgctggtctaatttttgtatttttagtagagacggggtttcaccatgttggccaggctggtctcgaactcctgacctcacatgatccacctgcctcggcctcccaaagtgctgggattacaggcatgagccactgcacccggcctaaagtgagatcttcacctctttgcagttctagaatttaatgaagtgtacagcagagagattatggattttgagatttcccctccactaccacccccaagtctgcatatcatatctggcagaatagcaaacatctaaaatagcaaaaagttcccctgcttctcaagcagctgtaccaataggaaaccttcagcaagggagcaagtccaagctcctgggtactgggcccttactaataatagctagacacttcgaattctgacacctcgggcaaggtagatataattatcttcattttgtagataagcccaagtaggagtggagaggttaaataactcattcaatgtcaaacagctgcaaagtggcagacctgactccaaagttcatgtcccctttccactctatttccctttttcccatatagcaagcactaactgtttgtaaataacgaccaagatatttcaagagatctttaaaaggatgggaacaaggcttctctggtggagaaagaagttggcatcacaactgctgacagtttgacgcccctgccttctctgcccccaatgacccgctctagcaatcctgcctccctctctagcaacaagacactgtgtaggcctctgtttgcaagtctcctcccgtggcagcctagactctgctccctccgctaattgcatacttgggctcctccacacaacattcaaaatccaatgacaggtatccctttttggaaggcaagtttcccaaactctgataccaacacgaaacacctggggccggattaccctctagtggggcccccaaatcaagctaaacagagaaggaagaggaggtgacgcaactaggcctcctgcaccaggccagacaggctgagcgcggcggccgtgaccccgcagtgagctttccacagtggcctcctacgccttccctgtggaaggcacgccagggcggcgatgttatctctgggataaagggccggtcctaacgcagtttgtggtagaaggcgcagcaaaagcgcctaccgcggcgagtcccaggcagctcactctccagtcactctccgaggcgggggagccggcgagagggaaacaagggcctttggtacccagctgttgggcctttggtacccagctgctgggctccggctggcacgagcgccggagcatccgtgcgcagcctctgccgcccacactcgcgcacacacgggcgcgcacacacgcacaaaagtacaccggcccgggcgtccgcctcctggaaggctgccgagaccggccactgtgcccctaccagctgcgtccccacccagccctgcggccaccctcagtgccctgccggggcgcccccacgcttcctctaacatcaacgccagagactggagaggccgcatgggccgcgcgttccagcccaggcaggtgtagccgagaaggacagaggctcttaccgggtcttgcacttcctcgggacacggccggacacccggagactgccagtgcggccgcgaccctccccccaccctcccccaccacgtagccttctctaccttcagtcgggaatcaatggtctggtc

SEQ ID NO: 1512 - DNA, 24243 bp, Homo sapiens
  source 1..24243: mol_type = genomic DNA
ttctaagaattcagattcttgttttttttttatttatgaggaatgtatattgttaagtcactgttatcaagggacacataaaagcagaatcataaaactggactgcagccatcatcacagtacccgagtctatgcttgggggtcttcctcactctgctcttggagtcacaaccaagactccaaaaaaccaacgaagtcccttcaatgtgagtaaaggaaacagcttcaagcactgacaatttttacaagtgattattcaaggaatgcacagtagccacagttcagacaaatcaactacaaaaatcattaaaaagaagagtagggagggtcactgcttattaaaaacaaaagactggacaaagaaagtgaagataacagtgggcagaagctctgcctcctctgtcctgtgtgactcagaggggcatgggggcgcagggatgtgcgatctgacacggctcgtttccagcagatgcgtggaattcagggatgcctcgctctcttcctacaacagaaactgaatactacaggcttgctagataagatcttgggggtgagtgggggttctgatcttgtgagagcctgtgttcccagttaaagaagaggcagctggccagagctctgctggagaacctaatgcccaagatggaccagagaggccaaacaacctgaggactcagcaggtgacaaccctgtagcctgaagaggagaggggctgcgctgccttctgatgctgagaaccacagacctctctgccctggatgtgggtgccaagactgatttactgtgcccccagcagacccagagccagggagcaggcctcttccactccaggagacaggcgccacttccctaccagttccttgggatgctttggtgttctgcaaaggcatccttagtctatttttagaacttgcattttcttactttggtcaatttttggtcaaaagtacagagagcatagaataaaagcaaagatgtgaatgtctctaccagacagaggatgacctagtcagcagtttggagggaaatcatctgagggtgctggctcagcacgttcccagatgaaggtctgtcatctaaaggagagaggcaggctcagctcctgaaggtcgcagagcctcagtagtcctcctgagtgtgtctagctgactgttatcgagggacacgtaaaagcagcatcacaaaactggactgcagccatcaccacggcaccaagtctatgcttgggctcttccctgctctgctcttggagtcatgaccaacactctaaaagccaacaaagtcccttcaacatgagtaaaggaaacagtttcaagcactgacagtttttacgagtgactattcaaagaatgcacaggagccagagagccagactccacagagaggccaaaggctctgaacacacgagtcaatgttcatggaggtatagacaaaggattctacctcacagagtttgaagacaacctgccctttcacccacaactactgctttctatgtcaaccctataaagatcaggtctgcgccctgcccacgagcctacttctgaagccatctggaaaaatgaaagcacttggataaatggaaaagtatgcctgaattttaaatctgctcaattacaggttatctgtagcagttaagaatcaacatctatggcattctttaaaacactcctaatttacatgtgacttagtcaacttcccttggtgtcactgtcatgagagatattacaccgggtggaacagtgacgttaagccaacaggattttttgcccttattcttgctaagtcatgattatctgagcagagatgattttataccctctaggatttgtcccgttggctagggtgtacgcccagcattggcggggaaaatattcctaggaatgctttaggagaagaggcagctggaagcttggcaatattccaaggcatgcccgtgctccctgggaagtggtctgtgtcatcctgccgggtgaaacctctgctattgcttgagcagctcccttaacccagtctggctggttctagacttcccagctgccggagaaagtgatacacttccagggaagcagctttccttgccttgcccgccctgcagctggctaaagtgcaggatgggaggatggctgggcattatctgcaggctccaatcacacttccgtggcactgggaactgcagttttcaactcctacccttacaaatgtttcaccaaatcctttatgttcacctctttgccctctgagggggaaaaggagacattcagatcacaaggaaagaatctcagaagggaaagaggggaagtagaggggtctgcgtaatccacaaatgaaattatcagtccctgacatgatccagagttgactgaaacctaatcaagaccgcaagaggtcagtgtagcaaacacaaagggaaaggaaatggaaacaaatcaaaacaaaacttttaagaggaaatggaccgcaggtgctcagtgactatgtatgctttgggtagaaagaaaagataacttcttaggtttctgcctcttcacttgggggaaaaaaggggggcctggccagaccttgcctagcaatcccaaagaaagcaggataaatgggaacccaaagttttcagtatcaccaattatggcttaaaaagaaaaaaaaaggagaaaaaaaaatcccctgaccatgtgatgaggaatgctacgacctacctctctcacaccctagtatgacacaccctaatccatctgtcactggagcatactatactgggcagagataaaagttcttttcctcctggggtttgctaatccagttcccatagcccatatccttcaggccttttttgaagtagttcttggccgtctcgtagtcacgggcagctttcttggcctcaccataggagagtctcagtagatccctgcggtaacggaaggagcagagcttcttaaatagaagaaaaatgttctttttggagacccgggacaattcattccgtggcctagagaaacaaaagcactcattattcacctgggacctgtaagataaggagctcacagtggagacaccgtgggaggggaggcggctctcaagccctgagactgcagaggtatgatgcacccttgcaagtcagggcagaggcttggtcctcactgcgctctcctgtctccttacccatccacagtgcctctggtaccgtccaggatctccaggtcatagccatcagccagacaccagttgacgcttgtctccttagtcttcccggattgccttttggaatcatatatgctgactctgccaacctaggaatcccagaagcaacgggagaaagatggaaacctttcaggaataagattctgaagcagggactcaagactcataggagagaggaagtgtggggtcatgatctttcccctgtatttagggttctgtttggctaagactgagcaccctctagacatactaactccacctcgattcagattaattccagactaagagaagaaaagcccttggcatccaaaaggaagaaagtttaagttcttgggagaccaaccaatgttggtggtgggccactgtgggcaatgttcccttgtgggctaccactgtgggcaatgttccccttgcccacagtgtacatttttcctctgtttacatgactgcttgaaaaggaggaaaatgtcagggaaaatagaagggggttatagcaccttggggtggttgacaataaagggatgtcgtagtccatcctcaaatgcactcccatctcttgtcacacgacagcaaatagcacgggtcagatgcccttggctgaaaaggtaacctgagtacaaaaaagagaaacatatatacctgtgtttgcaccaaatgctgttaagaggcagaagcatgtggggattttggaggtacaagatatagttgtcaagaaagagaaacagctgccttgttaggaagcaccttctgactggggctaccaggatcttcctaccacagcagactggacactcaatcaattactgaggagtgaatcatgctcactttgataagggagacaaaacacctggcaataaagcatgcagtttgggatctgggcacaagaaggacagaccagttccagatcccaaggcaggccccttacccaatgtgacagatttgagataaatgggctgcaggaagtgggtcaacagtgccccttgcaggcccagcacgttccagcgtaggattttgtcactacaggacatggtacggagtctctccccgagccgaatgccatcccacgtaggcacaatgtcactggattccacagggattgtgccttctcctgtgtgagagacttgggtcagacccacaggcgccaatggaccaaaccactccctggcgtggtttctatcctccttaagcttgggccacaggctacattcattcattcttcacatatttcacagcccctgctatgcgccaggcactatgcttggtgctgggaaagaacggtgagcaaaaccaagtaagatctttgtgctcttaaaacatctatggtggtgaggagattgaaagggaagagaatagacactaaaccagtagccagtacatacggaagaattccagatgctgacagtgctctgaaggctctgaggcagctatgacggaggaccacaggggacacctcctgggacagcagcagcaggggagcccagacatggaggaggacagctggagtaagtgtttcaggcacacaggacaaaagcaaaggccccaaggcagccagcggattggctgttcaggcgcctgacagagagccagtgtggacagagcatatgcgagggatggggaaagtggcatgagaggaggccgggtgatcacagcaggttttgcttgtatatgcagtgcagtgggaaaccactatcgggtttaaaaaaaaacaaaaaaaaatgctttactgagatatagttcatatgccatacagttcacccatttaaagcatacaattcagtcatttttagtatattcacagagttctgcaactgtcaccacagtcaattttagaacatttcatcgctccaaaaagaaaccttctacccattggcgcagtcactcctcatctctccaactctcccactcctggccctggcaaccactcatctactttctgtctctatggatttgtctattctggacatttcatataaatggaatcatacaatatgtgatcttttgtgactggcttttttcatttggcatcaagttttcaagtgcatccatattgtaagcatgtatcagcacttcacttctttttatggccaaaataatattcaatttatggatatatttgatgttttatttatgaatccatcagctgatggacgtctgggttgtttccacttttttggctcttgtgagtaatgctgccatgaacattcacatattagtttccgtgtggacacagatctccatctctctgcagcatatacctaggagtggagcaccggctccatggtaactgtgtctatactttagggtatttagcaaggtttcaggaccaccatgatgactgctgacgtggcctgaacgcaatggagtggatgcgaagagacagtaaggagacaggagaggataggagagaaggagccagtggacaaggcagagtcaactgccagctagacaggaggggaccccagcatttggcatcctcatctgtcaactcctcagggcttggttgtgccgcactcttcatttcctccccgctttcttgaggtaatcctatgcattctcatggccatgaagaccctatagggggatgactcccatatttctatttccagccaagctccctcctctgagctccacatgggaacccccacctcctatttgacttggggatctcccagatctcccaaactaacacattcaaaatagaaccctgatcttaccacacagctccctgacccaggtcttccctttcctgtaaacagcacctctgtgcccagtgactaatggtaaaatcctagcagccttgtagagacttggggtccctggaccttgcagagccttttgaggaaaggaggcgggggcatgtatcactcaccgttctccaccttggtgcggagctttccttgtttgggattctcgaagacagggtagtggcgggattctgtgctttccatagcacggtcgctgcaggacttgtcaaagagggcgccatctccacacggagcagtgctgaaaaacaggggtggctgttaaaactcacctgtgggaaatctgcaatttcgtggggctccaaaacagtcagatgtgacagaagcaagggatgttttctaaggcctaccatgggagactggaggtggacagcagtacatgtgagtcatctacacctgaatatggacctcaaacccacagtggagtgtggcttattgtatcaggttcgatttacaggccaggagagcatttggatacccaattctaacagcctggcagggcccaccctggcagcaacaggaactgtacagacctgatatacagatggaatgacacagtcttttttatttggagcttttctcctcccttagcaggttcaaatatactatccttcgcagtctgggagttgtatttcattaactcactgtagagaaacctacaaaaagaaagtctggttaggaaggcaggttcaattctgggaaaagcagttgtttctataatctgacctccaaatgagaaagtaaggaaaagtctcaatgttgcagacgtttcacagtttatcaggtggaaattctccaggggagacctcagcatttcataaagcatagttagccttttgggtctccttcatttctgctgagggctcctcgctatggcggctacagggattctagagcagagcaaactgattcaaggactacaggaagctgttgctcctttctaagtctctcccttcataaattaaagaaaaggtgagctagaggagaaagctggcaggggcatcaaggttgtgtaggtcctcaaacggaaatggaaagctgcctcatcctcaaggccctgaggactaaaaggtcattttgtgtttttagaaaagaacatgaagcagcagagttagcagaaaaaaggacagcatttaaaaacaggccgagcagtgggaggcagctcagctcacagaggggatggattccatcagacaggttcaaatggacgggtgaaaagcaaaggctgccactgccacatcatgacccgtctgtctgagggggattcagaggccgtgtcagagccatgtggggcagggaactggagctctccacagccgggcagccgggccacagctctgacctcgctcacctgatgaagcctctccgggagattatttctgcatggcagtcattgacagtttctccttttaggctgagagaatctcctttcacacagcgattccctaggaaggtgtttaaaacagaaatagaataatggaaggaaaccgatggaaaacaggatgaaggctatttgttctgaaagcttcaaggcagaaacagcctcagtttctcagatcctagactcccatattctctcctctaggaactaagaactcattcctcactctgaattgactgtagctaaaatgaagtctcttctccctgccttggacttacatgcatggactccaggggaggatgagaggcacccgctttcaggcgccatgggaggcggcatgtctcagagcctcactcacctgttcccaagctgacgacgacacccatgtcctcagagtcttttttcataatgatggcggccagaatcttgcggccgagcaaggagggctggaagctgttagtcagagtgttgaagcaccggtggctcagcatggctatctggtcatggaaggtgctgccagtgagagggagctgtggggaaaagaggctgtgtcagcaccacaaagctgaggctgtgtccaccatattcaccgtgggcagggagatcaagctctacttgtcgtgtgagtcatcttttccttcttacatctagtgtcccagttactgctctctcgaggctaagagtaaagcctaggaataactcgcatgacagcaagagccacctccacttaggagttaggaggacccccccgccccaaaaaaggcaccaaaagtagacgtcttaactgtctttggctgtgcttctggggaccttgagaggaggagcatagttcttctgagactggcccctgtcactggggttacctctgtgaaacccatgcgttctgccttctcgttctccccaatcaagacacggagagccgcatctgctgcttcctgcttgccttgcttcttgctgtgtgcgcagacggctgggaaccagcgacccccaacttttgcttggtaaacgaacctttgggatgagaaacagagaatgaagacaagtgccagaccctgacattgttccaaggaagggttagttttgctgaagatgtggccagtcttgcaaacatatggacccgtcaaacagaagctgtttctaaggcagcatttcctagattttggtcattcatgaatcaccacatgatttgtgccacatccaggtattacttggactattaattaatatttttctctaaattgacttcttagagccagccattgtggctcacacctgtaatcccagcaacttgaggagctaaggtgggagatcacttgaggccaggagttcaagaccagcctgggcaacatagtaatcccccaggcaacatagcgagacccctgtctcttaaaaaaaaaaaaaaaaatttagctgggcacggtggtctgtgcctatagtctcagctacttgggaggctggggtgagaggatcacttgagccctggaggtcaaggctgcagtgagctatgaccatatcactgcactccagcctgcgcgagacagcaagatccccatctctaaaataaacaaacagactctaaaaatgtaaatatccgtaatactaggtatgaaaaaagagataaaaatgtaaacacactgaaataggaaactttgtttcactactgtaaatggaaaaccagtatcacttgccacatattgaaggtggctgtaaaacagaatatgataaaatcatgttataaaattctgactagatactgttacctgcaaaggctctgagcctgtccttactataaaggaagattatgaagtatgaggaaggcttaacgaaatgctagcaccaacttggactctcttcttaagcagaaatcagaagggactacctttctccccacaagtcactgttacttcatacactgtctgatttttaaagcgcccaactccattccctcatttacttcctattagctcaaggggacttgacctggagaggtcattaggtcaaggtcggccttaggccagggacccaggttttgctgggagttgtttttttgactcctggcaggcttaagctaactctggggtaaggaatggatcttgggcgcatgagctgcgctgacaataaagtgcccaagtggagcagggaggtggcttctaccgctccggctggtaatttccaaacacagagggaagagcatggtggagcaaaacagcttggaaatgtaccagacaaggcatcaagaatcctagctttcaaccagatcctaatctactggctgagaacccagctttggatactctaactgcatataacagaggcttcagtttcaagacttagcagctcaggcagtaaaaggaatcaacgtttatgttcaaccacatggagtttctcactgttccttgatgatccgaagcaactaaatgccttcactcttttctttgtccatgctggcaggcccgtgcaggccagtgggcttaagttcagaatgagagggacagtggcatgaaaagaagatggtgaaggcggtcaggagggacagattgtgtagtatctttacctcagggatccaggagaatttcatgactgccccatgtgtttgaaaagaatatgaactcttacgtgcaaagttttatactgatatatttacatatatgataaagtttgttaattatgcaactagaatcctttagagctgtgctatccaatatggtagccactagccaaatggggctattgccataagtgcctcctctcagcctctttgccagctctgcgcttctcccaccacaggatttaacagtgtccttcgcctagaaccctcagtctttctctcttcatcatccttaaagtctcagctcaggcagtacttcttggggaagcccttccccctctccttcctaagtcaaactgtgctataattgattctcgctgcaactccagccctttggaatacttatcaaatatgagatcttacatttctttaggtgactattggttaatgtttggttcctgttctaaaaaaaatagaagatactccataaataagtgttgagtaaataaagtataaagatcagttaggaggctattgtgacagtctagatgagacagtggcttggattagagtgctgacgctggaggtggaaagaagaggaagggatttgggatagaaattctaagtataaccaataggacttaaggatgagttgacgaaggaggtaaaggagatagaggaaaagatgatcctcaggtttctgacttgagccactgggtagacagtggtatcacttactaagctgggaaagacttgggggaaatgaagcgaagggggcaaaacccaagagttctgctttggacatgtcatattagggatgttaatccaaacagaggtgacaagtaagcaactagatggaggaatcgggagctctgagtggtctccagcatttagatattaaaggtcatggctgtcgcggtggttcatgcctgtaatcccagcactttgggaggctgaggcgggtggatcatctgaggtcaggagttgaagaccagcctggccaacatggtgaaactctgtctctactaaaaatacaaaaatagtcagatgtggtggcagatgcctgtaatcccagctactcgaggagctgaggcaagagaattgtttgaacccaggaggcggaggttgcagtgagctgagactgcgccactgcactccagcctgggtgacagagtgagactccatctccaaaaaaaaaaaaaaaaaaaaacagaaaagaagtcataaaattagttaacgtcaccagccacagtagacagaaaggaaaaaaagacccagcataattcacattaagaagcaactaaagtatattattgtacgagatagttaataaacgtagttactcaattagcatttcccctctctatgcaaccttcctcagctccctggcagacagtggcagcagtgtcctctgtgtccccacagcactctgcattcacctccaatggcacatttcaatactgctatggctatatgtctgctacacactcaggggcagcaattttttgtatcttccatctagttcatagtaagttcttacattctcaatgaatggctgacttgaagtcctagaaaggatttcacagaagatttcacagaagagaaagaggaaatgcactgaacctatcatctgaaggactgtgcttaaagataaggaggtgcttattgagatgaaggatatgaattagtagaagagcagctggagggagactgggcctctccttttccagatggcttaaacagtgggcagatgtgtgttctaaattgggtcatgttgggcaaagggctacttttaaaaattatgttaaaagttcttacatatccatgagagtaacaatctgaaagaaaactggaaaaggacaagaacaggtggttcacagaaaaggaaatgcaaataacacataaatatgaataaatgaaatgccattacttctgatttttttgtttttttttttgagacggagtctcactccatcacccaggctggagtgcagtggcacaatctcaggtcactgcaacttccgcctcctgggttcaagtaattctcctgctcagcctccggagtagctggcatacaggggcataccaccatgctcagctattttttgtatttttagtagagatggggttttaccatgttggccaggctggtctcaaattactgagctcaaatgatccacccacctcggcctcccaaagtgctgggattataggcgtaagccactgcgcccggctgacattacttctattaaggagagacaaatttaaagtaacaagatagcatttttataagcttttttccttaatgactttaaaatggacaagttggatgccaaacatgtgaaaattcaaacagttaagagtgtacaataaaagtgtccctccttccccagaagcaaacacagttgccagttttttcgatccttcaagaaaatattctagacatatacagacaatcttcacctctcccctcactttacaccttgcttttccactttgtgatagaccttagagattaagaaaacatgccggttgcatggcaagagtgatgccatcttgatgcaaaaccactatgaccaccaatatctgactcccgcatcccaaagtgttgggtagcataaataattccacacaaagatgtctaccaagcctccccaccagctagtgctcataagtttcacaagaaagtataatgtgtgaccagctgcatgtttaaccaaaaaagcctctatagaaagcatactttctggagggtaagtgcagggatccaccatcttgcagccacccaagacatcatttctgttcctaagtccctattaaatgtttacttctgagaaactgaatttgtcagcttctattcaatgaaatactatgcagctatgcaagaagtctggtaagtaaaggagtcaacgtataaaacagaagatatacttgtttaaaaagacaaaagggaaaatgtgctagttatgcacagcaatttctagaaggactcaagaaactggtatagtcatgtactgcataacagtgttttgttcaatgataaatcacacatatgacaggggccccgtaagattatgatggagctgaaaaattcttatcaccaagtgcagggctctgtaacctgttaggaacctgggcacacaggaagaggtgagtggcgagcaagaaagcattctggtccgagctccgcctcctgtgggatcagcagcagcatgagattcttgtaggagtgtgaactcgactgtgaactgtgaatgcgagggatctaggctacacgctccttatgtgtttactatatttttatcattatttcagcgtatactccttctacttctagaaaaataagtaactaaaaaaagcctcaggcaggtattccagaaagcactgttaccataggagatgacggcccccatgcatgttattgcccctgaacaccttacagtgggacaagacgtggaggtggaagacagtgatactgaggatcctgaccctgtgtaggcctaggctaacagctaatgtattttcatcttagctttcaacaaaaaagtttaaaaagttaaaaaaataaaaaaatttacaaacagaaaaaagactatagaattaaggatataaacaaaggaaatatttttggatagcagtacaacatgtttgtgttttaagctaagtattattacaaaaggaacaaaaaataaaaaagttaataaagtaaaaaataaagtaaaaataaagtaaaaaagttacagtaagctaaggttaatttattaaagaaaaatattttaaataaatgtagttagcctaagtgaacagtgtttacaaagcctacattagtgtacagtcatgtcctaggccctcatattcattctccactcactggctgactcacccacagcaacttctagtcctgcaagctccattcatggcaggcgccctatacaggtgtagtatttttttaatcctttatgctgtctttttactgtatctttttgctgtttagatagacaccaatacttaccagtgtgttgcagctgcccacagtattcactacagttacatgctgtacaggtttgtagcctaggagcaaccggccataccatacagcctgtacgtgtgtaggagcccatgccatctaggtttatgtaaatacacactgatgttctcacaacaacaaaaccatgcttctcagaccgcatcccagttgctaatgcagggctatagtaatatatgggtctagggagggaaactagaagtctgagacggaaatgagacttttcattgaaatgactactttttcaatcagcttgaatgatttttttcaagatggagtcttgctctgttgctcaggctggagtgcagtggtgcgatctcagctcactgcaacctccgcctcccagcttcaatcaattctcctgtctgcctcccgagtagctgggattacaggcacccgctgccacgcccagctaatttttgtatttttagtagagacagggtttcctcatatggtccggctggtcttgaactcccgacctcaggtaatctacctgcctcaacttcccaaagtgctgggattacaggcgtgagccaccatgtctggcctgaatgattttttaatgtacctatacatttctttaaaaattaaaactagtcaaaaaattaaaaaggatcatgcttactggaagagtgaacgcattcactcttggcaggtctattgtcttctaagaggccgtggagacagggctggacttgtttccctcaactcgccccttctgtcctacacagctaaagcacacccttgttttccctgggttacagaccatccccaactggtgacacatgcattagccaggactaggacactcacttgggctcgtgaggaggtccggactggtcgaccaacttgaattcagcagcaaagccatgggagcgggcgtactccaaaaggccacccacagggttggtgttcaggtatctcacgagctcgccaatcttcctgaccttgttgggcatcatggattccaagttatcaagtgactctgagatcataccttcaggctaaaggagaatccatcaaacagaggagccataaacacttcaggaaatgttgagggagtcactggcaatcttaaaccactcagttgctaaaaatgacctgtatcttttgagtaggaaaacgccctacctggttatcagaagccatggagttggtcgcctccccatgcagggccttcatggcttcctctgcggccatctgctttgccactttcttgctgggagcactcacactggggaaagtttgggctcccactgcaacacagtattggaacctgacaggagatgaagcacgtagaaggattaaaatggttttgactgaggagcctgacctagcctctgccaggctgccatcctccactactggtaatttccttgaacacatcacctctgtgcagtcacatctcatgcagtcacttctgccttgaacagccagtgtctcttagcctggctgacccctttcaacatttaagcatcaacctagtttcacctcttccaggaacacttctcttgaacatgtgagtctatagacccacaggcagagagcttctcaggtcctgtacctttctgtcccaccaacagtgagtgacctccaagccgtgaacctccctagtgcttatagaggagatagagggtgggccaggaattccctttgaattcctaatccctaattgtctgcctcacaagcagcaaccaggacctcagagccctcctttccccattttgaaacaggagaaattggtcaatctgccatccctgaggaggcaaggaagaaaatgtgtctctttttctttctgagaaaacctcagctggacagaggacacgtaggacatacttgggttcatgggcagggccttctttggacaggagacggaattcgcaggagttccccaatttgtgcatacactcaagcagtgtggtgacggggctcttcccagaaaagaaggatgtggctgaaggggtgggggtctgggactctgcagtctagagaaaatgagagacaagaagaaaacaaaactaagaaaacactggttagtccatcacagaagaagggatggggatgggggactttattcccaccacctgtcaaggggttggcttcccaaagttaaaggggctgctggagctctcattccgcatcttccaagagaggagattggcctcaataaactttcaggtctctttcaagtccgaaattctgtaaatccaattatgttgggacaggagcagacagaggagctgggtatgagaggaggaaaggtgggctggcgagatagggtagagggaagagtgggaagctgactccgagatggtgtcagttgtttaggctgggattgcctcaagggagtcagttacaatccagacactgacagggaactgatcctcccagatggcaggaggacacctaccttctctgattctttctctgtggaatagtgggatgattcttctgattttccactgtccttggctttggcttcctctagcagaattgtcatggctttcatagctgcatcctgcttggccactttcttgcttccagcttcagctgggggaaactctcggccattgatgacaacctggaatttaaatcttgacggaaagtgattagatgtgtgaacaggagtctaggtcactccttctgccttctccaaagagaccttcaacctggaattttctgctacgctaaggggcttttcacttgtggagatgaagggtaggccaaggaactccttcctactccttaaggctcagcctgtcctttctttttgtaaacaaagcagccagtgactctttccccatagctcagtgaagcaaacataggcacagatgataggaaactagctcaggggaaacccactatctctttaacaatgaattaagataaaacccacacacacaaaaatgatgagccaaaaattaccattatagtcttgtgagcaaccaaaagaccttcattctaaagcaattgtggtagactggcctcctcaagggagggtcctaaaagatagtgaaggcttcttataacccagtctcacactccccactacctagggggatcaggcatctgccacttatcagtggcctgcttttgtccctagacctatatcaccgtagtttgttatgagtcactctatagcaccatttgtctccagctattttctacataacaaggaatttccccttgttatgtagaaaataaaaaagcatttgttctaggcctctggacttagcctaggccccctttgttcaagctttcaaatgtggtgagctctttgctcagtctgggatttcatttagaaaagtaggtcaaatttcttatttcctaggtcttctgatatatttgaacatggcaccaatgtttcttttagtgtgagtccaaagaatgactaaccacaaaatccactgctttcctccaactctggggaggagggatggaggcaaaagagaatgacggccatccagtctctaccccaaacaatccagctctggccttgccagcttttggacagacacaactccttttcttaaccgctctcctgaaatgccaaattggtgtcatgaagacagtcaagacaaggaataagggccctagccaggaatctacacccctagaaaccaggctaggtaaacataaaggtcagtggaattctcccccatcctactggctctttccctggctgcagctgcagccactcagcttcagtggttttgctctctgttatgcccttcagaagctcctgttttcctcaatctgtccactggcctattaggacctacagtgcagggcctgaccagctatctgagtgaggtaaaggctgacttcacagctcaggagtggcagcaagtgctagcctacccatctgtgcagaggaggtttataaaattagaaccaccaccttcaacaggcaggcagccgtgcacacgctcctccatcctttccccccaggagctatgcagaggggggattgtggacctgctgctgcttagcagcacaacccacccccactgtgtatgcagcctgccccaacccacctgctcctgcacctctctcagaaaacggcttagggaggaggggaaggcctacagaagggaattaagtcttcattacctctgccttaggaggcaggcatgatattgatgcatggagatcaatcatgtttttcttttttctttctttttccaagatggagtctcactctgtcgcccaggctggagtgcagtggcgccaatctcggctcactacaacctccacctcctgggttcaagtgattctcctgcctcagcctcccgagtagctgggattacaggcaagcaccaccacccccagctaatttttgtatttttagtagagatggggtttcaccatgttggccaggctggtctcgaattcctcacctcatgatctgcctgccttggcctcccaaagtgctgggattacagtcgtaagccaccgccccggcccccaagaccaatcatttctttcttttttttttttgagatggagtcttgctctgtggcccaggctggagtgcagtggcgcaatctcagttcactgcaacctctgcctcctgggttcaagtgattctcctgtctcagcttcctgagtagctgggactacaggtgcacgccaccacgcccagctaatttttgtatttttagtagagacagggtttcaccatgttggccaggctggtctcaaactcctgacctcgtgatatgcctgcctcggcctcaaaaagtgctgggattacaggcatgagccaccgcgtacggccaaaaccaatcatttctaaagaagcttcattacagccaacagagtcaacctcccccttgttcagccaagattctggctggtccaaggtctatattccctgctcaatatctggagaaagggccaatcaaggggaatttagctaaaaggcagaagggaaggaggaaaagataggcgccaccaaacagcactgctcacaaatcagccaagactgcgtcaggagcaaaagcacctgaccccaaccctaggtacagttcctgggtggtctcttaccgaggttcatggggtggtccactctgctctatcatgttgaactcacaggtttgactagcgaactgggcatattctaacagcccgctgatggggttcttcagctggcactctgtcagtttcttgtagggtgaacaccgtggcaagccatgactgtagaaggagggcatctccatgatggctcgaaactcacctggtgctgcgcggatactattcaagtcatctgggatgtcatctgtggcccactggccattttcaaagtcaacataccctgcttttgaggggccattgtaatgaacaggtggtttcagtcttgctggttctggtctggcctcttgcctgttttctaactttatgacaggttcctgcccattctccactttttctgtggttaccatgttatttgaggcatttgatgtgggtatattacaggtgaggaactctgcgtttcttttggtctcagggattgcagctggagcggtttcaggaacactgttcgtatttctcttgatttgcatcctctctcgcttcttgtctgtcaaatgccatatgggaggggttgtcccttgtctatagacatccccctgcctttccatgtcaattagcacagcatttatatctcgggccttggtaaggccaatatttttagccaaattcagggcagaggagtcagacacattgaagagatagtcgcagattttctccttgatctcggccatgtctaaaaactcaagaggatcttccaaggcagatgtggagttgctgtcttcaggttccaaacctgggtctgagtttggggatccttggctatgactgtctggtcttaccactccgctgtgctggttccaagcctgagctgagactgcaataaaaggctcaagaagatcttctgagacagatgtggagtttctgtcttccggttccaaactcgggtctgagtttggggctccttggctatgaccgtctggtcttaccactccgctgtgctggttccaagcctgagtggagaccgcgattttccacaaagggggtgttcctgcctctttctgtagcttgcccttctttgccagggagtataaaactcgattgatttctttcttcggagtcccaagtttcccagacagatcatgtgctgtggtggccttcccttccccaagctcttccaggaactttaagatcctttgttcctgatcttggtagatactcagttcctggaaatgtgaggaaaggcaatcaacacctctctgtggcagactcctgccacgtggtgaaggatgctggaaccctctctggagcccctgacttctgagatgcacgcccctggggacacccctgatgtccacttgcctgcctctggtactggaggcaagtagtactggaaaccttggccggagtcctgggagggaaggtggcagtgacggtgtctgctttccaatcaccggtgcttctgggagctgccccttgagaaattctatttgcttaagcaggaaactactgggggaagatcctggcccaggctgctggtacctgagctgtctgtgctcatagccttgaaatggatgggtgtagtatccgctgagggaatacccctgcagaataagacagtggaaaaagaaaatgaattagggctgcagtggtgaacctgtggaggcccctccctttgctgcctgtggaacagcccttgaagggctgagaaggcaattgagccatgggcttatgacttggctagggtgacttgcctacctcctaaatcctgcctaggggcctgccaacaggaacacagagaggggagcaggaggcaaagcacgcagaacttccaggaatacagaggttctgaggcctcagcatagcctctccagcaacctaacttacttttccctttgacagaatttaagggagttgagaaggtaattttctagttaccaaaacaattacccctttaaaatcagaacaacaaatatatgttattgttttgaaaacaaaaacagaataacctgaaataaccagaacaatcacatgaaataacaataaccaagggagatgggactagggaagggacgagatgacctctccttaagtcaggctcaccagtgcaccccttgcccacctgtctctaagatctatcgtttagatgactatgacaaaagaagaaatgtgattggatgaaactgaaccccagtcctccaaggctgtaacagcgcagtaacgaaaacaatctccaggtgggaaaaggccacgggacctcagagtcatctctgtggctcttcactgccatcccaggaggatcagaatttggtcttcagggagctggagggtttcctgataaaaatggcacactgtcctcactcttcagtgtggtacccaggctcagaagggatgccagagacttttgcccaaaccacccaggctctcctggatgtgtggagctggcagcatctgctcctcaccacctcagaccagtcctaccttccctagctacttccccatagctgcttccactgcacgttcttctgaaccctgacggacagggcacaagcaaccccatgttctcatatgcacatttaccagaacaccaagcacctgtgacccctttccccacccacccacctgcaaaccagtactgtcttctccccagggctgttcactggagggtgatggagccaggaagtacttataagcctgggggtgtcagtaaacaccttgcttcctttccctggggcttgtagactgggaggagggattctgacaacatttactcacactcaccgccccctcctcagactctcctggaggctgcacaggtagaggtgggaccctttcttccataactctagccttctactcttccacatcctgacacacttaggggatttcagcattcttgtcaatcactctcatggtgtcctggctacaaggatccttaacccagtgatctccatccctacctttctgccacacaattggcttgtctagctactccttcaatctcactatgactctaacctaggccatcacaccaagacctcaaatcctgcaactcttttccagtggctgataaactttttctataaagggccagacagctctgccactgtagcacaaaaacagcctcacacaatatgcaaaactttatttacaattcatttaccatgaagctttatttataaaaacaggtagtttgtacctgtgggccatagtttcttgactcctgctcttttctgatggtgacttccctgtgtttctacaacttcactccttactctggtggaacctgctcctcgcatgaccccggtgaagctgccagtaagccaccctgattcttccccactctgacttcacacacctcctcaccccacctggatctcatggtcagttcccttctccacccaaggcccactgtcccccttttcttctccaaagcttcccagtggtactggagaaggaccttgacttgtgctaacagggtccataaaaattccttctcttgaacctcatttgggtcttcgctgtgtggtggtcaattgtgtttaacaaacatgccttagttcactgtggattgagtactcttcttttaaaaaattctcctcccagggtttggtgacacagcaaaggtctttcacctcttttttcttctttgtccctttttcccaccccttataattttttaatagctactgtattaacggatccaccctttatataatcagtctccaaggttttaaggacctcttcttcctttataatttatttcctaggttgctttaatcactgccccaacctaaactagccctctgaagcaagagcactcaaatctactatgtccagccactaccttgtgtgggagcttaagatctgaatttccaactatgtcgacagtctgtccacttaaatatcctgccataactcaaacagcacatattctgaaccaaattaatagttccctcaaactcagctccttctcctgtagttcttattgctaatggcatcactctcctcctagcctattaaggctagaaacctgcgtcatctttgctgcccgcctcctggcctcatctcctggatctcatcaggtagttgccaagtcccaccttgtctgccacctctgtactgtgtcttaaatgtgttttcttccagttccagcccctcattacctcttactgggccattgcaaaggcctataatctttctatccctctacatgccaatccaggtggcacatctccctccacagccacctatcacaactctgaccctttccttatagagctccttaaatgccacttgcttcaggagactcctgactcccaccttcttcagcccttggggtttcctctccttgagcttctcctactcagcacctgttaaaccatttactttccctcgtatcagagctactggattttttttttttttatggcacacacacattgcagtgtctgaaaggtaattaacattaggtgtcctataagttatactcaactctccactctcaatattcccaacacagtactgatgaggggcttcagttgattccatggtgagctcttgggggtcaaggactatgcttcaatcatctcaacctctctagcacttggcacaaagctgattctcaacaaacatttgttgaattaatgactgcatgaacaagacgccactatgcaagcaatcatttctttcttgttcctcttgctgcaccctcacgcccaccatattgctagggacagaggcaaatgtgtgtacagagtgagtgctggctcccagagctgaattatgggacttaggggttctcctattagctctttgagtgaccttgggaaaaaaaaattgtgtttcaaagtggctagagtcagttaaaagctaaatgttttttaaactgctactcttggcccaaatctggaaaatattttaatgtctgtctatagaagaattaaattatgaaacattcattctatggaatagtactcacacggttattttttttcttgtgagacggagtctcgctctgttgccaagctggagtgcagtggcatgatctcggctcactgcaatcaggctggagtgcagtgtgatctcagctcactgcaatctccgcctcccgggttcaagtgattctcctgcctcagcctccggagtagctgggattacaggcgcacgccaccacacccagctaatttttgtatttttagtagagatggggtttcaccatgctggccaggatggtgtcgatctcctgatccgccctcctcggcctcccaaagtgctg

SEQ ID NO: 1513 - DNA, 558120 bp, Homo sapiens
  source 1..558120: mol_type = genomic DNA
ggagaagagaaagcggtgatgcgaagagggggcgggaccagagagtggatggcagaggtgggctgtagagccaaagtggggtgggagcgcgaagatggcagctgctgaggaggagccgaagcccaaaaagctgaaggtggaggcgccgcaagcgctgaggtgagcgctgccggacttggggaggagggtgacggcgctgcaagcaagccagggcccacgtggggttgcacggccccgacgctgggtggtgtctctcactgccagcttggggccaacacgcaggacctcccccagctgcccgcttggccgcgaccccttgccagacgttctctccgtttggctgagtccccgcctgtctggtgcagctccggctccagcagcccttcgccagtcgtggcccgcagggggaccgagctggctgaccgcgccacctgcgagcaagcccaggctgggctggtgcgaccccggagggtcggaccggagcagcgtctgtaggcggccgccttctcttcccgggggatggcgggaaagaggctcggcaactgctgtacactggggcaaagtcagaattcttggggatttttcagagtgttgcggaagggcacgttgaccttccttttcgtgcacattctgaaagcccgtacctttgaggaccctctaccagggacccagacccctccgatgctttgcaggggcagcatttggatgaatggataggaaaggttgatttctcttttttatttacactttttggcagcaacggggacagtgctgcccctaacacctgcctcacatgtgattgatgttgcaacttttacttatgaagagtcatttgttaaaatatcccttcctaataagtataaagtgaagcaggcagtctttgatgatttggaaatgttcgctgaaaggcagcgatttttttttccatcttaaaatagacatatcaaactgatttaaaactattaggacactcctgattaaacaggacatatcccatttcttccagtatcactcttcttcacctccaaaggaaggaatcactcacaattgaaaagaaaaggacacttaggggcctggtggtgtgttcatgctgctttgaatggagggtgaacaaatccttgccagttcctttaatgtattcctactaccctcaaagggttagtgtgcctaccttataccaagaacataaactttaaaataaaaaccctcaggatattctatttttattttaaatattccaactatatgcagaataaaaagcaacggcttttgaatcagacctacctgagttcaaggcatgtgctttccctactctgccctttattagagtatttccttataaggcacctccttcgccaaactggaagacagatgcaacttttccctaccatcctactgaacatataacccttagatttccttagatttttccttaataaaaattattatatataatgctgatccattttcactgtgttttcctatttattatcttgttggacagttctgtgatcaaaggaaggcaagaattatgcctattttacaattgaagatattgaagcccaaataaaacaattagtacaggaacagaaataggaactagctgagcatgttttcttatacctgcagtcctggtgctttgtgaggctgtggtgagagcattccttaggcaactaaaattcactttatacaatatgaatttagtgccacctgtagacatgaagttaaaagattagacacttgagtactgggacaaatctctaattttgtggggagacattttaggatcggctattattacttttattatattaatttgctttcagactcaaagtgtgataatgcattgagtatttacactgaatttatgatgacttgcttgacaggggattgctactggttttggttaaggagaatggattataaagactttgcataatttaatgtgcagcatcagtgggaacaaataatgagatatatttgtagatgtcaggaaaaatatttagatttagggatttgtgagaatttggtcagctctgggataataattctccaccaggggaaattttgccctccaggggacatttggcgtggtctagaaagatatttttggtagggagagctattggcacctagtggatggaattcaggggtgctgctaaacatgctacataggacaacccccacaacaaagaattatctggccaaatacgtcaacggtgttgaggttgagaaatctgttctagagggagcatctgacaagactagtctgcctttctcaaatatctattatttttctaggctcggttgcttttcagcatataacagttgcttataaagaaagaatcaggctctgacatgttttcacgtgggattaggggaaagaagggaacgttaattgagtgctagacattatactatgtgctctatatatgttatctcttttaaccctcccagtgacctatgaggtaggagcaatgattcctgtgttacagacgagctattttgtgatgaaagaagtggagaaacatttttgggaactgctccctagatgaaggtgttccatgatgatcacttatatttaagacaacttagttttcttttctctcctttggaaatctcatccaagttcatttctttagcgatcgcctcttaagaggctacagtgccttccaaggcttgttgagcacgtgccaagtcttttccttcagtttgtctttcaagtacatgctattttagacatggtgttaaaaactggatatatatagagagagaaagaggtaaggcacaggtaccatcctcttggtgggaaataagtggggtttgggaaaatgacacctgagtattcttaaagatgactaggagttaaccagtcatctgtgactgtagggtatctgtgaagtagggtatctgccttataggaaagtttgtttggtggcagaactgggagagagctgcctcttggggaagtgcagatagtctgactgaagcagagatgtatggggtccaggctttgtattagacactctcacatgtgtcctttctatctctgtgcctctcagttctcagatcttaatttaatttaattttgtatatatttttgagttggagtctcactctggcgcacaggttggagtgcagtggcaccatctcggctcactgcaacctctgcctcctgggttcaagcaattctgctgcctccgcctcccaagtagctgggattacaggcgtacaccactatgcctggctaatttttgtatttttagtagagacgggattttgccatgttggctaggctggtcttgaacttctgacctcaagcgatccacctgcctcagcctcccaaagtgttgggattacaggtgtgagccaccgtgccctgccttcccagaccttaatttttactgtctgctgagtatgtgcttctgagtgactttctgacatttcgaagtcatatataccaaactaaattatctgttatcctgaatctgtgcatttttccatatttcctgcatctgttaatggcaccagtaacctcctttactccaaagtttgagacctagatatttgattcattttacatccacattataatgtctttccttttccattcctgctgccacaccttacgtttagactttatcttttgcttagattttgttttgacttcctaagcagtctctttaccttcagcctcaagttctgcctacttttctttaggcacagctctacttattcatcacggcaaatatttgtaaactctgaagttgatgttaggaaacgttgaatcctgaaagcccatatcattactccatctgacattagcaattaaggattattaaggatcatgacttttaatagtactaaaaaggaaacaaactacagttctctaatcagcaaatgctgagcttttctcaaatattgcttcctaactgtttcacttccatggaccccttttattattttcctctatctcctacctcactatggaccctgtgttctaaaattaaacctaggagctgggcatggtggctcacacctacattccagcactttgggaggccaaggtgggaggtttgcttgaacccagaagttcgagaccagtctgggcaacaaaatgagaccctcgaatctttaaaaaaaacgaaacaaaaactagctggacatggtggcataagcctgtggtcccagctacacaggaggctgaggcaggaggattccttggcttcccaaagtgctgggattacacgtgtgagccaccaagcctggccttaattaatgtttgttgcatagagtggcactgataactttcatttttctagaccctatatatatatttttttgtttgtttgtttttgtttttgagacagagtctcgctctgtcgcccaggctggagtgcagtggcacagtctcggctcactgcaagctccgcttcccgggttcatgccattctcctgcctcagcctctgagtagctgggactacaggcgcctgccatcacgcccggccaattttttgtatttttaatagagacggggtttagtagagacgtgttagccgggatggtcttgatcgcctgacctcgtgatccacccgcctcagcctcccaaagtgctggattacaggggtgagccaccgtgcccggcgaccctatacttttaataatgcagcctaaaattgagctttgctactattttcttttttcatcatgataatctactattgaaagagtttggttatttttggatgatattgcatgccttttacttatattcgcaaatttaatcctttaagattaaggctttgggctatgaaggaatggaaaacaaaagtcccctaatgcacttagtatgaatgccttaataagatcctttcctgggcaatatatactagtgcagcgtgagggtggtagagagagccagaggaaagcttgcatggatggttctgggtatccagggacaagcatggaagtgcttgaaactcagggaaagtgggaagggccttaggaaaacaaggggcattgaagactatgtttcttattttgggtacaggcctagactgaatattcagcctcaaataaaacatgaggctgatgtgctgcttttttttacctggaatatgtctttgctttacttccatcaattaaaatcctggccacatggtgtggctcatgcctgtaatcccagcactttgggaggccaaggtgggaggattgcttgaggccaggagttctagactggcctgggcaacatagtgagaccctagctctacaaaaataaacttagccaggcatggcagcaggttcctgttgtcccaaccactctggaagctgaggcactggcactactacattccagcctgggtaacagcaagactctgtctcaaaaaaagaaaacaaaatatctttcctgtgtccaaagtgtttacagttaggtgggggaaaaaaagtatcaaaattttaaagagcattctggtcagaatggatcccagtagagcagtggttaagagcatggtctctggcatcagctatctggtttgacccttgatccttattagctagtgatctcgggaagattggctacttgccccatacctcttttctcacctgtaaaatgggtatagtaatagtacgaacctcataaggatgttgagagggaaacgcagcaattaaaaatttaaaaaggaaaggaaaagatatagatatactcaagaacaagataaacatctccagggaccaagaacagaaaagaaacatgcagttagactctgggttcaggagctagtagaaataacatgtaggggacctagggtcagatgctctgtatgaaactgaagctgggctgagactggatgaaagagggctgaaaacatctgctcttggctgttgctttaaaaagctgtggacctggagtgaagatgcagaagtggctgagctgccagatggctcagagtcaggaactgtggtttccccactatcagctagtacaagagcaccaagcttggaggtcgtggactctggaagaggggtggcctatcacagaacccctgggaaaagagggaatgtctgagcctataaacacacgaggaagaccattacttagaaaattaacacagttaccaagagataaattcacaaaaaatctgatggaaatatgggtaatttcaaaacaattgtaagtattttaaagatccttaaaaaagataaaagaaataatggtcataaaaaaacatgaatcaaaaataggtagatatgaaatagatggctatattaaagaaaaaatggaattattgaaattaaaaaaaaaataggtcagttgaactctagaccagacaaatttgaagggaaaattaatgaattggaagaaagtacccagatgtatcacagagaaataaataggaattaacaaatatgagctgggcgtgatggctcatgccggtaattccagtactttgggaggccaaggcgggcagatcacctgaggttgggaatttgagaccagcctgaccaacatggagaaactccatctttactaaaaaaaaaaaaaaaaaaatacaaaattagctggatgtggtggtccatgcctataatcccagctactcaggaggctgaggcaggagaatctcttgaacccgggaagtggaggttggggtgagccgagatcgtgccattgcactccagcctgggcaacagcgcaactccataaattgagaggcaccaacttacatctaactgggagttccaaaaagaggaaataatgtgaatggtggagaagccaggttggaagagctgatggctgagaatttaccaaaatttaagaaagaccagttctcagcttgaaagggcattatatgtatctagtaagatggaaacaaaaatataaactaaaacttcagagattttcttgctaattatattaatgtatctattatagaaagactgaaaatttagacactccaaatttaatagtgggcatctttaggtggaagaattatgaggtttaaaaaaaaacttgtattttccaatgtttctacactgaacatattaggaatcttgcttttaagttggagagacttgaagtacactgaatatataagtggccaagtgctgtgtggctaaatattatctttacagaatggacctctgggataccaaatacctctgaaacttggtaacataattattatgactttattgtaggctataatcttttaagctatatttctgaaatcccaaagctctggaagctggaagttttttaaaaagtttgagatgaattaatttggcagcaaaatttgaactgatgtaaaggtgtcagtagtatttatttgtctgacacaaatgtatatgctttgctatggaaatattaggctgttaatgacatgccacatgaattcctcctgggtgttctacaaaatatatagtgcagtgttaccttcctaaaatccataaaattctgaattccaaaacataccctgccccaaggatttaagaaagggtttgtggacttttattacttatttatagtttacttttaaaagttggctactgtgcaggaacaataatttctcatcagagttagttcctagatttttttctctagtcactgttctgcacttctatgatactaagtagatgctcatttcaaagatactttttggctagctctactgtaataccagtacagttgatgtcactgagttattaggcttttcttcctctccagtagtaactgaaaagacagacttctcttcaacttttggacttgaagatttggaaggctgttttacaaaatggtctcccaaactgaagtttcacatactgcttgaagaagatacattctgatgatttatcaaagcagatttagagtttttgctctcatttatgtgtattatttctgatgttgtttgtacttttggcttcgtaccatttctttaaaaatttggttcatacacttcagatctagaagcaatgtgattagcctttgatataagaacatctgagtttctatttgcatttttactttcattgcatgcatgctgactttagtattttctttacaatttagaagatatatatgtatagcaattatgtaagaaattcttgccttctgtaggcacaacagtttggttactgtattaacatggtcttaaccattttgtcagcaagccacatttggttagtagtgagtcctgctattttactatgttacctgcaaacaggattgcagatgtgaaggtagcctgtgtgatcattggtcactcactgaattagggattatcagaaattatattgaagtggtcacttggctacttgccttctacatgcttaggctagactttggttcatacttagaaccattttgaaatctctgaaagactcagttgactcaacctaactggaaagtccatctaatttttttttttttgagatggagtcttgatctgtcacccaggctggagtgcggtggcacgatctcagctcactgcaacctccgcctcctgggttcaagcaactctcctgcctcagcctcccgagcagctgggattacaggcatgcaccaccatgcccagctactttttgtatttttagtagagacagggtttcacaatgttggccaggctggtctcaaatgcctgacctcaggtgatccacctgccttggcctcccaacgtgctgggattacaggtgtgagccacagcacctggcctaaagtccatctaaatatgactcaatctaggagttcaccgcttgtctctgttgtcctttagattcaatttatctctcacgtaggccatttcagtgtaacaagatggcagttctcaactccaagccaaaatctcatgagtccaaaggaagagagtttttctatatgcttgtatcagttttgagagaaatttggttctgcctgtgttacacactaccttgaaccagttgaggtaggaggtggggctcagacactggaccaaattgaggactagctaaaacagggacagagtggaatcagctttccgtaagtcacacctactaatgtgccatgtcagtttcccattgccacggcaacacccagaagttagcgtcccttttcatgacagtgtcctggaagttaccacccttttcctagaaatttctgcataatctgcctcttaatttgtatataattaaaattgggtataaatatgaccacagaactgcttctgagctgctactctgggcatactgcctatggggtagccctgctctgcaaggggcagtacctctgccgatgctttacactgctgcttcaataaaagttgctgacacaccactggctgacccttgaattttttcctggatgaagccaagcaccgtcctgggctaagccccagttctggggcttacctgccctgcattacaatcactgtatcagaggtggagatttgggctggccttggatacattctcactgtctgcccgtctgttgtgtgcgtgcatgcaggtaggggtgtgtgcgtgcatgcaggtaggggtgtgtgtgtgtgtgtgtgtgtgtgtgtatgtgtgtgtgtaggtagtactaggtatatggggagccagtgagtgtaggcattgttcgtatatggggggaaatggatgggtgttgatgggtacactgtaatcaacaactccgacaggaccttgtagagtaagggaggtagtgtcattccctcagcaagagaaaaatccattttagcatgtacaatatttattaaaacaaccttcctcttctccccttccaaaaaacccgacaacctcagtcttcaaggtctagccaaattctctcttctctataaaacttttctactcaccaaacctagaaatggtttctcctttgactgtttgtactttatactttgcgttattgcaatgtacagtatgtgcatgttttatctcacctattgctacttgaagttgggaaactagttgaataactcttagtgcctcataactgatcacttcattgcaatataacaggctctgaatttctgttgaatcaaggaattcctatttatttttttgagatgaagtctcgctctgctgcccagactggagttcagtggcatgatctcggctcactgcaacattcacctctcaggttcaagcaattctcctgcctcagcctcccgagtagctgggactacaagtgcacaccaccacacctggctaaatttgtgtatgtgtgtgtttttagtacagacggggtttcactgtgttagccagtatggtctcgatctcctgatctcgtgatctacctgcctcaacctcccaaagtgctgggattacaggcatgagtcaccgcgcctggcctatttattttaaaattttaattaattttttttttgtttttagagacagggtttcactatgttgcccatgctggtcttgcctatgcctgtcttgaactcctggcctcaagtgatcttccctctcagcctcccaaagtgctgggattacaggtgtgagcaaccattcctggcagaatcagggaattcttaacactttttttttttgttttttttgagatgagggggtcttgctgtgttgcctaggctggagtgcagtggtacaatcatggctcactgcagctttgacctcccaggctcaagcgatcctcctatctcagcctccagagtagctggaactacagggatgcaccactgtgcccagctaattaaagaaaaaattttcttttgtagaaacagggtctcactctattgcccaggctggtcttgaactcaagcagtcctcctgcctcggcctcctaaagtgctaggattacaagcctgagctgcatgcctggcctcttaaccctttaaagatttttttgtttgttttttagacagagtttcactcttgttgaccaggctggagtgtagtggcacgatcttggctcactgcaacccccgccttctggtttcaagcgattctcctgcctcagcctcccaagtacctggggttacaggtgcccgccaccacacctggctaaattttgtatttttagtagagacagggtttcaccatgttggccaggctggtctcgaactccagaccttgtgatccgcccaccttggcctcccaaagtgctgggattacaggcgtgagccactgggctcggctgcttgtagcatttaatggtgcaaaatggattcatgtgttgtctataaattcttaccaataatgggagttgatggagagaactattacctgaaaatacttcacgattctttggcctttcatttttttgttaaatggagtgagcttgtgtgcaaaatcaacctgatactaaaggataagaaaggtactcccgattgcatttcttttgtgtgtgtgtgtgtgtgtgtgtgtgtgtgtgtgtgtgtgtgagacagagtctcactgtgtcgcccaggctagagtgcagtggcatgatctcacctcactgcaacctccacctcccaggttcaagcaattctcctgcctcagcctcctgagtagctgggattacagtcatgcaccactgtgcccagctcatttttgtatttttgtgtttttaggtttcaccatgttggccaggctggtcttgaactcctaacctcaagtgatctgcctggcttggcctcccaaagttctgggattacaggtgtgagctaccacgcctgtccccagtttgcgtttctgttctttctggtgaccatagtgagctcgattataatagccatttattatatttgtctatggggaaaaattccctcagaataaatacacttctcctacgtgaacagtaacattttctttcttttttttttgagatgagtcttgctctgtcacccaggctggagtgcagtggcatgatctcggctcactgcagcctccaccttccgggttcaagcgattctcctgcctcagcctctgagtagctgggactacaggtgcccgctaccacacctggctaattttttgtatttttagtagagacggggtttcaccatgttagccaggatgttctcgatctcctgaccttgtgatccatccgcctcggcctcccaaagtgttgggattacaggcgcgagccactgtgcccggccaacagtaaccttttcttaaggtcccgtggttgatgtcttcactcattctttcttcttttaatatagtagaattgcgtatttgggggaggaatagagtttctgaaagagtgaatgtacaaagaagatcccagtgacctgttagaatgatgaatctcttttctctgtgttagcaagcctttaattagtaaggctgtttgcagtgtaattagaactgcacaagcatggaaggtcagtaatactgttcagaatttcataatgtactgtgtaacataacatactgtgaaatgaatccatagtaccacaaaatttgtttttaaagaagtttgtctctattgactcatctaggaggggtcacttaaaaacaaaatagggcaaaaaagtcaaattcagatgtcttaggttttctcaaattcctttaatctcgatatagcaaaagaaactgtttccttcttagccctagaatggcagtctgaaaaattatctaagtttttgaggaaacaaattgaaatacaagaaaattatttcctttacaaataaacagttctcttgtttgtctttgaacttaaccacatagagatttaaatagtttgttgttttataggcttgactgaggaagtcttctcctaaaatagaattttttaaaatagttttttctcagcccagctgagaccttagttatcatttttagttcttagttttgttgaagattgaagccattaagccgtagaagtgatgcagatttatgctgttgtctatatctgttctcacctactcaggatgaattgattataaaacattttatcataggatagcatgttgatgcatataaaacatagtgatgaaattctactttgtcttgttttacttattgcttgttcatccaaatgtattaaatttgattgtttaggtttgagatattataataaaacttggttacattattaaattcagtacatagtataaaatgtttattaaaaatagtattttaggctgggtatgttggctcatgcctgtaatcccagcactttgggaggctgaggcaggcagatcacttgaggtcaggagttcgagaccagcctggccaacatgttgaaaccctgtctctactaaaaatacaaaaattagctgggcatggtggtgggcgcctgtaatcccagctacttgggaggctgaggcaggataattgcttgaacctgggaggcagaggttgcagtgagcccagattgctccactgcaccacagcctgggcgacagagtgagactccatcttaaaaaaggaaaaatttgtcctttttttttgggaggggagtgtaggttcttctctacataatacattgacttccttaggggtattcatctctgtgtttgcatatcctaagggtgttctttagagaaatatatacatttctagacttatactcgtagattcttatctttgcctagtttcctctggaggacaagaatctcttctttagcactatttcccccatatttgtgtagcattcctacatttttcaaatgtaaaaaaacaccacatcagagacctttgacctcagttctctgtgaagtttcaataaactcgattcctgagaagacgtgttagtttcttgtagatatcaagtcaaactcaaagatctttaagtgttttctttgtttcccaagatgttgattctttactctcataaaacaggttaaagcaggctctctcagcctttctctttgagaaactactttcatatttccgaagactgcttgggaatgctggtgggagttgggataggagcagcggagggaggagatgcctaagagtgcctgttctcaggtagagttggaaatgttccctcctagagctgagatttcctgcaagacatcgagttggggtgtgaaagcagcagatttcagtatcagccagatgtggctttgaaatggtggttcacagtttcttgtgatttttgaaaactctgaacatattttagactttttagattattagtgcttgatgaggtacttaaaatcagagtctaatatttgggttgtacagttgagggtattaaagcccagagaggctaggtggtatcagtaaggtaacacagtaagttacagctactaagtatccaaggtgagatttgatcctgagtcttataacttaccgttgctctaggctctggaataagaaatgaagcatcaatttcctggggagcttttttttttaattaaatttaattttttttaagataagaataacatatttgaagaaaatgtcaagtactttcacttacattttcttattgatctccacaagaagacaaccaggcaatctgtctttagctgaggaaacagacccccgagaggttaagagtccctaagtagtaaacattcatctcacgttcaggacctctgactcatgtgtcttgctgtttatattatgtatgaagatagaaattgagaagctgtcagtaaattctgtatgtgctagataagcaccctgtttaaagaaattctgtggcaattgtcaattgtgttttataatcttgtctagacttgtgtctctcaagttttcttattcacacatatgtagttttatcccccccaaaataattattctcttgtgggatctacttagtggtatggtttgcaaatggattaactcattgaactggaatttttagtagattatattttcttttttctcatgtttctttgagacagagttgctctgttgcccaggctggagtgcagtggcctcctgggtacacttccacttcctgggttcaagtgattctcctgactcagcctcccaagtagctaggattaagggcatgcgccaccacacccagtgaatttttgtatttttagtagagacggggtttcactgtgttggcctggctggtcttgaagttccaaccttaggtgatctgcccgcctcggcctcccaaattgctgggattacaggcgtgagccaccatgcccggccagtagattgtattttctaatcaaaactttagacaaaccaattttgcttgtgtttaattaaaatgttctagttaagaacaatttattagtactattttttgagatggggtcttacttggttgcagaggctgtagtgcagttgaacaatcttagctcactgtaacattcacctccgggctcaagccatcctcccaccgcagcctcccaagtagctgggaccacaggcttgtgccaccacgcccaactaattttggtattttttgtagagatgaggttttgccatgtcacccaggctggtctgaaactcctggcctcaagtgttctgcccacgttggctactcaggaggctgaggtaggagaatcgcttgaacttggaaggtggaagttgcaataagccaagattgcgccactgcactccagcctgggtgacaaagtgagactccgtctcaaaaaaaaaaaaaaagaaaaaaaaaaaagaaatggttaaaataggaaaagtctcagttcctcttagctatttctgattgctacatgacttccatgaagctttttaagctttcactcagttctgaggtgtttatatgagcttgtgaggaacttctggttacaaactgtaatacctattggcttttagcatggtgcaaggaaaagagctttggattagggataaggacacctgagtcctattaaggtctctgtctggatttgtgaatgcacctgttaagtgagttgtatagactaaaatgttttccagactacatgagcctttttgagtattgcacaagtggtattttataaacgagaaatagaataaaaaatattgtgcattgagtacctaagaggtaagtattgctctgtgaatcattgtttcagttatatgtatagggtactgggttacaatgtaaaaaatgtatttttaattaaaaaaatataaatgtagaaaaatataatagagatgaggtctcactatgttgcccaggctggtcttgaactcctaagctcaagtgatcctcccgcctcagcctcccaaaatgttaggattacaggcgtgagccactgtgtctggccaaaaaatgtatttttcacacagtttggttttctattccaaaatttggtggcttaaaataactactttattagatgtcatgatttttggattaggaattcagacacagcttggcctgttgattctgttctatatggtgaataagatcacttggaggtgtttagctgacaacaggtctggtctggagggtccatcttatctttattcactcaccttatgccttagggtaactggaggcttggctcaactgggcttctcttagtgtagtttgagatcctctctgtggtttcttcagctgggtagttggacttctcacgtggcagctccaagagaccaaagcaggagctggcagccctctcaaaggctagcttagaatctggcatagcatcaccttcactatacactattggtcagaggagttccaggctagcccagatttaagagaagggaacatagacttcttgtctctaagatattgttcccattttaagtctgccacaattatgtaaaataatttagaaaaacatgactgaattatatatccaagcttttaattctgttattgccctttgaaggatgatcacttttaaagtgttttttcctccattgggaaatttgtctgcttttggtaaattttcatagttcaatttgagtatgtatattatttttccatggaatactgagggttttatgcttttgaagaaatgatttaaagtttaaaatttctttctctacattgatctgctggttttaattctttgaatagcacttatgatcatttgatgctgttcttttttgttacttgattattcatctttctctccttagaatgtaagttctaaaagggcagcacatgttcttgatctttgccaaatctgtagtgtctcctgtagtagaacagatgctcgataaatatttgttgagttaatgaatgaacaatttaaaagattgtgagctgggcgcggtggcttacgcctgtaatcccagcactttgggaggccgaggcgggcagatcatgaggtcaggagatcgagaccatcctgtctaacacagtgaaaccccatctctactaaaaatactaaaaaattagcggggcatggtggcatgcgctgtagttccagctacttgggagcctgaggcaggagaatggcatgaacccgggaggcggagcttgcagtgagccgagatcgcgccactgcactccagcctgggcgacagagcgagactgtctcaaaaaaaaaaaaaaagaaagaaagaaaaaaaagattgtgaagtatcatagatcagatctacgttgaaatgataaaaataaggaaaatctttttttagacggagtctctctgtgtcgcccaggctgtagtgcagtggcatgacctcggcccactgcaacctccacctcccgggttcaagcgattctcctgcctcagcctcctgaatagctggaattacaggcatgtgccaccacacccggctaatttgtgtatttttagtagtgatggggtttctccacgttggtcaggctggtctcaaactcctgacctcgtgatcctcccgccttgtccttccaaactgctgtgattacagacgtgagccaccgtgccttgccaaaataaggaaaatcttttagatagaaaatataggaccggtgtggtggctcatgcctgtaatcccagcactttgggaggctgaggcaggtggatcccttgagctcaggagtttgataccagcctgggcaacatcgtgagaccacatctctaccaaaaaattagctgggcatggtggcgtgcatatgtggtcccagccgctcaggaagctggggtgggaggattgctcgagcctgggaggcggaagttgcagtgaaccaagattgtgccagtacacttcagcctgcgtgacagtgggaccctgtcttaaaaaaaaaggaaaaagaaaatatatttcataaggttagcaacaagcttttgagaagggctattctttatttctgtgatgtactttctatatttttgtattaaaatcccttttctgttgtgaaatgatagtgatattcacttctatagtttaaaaatatgttctgtgcagcataaataattgataagcagtgttatcttgtactttcagattggagttgcctttgagagtcaaagatttgtagctcacagaaaataaagaagtactgtgtgggtgtgcctgggagggagttttgctaagaattcttactaaataaagttcaatcagtcaaatgttattgtactcttcaaattctccagggaaataaattgccagcttccatttaaagattgtattttgtttgaatatgtgatgttaaagtgaaatgtgacatataagaatctaaagatgattattaaaagcaaacaacataatagcattcttacaatgtcttttgcaggagagaattaatagatttagcagtgtttctttgaataaacttgtccataatgaaagctaactaaaattgcattaaaatttatcaactcctttaaaaaaattcaatatgttttgagatacaagtatgcacaagtattttctttcattgtctaataagaacttaaaggaacctgagatgtcacctataacaaactcctttgtgtttcagaaaaggaaactgatggtcaaagaggtaatgatttgtcaaaagtaataaagttattggtaagtccaggattcgaatcccttctcattcccaggcccctgacctttacatggctgcacactattttagggagacaagttttaagaagtttctctttttggatatgatatagattctttaaataatattattttactgatttttgaattcatattaaatgagggtttgtatttttaagtaacatgcagggaaaacattccacattcatgttatgacagctgggctcgtcaaggctttgcaaagctctaaaagtaggatacacacttttaacttttgtcaagttgtgatttaaaattaatcaaaaaaatcatgaggacaccttatttttgttattcctgtcttaaagaatctttatacatgaaaaaatgaaacatttataaaattagcccaatttgtctaaaaataagggtagttttgacggttgtgaatttctttttttaaaaaaactcaggaacaaggttatgattttaaaaatgcaagttttcaaaaagggcaggagtaagttttgtatttttaagccatttaaaaaagatagtaaggccgggcacggtggctcacgcctgtaatcctagcactttgggaggccgaggcaggcggatcacgaggtcaggagatcgagaccatcctggctaacacggtgaaaccctgtctctactaaaaatacaaaaaaaatttgccgggcgtggtggcgggcacctgtagtcccagctactcgggaggctgaggcaggagaatggcgtgaatctgggaggctgagcctgcagtgagccgagatcgcgccactgcactccagcctgggcgacagagcaagactccatctcaaaaaaaaaaaaaaaagaaaaaagatagttgatatttaataataattataaaaattataactataaaaccagtattagaaaattaatgatggatgaatgtaaataaagtaaaattatgcataatcctactttccagagataactaataacatttaggtgtatttctttccaatcatttttttctatgcatatatggtgtgtatttttttaaacacagtcaagttcatactctacttccttttgttttgcttttttcatttaacattatatcatgagcattttcttatgtccctaaaaagtctgtggaaacattttataatagttccataacattctgtaattatttaactattaccctatttctggttatttgggatataataaatttttgctattgttaataaggctgaaatgaataactgggtatacaaatctttatacacatttgtctctcttttaatgatagttgcctaaaagttggaattactgacacatattgccaaaattctttatagtagaaatgtactaatttatactcccattaattttatatgagagtgcttgttttatcgcacccttaacaaactggttgtgtttgaagagaactttgctattattttggggcttgaagcatttgttgaagagattagtggatgggtccacatttttggtatgctatttggaggcacttagctattttgggttatgtatctgattgcttttatagggccagaccacaagattagataaagtatatggaatatttacatatcagtcttacgaagagcaaactattcagacccacttatcttgattcagctattctaattgtaaaaagactactgaaggttaaaaatttcagttgactattttctcctaaagtaggataagctaggcttttaggaaaaaaatagggttgaaataaattgtttagaaaattgatcaaaagtagtagttactcagtactctctctctcagcgctcactctctttctgtctctctctgtctctctgtgtgtgtgtgtgtgtgtgtgtgtgtgtgtgtatttagaaaaagagtagaatggaaagattagaaatagagcatgaaaggctggggaagggaagttgctgtgaataacagaacttctgcctttacctgggaaaatatatctttacttttgtcgctacattattgactctgaaagatcacatgagtcctctttcttgaaataatatttttgtgtttgtaactgctgacacgactggtacttaaattttgagagaataaactttttgaaaatttttttgaccattaataaaaaacttttttttcatttcctacagtacatggattttctttttttttttttttttttaagacagggtcttgttctatctctcaggctagattgcagcggcgcaaacacagcttgctgtagccttgaactcttgggctcaagccatccttccatctgagcctcccaggtagctcggactacaggtgtgtggtctccctatgttgcccaagctggttttgaacccctaggctcaagtggtcttcctgccttggtctccctcagtgctgggattacaggtgtgagccattgcacctggctagacagctgattggctgggcgcggtggctcacctgtaatcccagcattttgggaggccgaggtgggcggatcacctgaggttgggagtttgagaccagcctgaccaacatggagaaaccccatctcttattaaaaatacaaaatcagccgggtatggtggcacatgcctataatcccagctgctagggaggttgaggcaggagaattacttgaacctgggaggcagaggttgcagtgagccgagatcgcgccattgcaccccagcctgggcaacaagagtgaaactccatctcaaaaaaaaaaaaaaaaaaaaagcggatcacgaggtcaggatatcaagaccatcctggccaacatggtgaaaccccatctctactaaaatacaaaaaatttgccaggcctggtggcgcacgcctaggggattgcttgaacccgggaggcagaggttgcagtgagccaagagtgcaccactgccctccagcttggtgacagagtgggactccatgtcaaaaaaaaaaaaaaaacggttagatgcaaatatcaaaaatgagttaaaaaatatctttggtgtggcttcaattttattaactattttaatattgcagacccatatcttcccttaattatactgaatttagtatatttgttaaaaaataaagttttaagactacctgttttggtatcaaaattagttttttttttttctttttttttgagatggagtcttgctctgtcacctaggctggagtgcagtggcatgatctctgctcactgcaagctccaccttgggttcacaccattctcctgcctcagcctcccaagtggctgggactacaggcacccgccaccacgcccggctaattttttttttaatttttagtagagatggggtttcactgtgttagccaggatggtctcgatctcctgacctcgtgatccacccgccttggcctcccaaagtgctgggattacaggtgtgagccactgcgcccggctaggttttttcaaattgaaaattttttttctttttctttctttttttttttcttttgagatggagtcttgctcttgttgcccaggctggagtgcagtggagcaatctcagctcactgcaacctctgcctcccaggttcaagtgattctcctgcctcagcctcccaagtagctgggactataggtgtgtgccaccgcgcccaactaattcttgtatttttagtaaagatggggtttcaccatattggccaggctggtctcgaactcctgaccttgtggtcctcctgcctcagcctcccaaagtgctgggattacaggcgtgagccactgtgcctggctttaatttgaaaattttaatgttacaaatcaaaggtaggtgttaccaaagtatgttaagcatgagcaaaagtgcatttgattgttcagagggccaagttcatgttagctttgggatcatgcctccagagatgtaagtttaactattatgataataacaaagtaataattatgccatgtgccaaggattctattagactctttactatagttaattaaattttaatcttcacagtgccctgaacagcatataatgggtaaaccgagggacagacagtttaagaaccagtttaaaggctgggtgtggtggctcatgcctgtattcccagcattttgggaggctgaggtgggcggatcacttgaggtcaggagttcaagcccagcctggccaacacggtgaaaccttgtctctactaaaaacacgaaaaaaaaattagctaggcatggtggtgcgtgcctttagtcccagctactcgggaggctgaggtgggagaattgcttgaaccccggggatgggggcggaggttgcagtgaaccgagatcatgctactgcactccagcctgggtgatagactgagactccatctcaaaaaaaaaaaaaaaaaaaaaaaaagaaccagcttaaagtcatacaggtaataggaagtcaagcagaagttgcaaaccagataccttttgctacctttacaggcttgctactcagcctggcccacagaccagaagcaattagtgagacctgggaacataaagaaatgcaaaattttggtcactgatacctgcagtgccaaacctgcattttaacaagatccacgagatttgtatgcatgttaaagtttgaaaagcactgatggtgtgaaatgtggattatctatcaacattttccacaagagaaggtgggtaactctagccagtgtctccaccactgtgaattgctaatccagctgctgctttgcttcagatcctgtttaatccagaggaacaattgactaattctgcttgtggaccttcggtcaaagtcttaaccacgccaagtatagctcagtgttttaacagcttttactcatggactgaacacatcagttttatagaccatggcttcattctggataggcatttcccaggttaaagagaacagtgctaaaaatagcattttctaaagaaacttgaaatcttctggaatatttgatgtgttttatggctagcaagaaaacagatttgtataaactggcttccttactaatttcattttgtgaacttaattattctatcacagggacagtgataggtaaagctaacttagactagagcagcactgttctgtagaaatataatgcaagattcctgtaattttaaattttctagtagccacattaaaaaaggtaaaaaagaggccaggagtgttggctcacgcctggaaggctgaggcgggcagatcgcttgaggccaggagtttgagaccagcctggccaacatggtgaaactccgtttctaccaaaaatacaaaaaaatttagccaggtacggtggcgcatgcctgtagtcccagctactcgggagcctgaggcacaagaatcgcttgaacccaggaggcagaggttggagatcgcaccactgcactccaacctgggcgacagaacaagactccagctcaaaaaaaaaaaaaaagtgaaatgtagtccaactaaaacaatacaattgtgtttagtggaaaaatatattgcttcagttataaaatttaaatgaattaaaattaaataaattaaaaattaagttcttcagtcccatcagccacatttcaatatcggatggtattggttgcttctgatataactgatttcagacatatgaaattgatcaccatcctagatggtcagtaagttaatgccacaggatattgtagtctattaataacattgtagaacagggcccagtcgttcacacctatattcccagtgctttgggaggccaaggtgggagggttgcttgaggctaggagttcaagaccagcctgggcaacatagtgagaccctgtctctacaaaaataaaaaaatgaaaattaaaaaaattattgcacagagaataaaggaataaaagcaatttggatcataaagcatttactgattccccccttttcatagttggagttaattttccttttattggttcacaatttcttaactcttcaactgcattaaactgtaagattagagccaggagttagggtgccatccacttttcccctctatggtcttagattcttttttttttatagcccgcatgcttctttggaaagtgaggtaattgtgtcaaataggatagccttgagtggggcccagaggttgtaaaattttatgtctgtacctgattcacctggtaacttgctaaaaataccgatgtccaggcctacctttctagattcggatacataaagtgacactttccatattaaataagctgctctaagtgtttctgaagttcaggaacgtttgggaccatcagatccagcaattgactctcaaaggctgcggactggaattagtacgtcgtgctgccgttgccaggcattttatattttcctaggctgaggcttcccaggctgttgctttttttccccccacctttgcagatggattttgcaggctgttaaatcccactcccgaagacctgccctgacagcgcctctttcctaagtgctgttacagggagctgagcttgccgaggtagacagtggccacgtgactgctaaaccggttgccagaggcgcggccatttttggggcgggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgctgggcaggagggcgaagccatgacgtcagtcaggtaacgagcgggcggctgccttgactgctccgagctgggcgttagcctcccgagcgcgtgagcactgtcgctccttctcgcgggtggtctggagcctgcctccgcctctggtccccctcgtgttgggggttccctccgcacttttcatttgggcatttctgctttcctcagaagttttcgggtctgtggcacattgcggagttctgtgtgtcgctgcttggtcgaggtgaccctcgcccaaattccagggttgcaagcgttcttgggtgtgtagtggatttcccatgaaaaatgtgccccacccgcgcccccgggggcggcccagggccggagggagcgtggcgtgcacagtgtgtgtcatgcctgcgtgtcatgccctctgacagaacttcattgttggccgggagcagacctgcaaagttggcccttctctgatgcaggtatattgccctcaagttgtgaaattgtgtgtctctaaaatgtttgctcatgactggaattaggaccctggttcccgaaggtaccatcttgtttctttactccttttatctcagagtcacaagtgaaatgagttgagagatactgggcatgtagcgaaatccatgaaactggagactttcccccaattgctcttccagtttggaaggttctttttttgttaatgaggacaggataatgggcttgtccactttctcccagtagccttgactgaatgtttaatttacgctagttcaactatttataaaaagagataaattgccttatatacccagtgttctgactggcctttttaaaagcagaacttgggctttgttgtcccagagaaagggaggccccagcacaaaaatgtgaagagaaataaaataagctcatttttggtctatgagctttccaggctccacccgtcctggtgatttgagggcttctcaatgccaatttttactacattgtgtttaagagacagcttgggaacctaaccctcagtaagatctaactgtgctgaactcggacatagtctgtctcttaaattgcataattatatatatatatatatatatatttttttttttttgagacagagtttcgctcttgttgcccaggctggagtgcaatggcgcgctctctgctcactgcaatctccgcctcccgggttcaaacgattctcctgcctcagccatccaagtagctggaattataggcgccagccaccacacccagctaattttgtagttttagtagagatgggggtttcaccatattggccaggctggtctcgaactcctgacctcaagtgatccacctgccttagcctcccaaagtgttgggattacaggagtgagccaccgctactggtctaaattgcttcattctgtactaacatagacaaagtacttatctcattatgcagaaggagattcaggtgctgaaacatggagacccacatggaaggatttcacagtaaattatattggggcatataaatctagcttttaaagctaacagtattttaggatgaattagaattaggctattatacccagagttaattccccttcttcccattcccactcttattatcacagaatgctactaattaggtgtaggggtcaaatactttctgtgttaagaatcagttgttatgtggattcagttttaattgactatcatcttcctgaccgtgcctcattggagaaacatccaaatctaaagcttctgctgtttaataagtgacagcaggatgtatcttttactgtaggggttgatagttttttttaaaagactgatgtaaaggttgacaccagccttacttgacatgttttgaaaggatggataactgataataaaatttatttatgcttgtttcttcagatgtcagtctgtattttacataatcttgaactatggtaacatggctcgagaaagctcttttagatgttatttaaaccagctattacattttacacctgaggaaactgagacaaaagttgagtgccttgtgcaaaatcagcggcaaaattaggaattgaatccagatttccatgatttagtgctctgcatggtgcctttgtagaaacaatatactatttaaacttcctgaaaaagctgtttctgtggacagaaattgtaaagtatcatgagagacaactatagtaactcttttgctttcttcttatcctgcaacgaacttgataactggggtttagaagtaggcagggttagccaagagaacacaactactgggtgttgggaagtgcagggaggccattgaaagtgaagtgactctgtatggtgatagttttgaatgagttggtcatcctacagataccagccatttcctggtgaacactacatttaatacaattatgtcatatctttagtttttgcaataatgatgtcagacatgttcctatcagaggcatttgagccagagcgactccatcttgaatagggtctgggtaaaataaggctgagacctaccagggtgcattcctaggaggttaggcattcttagtcacaggatgagataggagatagtcagaagatacaggtcacaaagaccctacaacaggatgcagtaaagaagccagcaaaaactcaccaaaaccaagatggtgatgagagtgacttctggtcatcctcactgcttattatacactaattataatgtattagcatgctaaaatacactcccaccagtgccattgacagtttacaaatgccatggcaacgttcagaccttaccctatatagtctaaaaaggtgagagaccttcagttctgagatatcagaactgatttcttcctttcctggaaaactcatgattaatccaccccttgtttagcatacaatcaagaaataacaagatacttagttgagcagcccatacccgtgctctgtctttggaatcgtcatccttttgtttctttatttctctaataaacttgctttcactttatggacttgccttgaattctttcttgcatgatgtctaagaaccctcttggggtctagatcgggacccctttctgttaacattcccattttgtgctcagtctaacagtagcctaaaaggtaggtattattgacccccttttactgataagctgaatgattacaagatatccaactctgactttgtgtccaatgttcttgttttataccacccttaattgttgctaaatatagtagtatgtgactcttttcatagcaatggctatgaaagaatacaggattggaaatcaatgaggaccaatggtcagaatatcttgggccccactgagggccttttctgagttactgagcttccatttctcttttctttttattattattattattattattattgttattattaattattattttgagacagtgtcttgctctgtcgcccaggctggagtgcagtggcgcgatctcggctcattgcaacctccacctcctgggttgaagccattctcctgcctcagcctcccgagtagctgggtttacagacgcctgcctcacgcccagctaatttttttctatttttggtagagacggagtttcatcatgttggccaggctagtctttttttttttttttttttttgagacggagtctcgctctgtcacccaggctggagtgcagtggtgcgatccggctcacttgaagctccgcctcctgggttcatgccattctcctgcctcagcctctctagtagctgggactacaggcgcccgccaccacgcccagctaattttttgtatttttagtagagacggggtttcaccgtgttagccaggatggtctcgatctcctgacctcatgatctgcccgcctcagcctcccaaagtactgggattacaggcgtgagcaaccgtgcccggctggccatgctagtcttgaattcctgacgtcgtgatccccccacttcggcctcccaaagtgctgggattacaggcgtgagccaccgcccccagccccatttctcttttctattctggacatttgtttaatgaaataactcagtagcagagatactaatatgcatcctaccagtgttgttggataagtgtaaaagtgcttttaaattttaaagcattttaaaaatagaataaaagcactttgagccctctagagaatggtgtcatctgaggaaaaaaatgtttaaatcttaaatttttagacaggaaacaaatttacctatctaattttctcattttacagttgaattaaagcccagagatagtgtgacatgttcaagttcacacagttacatatcttgaactagatatgagatctctagataccttgttcagttccctttctagtatagcattcaactctgaggaattcctaaataatgatttttttttggggggggtctctttaggaattcctaaataataattttaaatgaaaacttttctttttttttaacttaagatctttgaatttggctggagttagtatttcatcatttgtattctattctacttaattactgattaagagtctaaatttacagcctctgaaaccagatatccttggggaacaacttatatcctttgttatgtatatcagattcctactggtcttcatttgggaaatgatagaacatatttgataaattgatgcttttgtcattttaaattggcccaatagttaagttggcgcctgagttaagttcaggagacagaggaagatgcagaatgtcaggattcaaagaggatcttagcattttactttttttccttttctatactggatcttgtgtccaaagtaaagtgaaatgtcctacttagacctagtggtagagcctaagatagaatttagaccttctgactcctaatttatgtatttttcactgagcaacactatttcaaaattcccctctgaatattgccttgttttcctaacatcagtgtctagtctggttttgggcatcgcttacagcttgggtttgcgccagggaagactaggaaatggagttggggaatatttgttgtagagctaatgagccctattctttggtctgcccagataggtcaggtttggtctaaaactattctgggactctggacatcactgtgccctacatgatgattctggaacccacttttgtgggttaagcctacattggaaaatttatgtgggcagtgggtggggtcgtggggtattttccttctaacactcgaaactttttgaggtatgtccaatagaatctgccaagccactcagaacattcatatggagactaaaatctggctaagattgaaactgtctttgttgagttggtttctttagagccttaaagttttcaaactcatttttacctgtgtttttaaaatacgaattgtaaattcacattactgcacaattttttttatgctgtgggatgtttttagagaggtaagtgagcttttaaactaaaattgtttcatttatggaatattttgaagaagtaaaacagaaatctttttatttatttatttatttatttatttatttatttttgagacacagttatactcttattgcccaggctggagtgcaatggcacaatatctgctcactgcaacctccgcctcccgggttcaagcaattatcctctctcagcctcctgagtagctggaattacaggcacatgccaccatgcccggctaatttttgtatttttagtagagatggggtttcatcgtattggtcaggctggcctcgaacttctgacctcaggtgattctcctgccttggcctcccaaagtgctcacaggcatgagctaccgtgccggccaggaatcttttatgtgcaacgttgtcagctgttaatgctcctatttatgaataggtcacctttgtttgaaaaaagcgtacaaggttttctaactccaaatctttccagccacaatattgctacgttaagcagaactgtcaaagataaaacttgaaccaaagtgattttctagactgtttgaatgttaaccctttcctgcaatattggttaacagtcacgtctccctacctcttcatacctccttggttttattttattatttttattttttgaggcacggtcttgccctgttgcccttgctggagtgtggtggcatgaacacagttcactgcaacgtcaacctctgggcttaagtgatcctaccacctcagcctcctgagcagctgggagtagtcccacttgtagtccctacagtcccacctgtagtcctgtagtcccacctttgtattttttgtagagatggggtttaaccatattgtccaggctggctttgaactcctgagctcaagtgatccacctgctttgacctcacaaagtgctgggcctcccaaaatgctgggattacaggcatgagccgctgtgcccagccacatccttggttttaaattgttatttaaaaaatactgttgctgggcacggtggcacatgcctataatctcagcactccgggaggccgaggtgggaggatcactttgaggccaggagttcaaggccagcctgggcaatatgataaaaccccgtctctacaaaaaatacgaaaatttgcagggtatgatggtattgtgcctgtagtcccagctacttcagaagctgagtcaggaggatcccttgatcctgtaatgaaatatactatttttttttttttgagatggagttttgctcttgctgcccaggctggagtgcagtggcgccatcttggctcaccgcaacctccacttcccaggttcaagcaattcacctgacacagcctccctagtagctgggattacaagcgtgtgccaccacacctggctgattttgcatttttagtagagatggggtttctccatgttggtcaggctggtctcgaacccagcctcagcttacccacccacctcggcctcccaaagtgctgggattataggcacaagccaccacgcctggccatgaaatatactactaataaaataaaatactgtgataaaacataaataaacatttttattttttactttttacttttttagctggcattctggtctgagattattttattttatttttattttattcgagacagagtctcgctctgtcacccaggctggagtgcagtggcacaatctcagctcaccgcaacctccgcctcccggattcaagcaattctccctgcctcagcctcccgagtagctgggattacaggtgcccaccaccacgccctgccaatttttgtatttttagtagagacggggtttcacaatgttggcaaggctggtcttgaactcctgacctcaggtgatccacccaccttggcctcccaaaatgctgggactacaggtgtgagccactgtgcccggcagagatttttattttttaaatggcaaagctaggttatgaacaggatgaccatatgttccagtttgcccaggacaattctggatcatgcctgttatcctgacattattatttattattattttttcttttgtagacacagggtcttgctctgctgcccagctggagtgcagtagtgcaatcatggctcactgtaaccttgaaatcctgggctcaagtgatcctcccacctcagccctccagagaggctgggactataaacacacaccaccatgcctggctatattttgtgtgtgtgtgtgtgtgtgtgtgtgtgtgtgtgtgtgtgtgtcaggggggtgggtaaagatggggtcttgccatgttgcccaggctggtcttgaacctcctggcctcaaactcttggtcaagtgatcctcccgcctcagccacctaaagtgctgggattataggcatgagccattgtccccggctatcctgacacaattattaatagacacataaatgtgtctcatttactctcaaaagtgtcccatttggataataaattatctggtcacctacatatgcattacaatcattttgttgtactaggttttgtttgttgaaatgttatttgaactaggaccataagataatggaattttggcctattttgggtacatttggatgtttttcattggtcagacatttttattgtatggagagttctgagtgtacaaatgtatattaaatagtaatgcacatgatttgaaattagggattatttgttatcttacttttgggaggttacataaccttgaggaacctcttgtttcctcatccgttaaaaagagataatagcgatacctatcctacatgggtgttttgaagatattaaagaggtgacataccaaaaaatgcattttaagttgaaaattgttatataagtgttagtcatgtcacacatgtgcctttctgcaattgaatttaaaatgaataattttacctagtttggggaacttactatttgatagagcactggtagtgttttgctgtaaaggagagcagggaaataatggtagttggaagtacatgctgggctaaggttttctgcggggaggttttgaaattttcacatttgtgtgctgaaaagagtggtccaatagaaagcagaaaaaatagatgatgcttgacagaaggaagaaatcaatgttgagtaggaaagaaggatagaatctagaatacatatggaaggattggctttacgtaaccaagaaacacatttccctagtctgttcactttaaaaaaaaatgccaacaatataatttttttttttttttgaagcagagtcgtcggccgggcgcggtggctcacgcctgtaatcccagcactttgggaggccgaggcgggtagatcacgaggtcaggagatcgagactatcctggctaacacagtgaaaccccgtctctactaaaaatacaaaaaaaaaattagccaggcgtggtagcgggcgcctgtagtcccagctactcgggaggctgaggcaggagaatgccgtgaacccgggaggcggagcttgcaagtgagccgagatcgtgccagtgcagtgcagcctgggcgacaaagcgagactccgtctcaaaaagaaaaaaaaaaaaaaaaaaaaaaagaaacagatcctccctctgttgcccaggctggagtgcagctgcccgatctcggctcactgcaacctacctctcctggggtcaagggattcttctgcctcagccccctgagtagctgggattacaggtgcgccccaccgtgccaggctaatttttgtatatttttgtagagatggagtttcaccatgtcggccaggctgctctggaactcctgacctcaagtgatctgcctacctcggcctcccaaagtgctgggattacaggcgttagccactgtgcctggctctctcagtataatttacctaaagtcaaatcagccttccctttccttcccttcccttcccttcccttcctttcccttcccctcctttcccttccccttccgcctttcccctttcccttctcccttctcccctttcccttctcctttcctttccacagggtcttactttgtcgcccgggcttgagtgcaatggggcaaacacgtctcactgcaaccttgacctccccagcccaagccatctacttgcctcagtcccccaagtagctggggctacaggtgtgcaccaccacgcctggctattttttttgtattttttgtaacaatgccgggggagtggggtgggggtggggtcttgctatgttgcccagggtggtcttgaactcctgagcccaagtgatccacccacctcggccttccaaagtgctgggattacaggtgtgagccactgtgcctgatccagcctctttttaattaattctgtcccccttctcacccaggcaaccacttttggacttcttttactatagatgttagttctgcctgttctagaacttcacataaatggaatcatacagcaaggagtattttgtgtctgattacttttgttcaatataatattttttagattcacccattttggtgtgtgtatcagtagtttttcccttttattgtgaagtaatattccattatatgtatgtagcaacaagtcttctattgatgggctttgggttatttccagtttttggttactatgagtaaagttgctatgaacatttttgtatatatctttatgtggacttgggtaaatatctaggagtgaaattgctgtgtactagggtagatttatgtttaactttagaaaccactaaacttttccaaaatggaaaatttaacactttttacattcccaccagttttttttttatgagagttcagttttccacattcttcacaatgtttggcattttaaaatttaggcattctcctgagtgtgtacttgtatttcatcatggtttttgtttatatttccttgatggctaatatgtgattattggccatttgcttatcttttattttgaagtgtcaattcatttctgaaatattatcactgaataatatttcattgtatagatatgccacaatttatccatttatcacttgatagatatttggattattttcacttttgggctattatgaacaatggtgctataaacatttatgtacaagtttttattaaacttttatgtgcaaccctattttattgggttgtctttttgttgctgatttgtaggagttctctttatatctgaatgcaggttatttgccaggtttctcagattttacacgcacatacacacacacacacactctttctctctctctctctaaatattttctcctggtctgagctatgttgttgcattttcttaatgccttttgagagcagaacttttaagttttgagcaagttgaatttgttgatttattttattttatggtattaccttttctgttctaagaagtctttccttactctctgctaggcttgtgaaactattctctcatggtttttttctagaagctttatgtttttgtcttttgtatttaggcctatgatctatcttaaactactcttttgctatcatgtaagggtttctcaaaaggattttcaattaattgattagatagctgtgggtcttttcttggatttgttctattctgttgatttatttgtatcttcttatgtcaatgccacactgtcttaattattgtagctttataagattggtattgttactttaaattttgatagaattaatcagtgcagccgtgtgggcctggagtgtttttgtgggaaaaagcagaaggttttaaattagtgtaattacttttacaggtttaattactttagctgatatataagcattcaggttcttcactttttcctgtggcagttttaagaagttgaatttttaaatgaatttattctcaattgttgagttgttataaagttcataaaatttcctaatattctgttattgcctgtatgaactgctgtatgtctccatttgcattcttgatgttggtacttcttttgaatttttggatcagttttgctaggggtttagcaattaatcttttcaaaaacccagattttgttttgttgaatttctattttggacatgtatttttaatttttttttttttttttttttttgagacggggtcttgctttgtcacccaggctggagtgcagtggcgcgatcttggctcactgcaagctccgcctcccgggttcacaccattctcctgcctcagcctcccgagtagcagggactaccggcacccgccaccacacccggctaattttttttgtgtgtttttagcagagacggggtttcaccgtgttagccaggatggtctccatctcctgacctcgtgacctgcctgcctcggcctctcaaagtgctggtattaggggcatgagccactgcgcccggccaccttgctctcctcttgtggatttgatttgctctcttttttctaccttttttgagttagaagtttagattattgtttttaaacctttcttgttttctaatgtgcatttcatttcattcattcattcatacattcattcagagacggagtcttgctctgttgcccaggctggagtgcagtggtacgatcttcgtttactgcaaccttcgcctcccaggttcaagcgattcttctgcctcaggctcccgagtagctgggactataggcgtgcaccaccacgccaggctgatttttgtatttttagtagagacggggttttaccatgttggccaggctggtctctaactcctgacctcgtgatccgcccaccttggccccccaaagtgccaccgctcccagccacatttctttcattattattattttttctttgctaacccctagtagtcattctaatgtacatttcttatataattaacattttcttctaagtactcctttagctgcagcatacaatttcgatgtgttcaattcaaatttctatttccattgtgatttttctggtccacaggtcatttagaagtttattgtttcttaatatttggggattttttagctattttcaattttacatggtgttcagggaatgcgttgttgacatattgtgtacatatctgtaccatatatctgtaaatgataagttgtttatcattttaatcctttgatagctactgagattagttttaaggcctaccctgtggtggtctgttttggtgaatgttacctgtgtctctaattccgctctgcaatattttgaggttttcagtgtagatattttatgtatcttttattaaatacggtgtatactgcagttattgaatttagtgttctataatttatcaattaggtcagatagttttatgtgtttgttactatataactgagatataattcagctactgtaaaatgcaccacttaaaaattgcacagctcagtagttttcagtatattcacaaggttgtacagccatcggcactatttaattccagaacgtttttgtcccccaaaatgaaaacccatacccgttagcagttactcttcatgtctccctaacctctaacccctggcaaccactaatctaccttgtccctacaaatttgcctattctgaacatttcctaagtggaatcatataatatttggccttttgtagctggcttttttttttaactaagtatgttttcaaagttcatacatgttgtagcgtgtatcagtatttcattctttcttatgactgaaataatatttcattgtatagatatgccccaatttatccatttatcacttgagagatatatgggttattttcacttttgggctgctatgaataatggtgctataaacattcatctacaagtttttgtggtgttctatttttctatttcccctaagggtagaattgctggggcatgtggtaattttatgtttactttttgagcaactgccaaactattttccaaagcggctgaatcactttataatttgcaacagcaatgtatgaagattccagtttctccacattcttgtcaatacttgttactgttctagtcttcgctgagaggctctgtgtgcttgttggagcacactttcagcactcaaccaggctttcagttcatccatagccttgacttcctgttttgccgagcttcatgctcagtcagtggtgattgcttagggccttctcaggtctttcttgagtatgcccataggcctgggcacactgttttcatcttccagggtcttaggaatttcagaacttttcaaaactccctatggacatctcattctcctacttttccttttgtgttttttggttagcttgtttgccccagctgcttcagggagctgaaatgttaagcaattgtagctgattgtttttgacaaataaataccttgggggaaaagcctgttagcaatgggcaagctctgaatcaggttaaatattaggaagtcttgggagtggggtttttcagggaattgctagtcagctcaaataataactgtactctgaaaatgggactttgaaggaactctagccctgttctgtcacctccactggctgctaggctccaggattccacagattgtggtttgctgcttttcagggctagcctggagctgggaagaggggcatgggaataaggcatgttaaaatgccacaaagcttgctattcttactgagatgcagccatctttttttgaataaatgctccttggattgttgcaaactttttggttaatattcagagttctgaaaaaggctatttttgactttttttttttttttttgagatgcagtcttgcattgtcgcccaggctgaagtgcaatggtgtaattttggctcactgcaacctctgcctcccaggttcaaacgattcccctgcttcagcctctggagtatctgggattataggcacctgccaccatgcccagctaatttttgtatttttagtagcgacggggtttcaccaggttggccaggctggtctcgaactcctgaccttgtgatctgcccgccttggccttccaaagtgctgggattacaggtgtgagccactatgcccggcccaagtcttgacatttttttgccagtgttcttgttggttttatggaagagaggatttttggaggtccttactctgccattcccaatgatgtcacccaatttgttttttaagcattaaaaaaaattattttaaaatataaagacagggtctcactatgtcaattaaaaagacagggtctcgcccaggctggtctcgaactcttgggctcaagtgattgtcctgccttggcctcccaaagtgctgagactacaggtgtgagccaccacacctggcctaaacatttttaatatatctgtttttatatcctgttcctcccttttcttttgaaatacaactcacagaaattgcaaaaatagtacagaaagttcctgtgcaccattcactcaacttcccccaatgatatatcttttataactatagtgtgttaccaaaaccaggaagctgatttcggtgttatacaatagtattaaattaactatagacgttattagaatttcacgggtttttgtatatactgtttttaattgaggaggtggtggtgtatagttctataaagttttatcatgtccagattcatgtagctattaccacattcagggtattaaactattctgttaccacaaagaaatttcttcatattatttctttatggttatgcttttctctgaaccctaacccctggcaactactgatctgatttccatcactgtaattttgtaacttcgagagtgttatataaatggaatcatatagtaggtaacccgtagatacggcttttttctcacttagcacaatgcctttgagatccgtttaagttgttgtgtgtgtcatagttcattcctttttattgtttctcttttatgggtgtaccatagtttgtttacctatttacttgttgaaggacatttattatgtttccagatttttaccatttttttttctttttctttcttttatttgttttttttgagacagagtcttgctctgtcacccaggctggagtgcagtgccgcgatcttggctcaccacaacctccgcctcccgggttcaagtgatttttctgcctcagcctcctgagtagctgggattacaggcgcacactaccacacccagctaatttttctgtttttagtagaagcaagttttcactatgttggtcaggctagtctcgaactcctgaccttgtgatccgcccgcctcggcctcccaaagtgctgggattacaggcgtgagccactgcacctggcccattttttttttttttcaaacagatatggttttgctctctctgtcactcaggccagagtgtattggcatgatcattgcacactacagtcctcctgggcttaaagaattctcccacctcagcttcctgaggaactaggagtagagacatgcacaactgcacccagctagtaattttaatttttgtagagatgaggtcttactatgttgcccaggctggtcttgagctctggcctcaagtgatcctcctacctcagcctcccaaagtgctgggattacaggtgtgagccaccatggctggcctagtgttttacaaataaatctgttaggaacatttgtgtacagatttctctgtgtacttaagtttttcttcctctgggataaatgctgtgtagtgtgattctttaatttttggtgtgtctgcctgttttactaattactgaaagaagggtgctaaactaagattatgtatttgcctatttcttttgtttctaagtttttaaaaaagtattttgaagccattttatttggtgtgtacatattttgtattgttacctttagcatttcttttcttgatgatttgacctattttcatgaaatccctttgtatctggtgatactctgtattttaaagcttaccttgtctgtgtcttaatatagccactgtatagtgtctatatagtgtcttaatatagccactgtaatttatgattagtgttttctttttttttcttttttttattatactttaagttttaaggtacatgtgcacaacatgcaggtttgttacatatgtatacatgtgccatgttggtgtgctgcacccattaactcgtcatttaacattaggtatatctcctaatgctatccctccctcctcccgcctccccccaccccagtgtgattagtgttttcatggtgtgtctttttgctaactttttattttcaaaacttctttgtctttataaaagtgtatcttgtgctaggcatgctggctcatgcctgtaatcctagaacctagggaggctgaggcagaagtatagcttgagcccaagagtttgagatgagcctgggcaacagagggagacccagtctctattaaaaagaaaaaaattaactgggtatggtggctatagtcccaacttattgggaggctgaggtgggagagcttgggaggttgagcctgcagtgagctgtgattgcaccactgccctccagcctgggcaacagaacaggagcctgtctcaaaaaaagaaagaaacaaaagatcagaacctataatcacagaatcactgaaaacccatggaattatcatatgctagccattgggaatacaaatgtaaatgagatttcaaaaaaatctttaccctttgttgtctaggtggttaagatcagttgattgagataaagttcaaagcaacccctaaaatcaactaaaaagttcatcaaaggacttttagaactgagcaggagggaatgaataaatctttgggagggagggatgcagtgccttgatatacagtaccaggagccattttctacattgttaacagcactcttgagtgatgttggtggcagcttgtatatcttatgtggaagcccttgggtaggagtcgatcaggaaaaacttcccaagacaggtagcatacagggaattttaaaaagatgaatgggagtttgccaggcaaaggaagcaggagaagaactttacaagcagagtcttattcaaagaacagtaaggcattatgattaaaatagtttgtatatattagaatggtgagaggtaaggttaaagaattactgaattttgattatcttagtgtgcacatttcttcccattttaacaactctgaaattggcatacatcttacaactgattgtgttttgcatcaccattggaaattgggattattttatgaataatggcatcttagatatgatgaaatatggtaagtttgagtagattcaatgtcctttaagttatgcttttggattttatcctattaataatcagaagctaggtagattttaagtagaaaaatattatgtctagaattgtttaaaataatatgattttggtgatattgtgcaggatttattgtggctaaaacaattgctaacaatgtagaaattcaggcaatgtctgcagagggcctagtgctagtgggtgtattgtgggaaatccaggtacaggaagcgtttgataaaaccaagatgatgtcgttactagtaagatggggctagttgacgtagagagaagagtcatataaagctgaggtttctggatttaaagagaagatgactggtgtaacagttaaaggcagtcattgttagtgtttattctggcatcataattaaatgtttctattactgagagggctaatcaacattcaaacattaatatatcaatagccaagaaaagattttctcaggaactcttactgtaaaatatatgtcagtataaaatttgttgactgtccaataaaataataattatagtgtaggtttatgttggctgcaagcctaaattatgagacatttataaaattactgaccgctcccccccccaaaaaaaaaagattgttcagaatctctcatcctagcatccattccaagaaaaagatattgctaacatttggaataaaaagtaatcccagtacgggttagtcatagtttttggctatagactaaacctcatcttgttcacattctagtagaacaagataaaaacaaatgcttattcatatagtatgttcatcatttaagaaggtcatagtatttactggcctggacactagtttatatgtgtttgtatttaagaaactagccattataatctcaattatgtgcagtgaaggagagagaaacgtgacatgagcaaagttttatttgcttttgaaaataattgtatcttttttacttaacttactatttcaagatatcttttatatgctactttatttaattaatttgtttttaagacagggtcttattctgtcacccagggctggagtgcaatggtgcaattacagcttactgcaacctcgaccttccaggcttaagcgatcctcccacctcagcctccctggtagctgggattatgggtgtgcaccaccatgcctggctcaattttttatatttttctttttctttctttctttctttctttctttttcttttctttcttttttttttttttttttttgaggtagtagcatactcatggctcactgtagcctcaacctcctgggctcaaggattcttccacctcagcttccctagtaactggggctataggcacatgccaccacacgcggctaatttttgtattttttgtagagatggagtctcgccatgttgcccaggctggtcttgaactcctgtgcagaggcaatgcgcccgcctcagcctcccaaagtgctgagattacaggtgtgagccactgtgcccagccaattttttgtagagatggagttttggcatgttgccctggctggccttgaactcctggactcaaaccatctacatgcctcagcctcccaaagtgctgggattacaggtgtgagccaccacgtccagcctgtgctaatttaaattattttctcctcactgctgtactagccacaacttctgcaaccagtttcatgtgggctttggacaattgcagcctaacagcatcactcatcagggtctatgttgcatacgttctcccttggggaactgtaatgttaagattaggctgggtgcggtggctcacacctgtaatcccagcactttgggaggccaaggagggcagatcacgaggtcaagagatggagaccatcctggccaacatggtaaaaccccatctctactaaaaatacagaaattagctgggcatagtggtgcgtgcctgtaatcccagctacttgggaggctgaggcaggagaatcgcttgaacctgggaggcggagtttgcagtgaaccgagattgcgctactgcattccagcctggtgacagagcgagattctgtctcaaaaaaaagaaaatgagcactaataatcttttctatattacagttttataataaaaatgcattacatattaaacagattcacaaagtgaactaatgacaatttacgtctgtccctatactttcagttgtaagtaactaaaaaccagcctcaaatggaaataaacaaaactaccgacatatgtaattgaaaagtccagatacctgggtgatgaaataacctgtacaacaaacccccatgacacaagtttacctatgtaacagacctgcacttgtacccctttacttaaaaaagcaaaacaaaacaacagaaaagttcagatggagtataggtttcaggtaaagctttattaggtggtccaacaacttcattaatgacctggtttctttcagttttcgcactctgctttctgtggtgttaaatttatcccaaggcagccacattgaagccattaggtttttaaggcttctagcaccttcttcatttatatctattagggaaaaatatgttctgtatctgagcatcatagaaaaaaatcttgggttcattctgattttcctggcttaggttacatgccagtctctgaactgattactaaggctagagaaatatattgtgctgattggcttaggtttgccccagggatcaattccacccaaattccattcttgagtgaggaaatttggggtaaaagagggaggatagcaaggaaaagatgacagacacacaattccagtttattataagaatgacttcaaatgaccttaactgaattgtaatattatttgggaacaagtcaaacattattaacatttaggcccagagatggtagatggcttgcttaagtctcccagcaagctacctcaagaactgagacttgggctgggcgtggtagctcacacctgtaatcccagcactttgggaggcccaaggcgggtggatcatttgaagccaggggttcgaaaccagcctggccaacatggtgaaaccccatttctactacaaatataaaaattagccaggcgtggtggtgggcacctgtaatcccagctactcagcaggctgaggaaggaattgcttgagcccatgaggcagaggttgcagtgagcagagatcatgccattgcactccagcctgggtgacagagagagactccgtctaaaaaaaaaaaaaagaaaaaaaaaaagaactgagactcagaagtgaattatttgactcttgaattgtacttcattcttagaatcaattattggcctctctgtaagactgtctttactgagtttttaaacggagtataataaactcttttgggaatgcggtagatgttcaaaggtttgacttcttaaaaagaggtgtaacaattatattccttaaaactgagaggggaccaattgagggtagagggattgatgtgggggcaggaggatacttttttgttgttattgtgatgaaaatgttccatagttttgtggttatatgactgtatacattgaactggatgcttacaaacggtgataaaaagggtgaaggaaaataaaaaaccaagtagcccaataacactgctcatccttgtttttttgttttgttttgttttttaaataacaagttctaggagtttttgtttgaataagaatatataaatcaggcagagtagtcccagtgaaatcatggttagattttactgtatttgtctgttgatccttcaccttctaagcacttaaaatacttttttattagacttgctttgatcacatatgcaatttaagtgtgaataagtaagtgtattatctttccctcctccactcagctttctttaaatagaaaagggacaaatatctctttattgcatattcagccatagttgctcaatctatggtgttaataagagactgtaattttatcttctaaaaatcattacagattataattataggctgtacctcattctcttaaagaaatattggcatgttagtccattgatattactgatagttgccaaatggtgagaatggtaactggtttggaggcaactgaaagggagggggaatcatcagtaaactggagaccaataaaaaattacacagaaacaaatctttttggataaactagatgaatgtctcttattgagactgatccaacagtattcactggcccatttcttgctgctagatgagcttctgtttaaggcatcacttgtggtggagttctttcttttatttggattggaaccatactgtgatctcttatggaaaacagacttcctccaagtctgttaaatataatttaaaattatatcgtttcttgttgatttgtttgtttttgttttgctttatttcatgttataggcatctgaaatgaatccttatatatataacatacaagtatatgtatgagaagacatgaatataagaagtataggaaacataagacatgaataaaagttttagctagacatttttagatgaaaagatgtgcatttaaatttgtaaaagttacaaatcgttctataaaaagttagcatatatttaaattttttggatacataataagagaattatatcacttctgatatccattgtgaagaccctaccacagtcatttttttgtgaagggtagatagggctcttgcttgtactcttccaggatgtgccacgggctccctaataacattcaggggagtgcatgtgcaggtttgttacatgggtatatcatatgatactgaagtttggttttgtaatgatccccatcgtctaagtagtgaacatagtaaccaataggtagtttttgagcccttgctttcctgtctccctccctgattttggaatctccagtgtcttttgtcccgacatctttgtgtctctgcgtacccagtgtttagcttccacttataagtgaaaacatgtgatatttggctttctgtttctatgttaattcacttaggataattcagctgcatccatattgctgtaaaggacatgatttcgttctttttttatggctgcatagtattccatggtgtatatgtattgaattttctttatccattctaccattgatgggcacctaagttgattccatgtctttgctattgtgaagagtgctgtaataaacatatccctttttggtagaatgattcattttttttcattttttttattttttaggcagagtctcgctctgtcgcccaggctggagcgcagtggcacgatctcgactcactgcaacctccacctcctgggttcaagtgattctcctgcatcagcctcctgagtagctgggactacaggtgctcgccactacacctggctaatttttgtattttttatacagatggggtttcaccttgttggtcaggatggtcttgatctgctgacctcatgatccacccacctcggcctcccaaagtgctgggattacaggtgtgaaccaccgtgcccagcctagaatgattcatttttctttgggtatatacccataatgagattgctgggtcggatggtaattatattttaagttttttgagagatctttaaacttcttttcacaggggctaacctaatttgcattcccatcagcagtttataagtattaccttttctctgcaaccttgacaccatctgtttttttttttttttttttttgactctttagtaatagttattctgggctgggcacagtggctcacacctgtaatcccagcattttgggaggctaaggcaggtggatgtgctgaggtcaggagttcgagaccagcctggccaacatggtgaaaccccatctctactaaaaatacaaaaattagccaggcatggtggcaggcacctttaatcccagctactcaggaggctgaggcaggagaatcacttgaacctgggaggtggaggttgcagtgagctgagattgcaccattgcactccggcctgggcgacaagagcgaaactccgtgtccaaaaaaaaaaaaaaaaaataggtattctcattggtgtgagatggtgtctcattgtagttttgatttgcatctttctctgataatcatctttttttctaaatgtctttatgctacctctaaaatgttctacgtataataggcaaatcaaatgtttaataaactggtgtgttaggtttattttcaggttgaaatgaagatagttatttttattttgtgtaccttttacatatcaacttacttttagaagtatttctaacttgtgttttgtgtttttttagagaaaatattctctttggaatgggaaatcctctgcttgacatctctgctgtagtggacaaagatttccttgataagtaagtattaaactcttcatatgcactatgtggaacttacatttgaagaagaatggatgaaaactttagaagtgaatttaccaccgaatgtcttcaattaaaggaaaactcaggaaatttaagtttggtgatagcaagtgtgctatcattaactattgaataactgagtacagttttccttgggaaaacttatatacattgctatttttacttaaaacttttttgcttattatttggaaggagaaaagtttatataatttacctaattatttaattccccaacttttaaactactgtcagtgagctacgtctataatggtatcataatctacagacattctaccccgaatgtgcccagtctggtttcctctcagaagctataatgggagaagaaagatgattagagaagacaagagaacgtgcaggatataattcagaggatatgaagctctgctgtttccgctttattagtaacttccaatgtttcaacttagctgagaaatcagtttgtttatttacctaagtatttgaggccatttcgtacaatagtccccacttgtgtccttgttttcagtttctgaggtctcagttacccataggacagtgtaataagacattttgagagagagacatgcaccacgtccacataacttttattacagtatattttaatagttgttctatttttagttagttgttgttaatctcttattgtgcctaatttataaatgaaactttatcatagtatgatgtgtaggtatgtatgtgtaggaaaaacagtgtgtgtgtgtttgtgtgtgtgtgtatatgtatgtatgtatgtatgtatgtatgtatgtatctatctatctatctatctatctatctatctatctatctatctatctatctatatatggttcagtactatccatggtttcagatacccactggtcatcttacaatgcatctacctcggataacgggggcactactatatggcaaatttaagtagtaaaaaagattaatgatgagaaagcaagatcccccctctcctcacacaccctgatttctgtacccaagagtaattactttttaaaaaattgaggcaaaatttatatcgcataaaattgatcgttttaaccattataaagtatacaattcagtgactgccagtatattcacaaagttgtacaaccatcaccactatctaattcaggacattttcatcaccccaaaatgaaatcccatacccagtaagtagtcattcgctattccctcctctaacccagtctcctgggaactactagtatacttagtttttctatgaatttgtctattctgagcattttatagaaatggaatcatataataatatatgatcttttgtgtttatatatatgaccttttgtgtttgggcttattttacttatgtaatgctttcaaggttcatccatgttgtagcatgtatcagtccttcattccttttaatagtggactattccattgtgtggatagaccacattttgtttatccattcattggttgatggacacttatgttgtttttattttttgtctattaggaacaatgcttcttatgaatattcatgtataagcttttgtgtaggaatgtgttttcatttctcttgggtatacacataggagtggaactgctgggtcacatggtaattctgtgtttaacttctagagaaaccaccaaactgttttccaaagcagctgcactgttttgcattcctaccggcagtgcataagtgttccagtttctctacgtctttgccaaagcttattttttattttttaaattatagccatatgagtgggtgtgaaatgatgtctcattgtgattttgatttgcatttttctattgaaaacttttgatgttagcatcttttcatatgcttattggatatttgtatatctttgggaaaatgttgaagctctttgcccattttttaattgggtcgttgtctttttgttaagttgtaaaagttctttttatattctggatactagaccctatcagctagcatatgatttgcaaacattttctcccattctggggatttactttaattttttgatagtatcctttgatgcacaaaagttttaaattttgatgatgtccattttatttttcttttgttgcttatgcttttgctgtcatatgtaagaatctattgttaaatccaggatcacaaagatttgtgcctgtgttttcttctaagagttttgtagtttaaggtcttagatttaggcatttgatcaattttgagttaatttttgtataaggtatgaaataagggttcaactttattcttttgtgtgtggaaatccaattgtctcaacatcatttgttgaagagactattcttttccccactgaatgatcttgatactcttgacaaaatcaggtgaccatagatatatgggtaaatttctggactccattctattccattgatacatatgtctgtccttatgccagtatgacattggtgtttttgtgtatgtgtgttttgttttttgttttttttttggagacagggtcttgctctgtcacccaggatggggtgcagtgatgcaatcatagctcactgaaaccttgaactcctgggttcaagtgatccttctatttcagcctcccaagtaactgagactatatgcaggtaccaccatccctagctattttaaatttttttttgtataaacagggtctccttatgatgcccaggctggtctcaaactcaagtctggcttgatcctaggcccaagttgtcttcccaccttggcctcccaaagtgctgggattataggcattagccaccatacctggcctgtacgacactgttttgattactgtagctttgtagtaaattttgaagtcaggaagtgtcagtcctccaactttgtttttcaagattattattattattattattaatttttaatttgagatccctcacaattccatatgaatttttggggatagctttttcatttctgtaaaaaaggcagttggaattttgattggaattacattgaatgtatagataaatacatgattaagtcttccgagttatgaagacagaatgtctttccatttatttaggtcttttttttttttttttttttttggagacagaatcttgctctgttgtccaggctggagtgcagtggcatgatctcagctcactgcaatctccatttcccgggttgaagcgattctactgcctcagcctcctgagtagctgggattacaggtgtgtgccatcatgcctggctaatttttgtatttttagtagagacagggtttcaccatgttggtcaggcttgtctcaaactcctgaccttgtgatccacccgtcttggcctcccaaagttatgggattataggtgtaagccactgtgcctagccttaggtctttttaaaataattttagcagtgtttagtaggttttcagtgcataagtcttatacttctttggttaaatttaattttattatttttgatgccattgtaaattgggattgttttattttcttattgttcattgatagtatgtagaaatataagtaattatgggggacaataatttttttgaaacttttttttatatcctggggattacccctgtaagtatatttggctaaactcaaatgtcaaagggtaaggcaagaatttataaatgtgtaaatttgacttacggtaatataataggaaatgtgctgggggtctaggataaactgggagatgtgttttatcctaagacattcagatagaaactttaaaacacactttcccagtcagaaaatactactatatacagttactttaatgattttagttcttttggttaccttgtacttttaaataatatactatacttacatttcttaaaatttctttttctgtcaaatttcaggctgggcgtggtggctcacgcctgtaattccagcacttttggaggctgaggcaggtgaatcacttgaggtcaggagttcaagtcatgccaacatggcaaaaccctgtgtctactaaaaataccaaaaattagccaggtgtgatggcacgcacctgtagtcccagttactcgggtggctgaggcaggagaattgcttgaacccgggaggcagaggttgcagtgagctgaaattgcaccattgcactccaacctgggtgacagagttgacactctgtctcaaaaaaaaaaaaaaaaaaaaaaaaaaaaattaaaccaagccaaaccacaccaaaacaaaaaaacccaaatttcaatggaatccattgacttctcattatggagaacgagattactggtgcccctattctttcctatgctacttcttctatctttctattctattaactgtgtttttaaggttgatgttttcattctgttatctatctataattgttttcccaactttgaatacaaattcataatgaaagttgaaaatgacttacccacattatcactctgtgtatcatttattgcagaattaagtagtgtaccaggaatgtagagcaggttaacatttgaaatgtaattagaagactgggcgtggtggctcacgcctgtaatcccagcactttgggaggctgaggtggatggatcacttgaggtcaggagtttgagaccagcctggccaatagggcaaaattccgtctctattaaaaatacaaaaattaactgggcatggtggtgtgtgcctgtaatcccagatactcgggaggctgaggcaggagaatcgggtgaacctgggaggcggaggttgcagtaagctgagattgcaccactgcactccagccagtgtgacagcctgagaatctgtctcaaaaaaaaaaaaaaaaaaaagaaatgtaattagagtaattcactatagtaagaaactaacataacagtctaagaaaactccatataattatctcaatagacaaagaaaaaccttttgacaaaatctaatatctattcctgatgaaaaaaaataacttaaagcaacctaggtaactatgtcgataactttcttaaccctataaaggttacgttaggggaaaactggtagtgtgatgcttatatgggtatataacgtatcaaattgtatactttaaatgtctacagtttattgtatgtcagttatatatcaaaggctgtaataaacagaaaataaaatcagttggacatgaattcatgggtttaaaattagatctcttttgtttgtgtagtgtgagatattttgttcaggaagtcaactaattcatggtcactattttaaaaaaatcatgatgtataaaagtaaagagcaacttaaaaatttgaaattttatcgtgtatttcaaaagtaaaataaagtatagagacaaacccataaatgtagaacattttatatgggaagcaagaattgaaatttgggatatacacacagaccaggtggtctttgctatgtctgaagaagaaagataagattggaagttttataaaaaggtgaaatgttttgtattgttttgaaagaaagctcattggcactagttttggggaggtggcaagctttgattggtgagtgactgcagtgagtagaactagtcttttagagtcacagctcattgtttcagtagctactggataaaactgttttcagatgacaacaggcagtttcagcagccaggcttgcagagaattaccttcttggagcaatgttatgtgtgctgagtgctcttccccccagcctgtcacctgttttagtcagatatgacaagaatgacccaatttatatgattagctttcacacatatataatcagtgttgttattttggtgaacatgcctccagatgtttgttaggcatatataacctgaagatgaatgtttatgggctaatactatgtgtagtctttgttagtatgctgtttttcactcaacattatgtttttggatcactgtttttaaaatttcaggcaaatgtgatcagagtgattatgacttggcagctgtgtgatgatgtcacaggatccttagggtgtcgcttttccagccagaagccactgtggttggtggagcctttgcctgaggtttgcttgtgcctgccaggcttgttctgcttgtttggcctggcaggctgcgttcggctcatgctaccagcctggatcccacacctgccaagggcgagccaggtgcagagtggcgtggcaaagagtgtgtgagcaagcgaatatgggatctggccactgtgtacagccactcatgctggctgctgtggtggggtgggcatctccaggcactggcacaggtgctggcttcatgcaagcttgcggctggatctgatgcatctcaagtggcttccactgtaggaacccacgtctggacgaggataatatggtggtgcccagaagcttggagacaccagaaaccacagagccccaaagagagtgtcacagccctggattgggaaccccctaggtctgggctctcagaagggctgcagctcttctttccttcttgttgcctgcaaggtgctgagtggggtgaggcatattttagctctgtttgtgttacagctgtttcagtcctgccacttggtgggtcttcttatcctgcatccatgaacagtgaggtatggggacaactggagggtgagcaaggtggagaggagcttcattgagcaacagaacagctctcaggagacccgaagtgggtagctcctttctgcaggcaggtcgtcctgacaagtgttcacctctcagtgagatgagaccccgagggggtaactcctttccacagttggtagtcccaggtctcttctgtaagtctggctgagtccagggtttttaatgggcttcacaagggagaagtgtgtgctgattggtccatgggcggctatgggtgggtctggaaaaagcaccatgagtctcactcccctcagtggaccccacctggaactgatagcctggcccccatgcttcaggctgtccctggcttgaaggcagggcttcacctgaacccaccccttttttcccaggagagtgtctgcctcctgctgccatcaatcatgttgtccacagtgtgcaggctgttggtgatgagggtacttgctggccccattgagctgccctcagtcccaccttggcctccttcccatgcttctctgcacctaaagtccagagggggctgagggggcagggggctggtatgtcagtgctgccccgagcacatgcacacctgctgggttgtgacagtgcctgggcttggccacgactttgctccaccctggagcaggtgctgggatcgaggagaggccaggcatgggaacaggcacttctgagtctgcaggggaaagggggacttcccgggccccagagagtgcagggatacctgggtccacagccatggctgggtggctgcagctgcactcaggagggtggggctccagccctgccaacttggaagtgggtgtggctcccacctgttcccagctcccatgggctctgtggagcatgcagccctggctgcatctccccaattgtagccagtgtctttgcagcagctgctctagacagcctgctgctgccatcaatgacgctgctgggagctcgagtaacttctttgttttacatgttttactagcagctggtcctaagtggctagctgaagttctattttatatttggaaggttttaatctttaactttgattttcaaataagtacttgaagataaaaaacaagtctttggaccctaacaataaaagagtcttctctattgttactcctggctatttcttccaaatatatttaaaaacttaccttatgatataaacgaatcgtgtttagcctacattttgagccaccattagataagtatttagataagtactatgtatatatatattttttatttttttatttttttattttttatttttgagttggagtcttgctctgtcacccaagctgcagtgcagtggcgcaatctcagctcactgcaacctctgcctcccaggttcaagcgatcctcttgcctcagcttcccgagtagctggaactacaggcatgtgccaccatgcccggctaatttttgcagttttagtagagacagggtttcaccatgttggccagggtggtctcgaactcctgacctctggtgatctgcccacctcggtctcccaaagtgctgggattacaggcatgagccaccgcacccagcatagataagtggtatattgctatggtttgaatgatggtatcctctccaaaaattcatgttgaaacttatccccagtgtagcagtataagaagtgtgactcttgggggttgaccaagttatgaaggctctgctcttatgaatggggttagcacacttgtgaaaggactcaaggttgaagggagagctctcctgcctttacattccttctgtcatgtgaggacacagtgttcctcccctctggaggatgcagcaacaaggttccatgttagaagcagagaaaagcctcgccagacaccaatcttgctggtgccttaaccgtggatttcccagcctccaggaatgtgagaaatatatttctattgtttacaaattaccccaaacaaaataagaaaaataaaacaacaacaaaacataagtaagtaaataaataaatagcctggtctgtggtatttttgttatagcagcacaaggggaccaagacatataccaaatgaatgagatatatactgattagtatcttacactgtgaaagtgagttctaattgtcaaaattcatttgataaaatatttttctgattctgatttttttttttttagagacaagtttttctgtttcccagactggagtgcagtagcacaatcatagcctagtcactcactgcagcctcaaactcctgtccctcccaccaaaaaaagaattgaaagttattaggaacacctgtggcagaaagtacattattgaaaagaatcttttctagtaaactgtagggacacagtgggcatgaggggataggaaatgtggaacatatgaatacctccagttgagccctggtctgtaattatggaggtatgtattaatagggatgaaaaaggcagggaaggaatgtgtaaggtaggtttgccttggtttttcctgacactagataaatatgaaagtaagaggaatgagagaatgaatgaaatggtaattgagaaaggaaaaccatcagtagaaatgaaaatactcagttttggctgggcgcggtggctcacacctgtaatcccagcactttgggaggccgaggtgaacggatcacctgaggtcaggagttagagaccagcctggctaacaaggtgaaaccccatctctattgaaaataaaaaattagctgggtgtggtggcacacgcctgcagtcccagctactcaggaggctgaggcaggagaatcgcttgaacccaggagcggaggttgcagtgaaccgagattgcgccactgcactccagcctgggcgacagagtgagactccatctcaggaaaaaaaaaaaaaaaaaaaaatagaaaatactcagttttatgacaggagtagttgaggagacgtgtttttcttacagatctaaacctttaataaacatacaaaccttacatgagtttttattaatctgagtatgcatgaaagatgttacttaatgttcaaacctaaaatgcccgaagtagctggctgtggtggtgcttgcctgtagtgccagctacttgggaggctttagctgtagtgcatcatgattatgcctgtgaatagccactgcactccatcctaggcaatatagtgagaccctgtctctaaaaattaaaaaaaggaaaatgctcaaagtaattggccataaattttagtgctgattattcagtgccaataatttacaactgaattatttctataaataaaaatttatttcttctacaaatgggtgtatgttagctttgaaagtgaaaaaaatatttagtgtcaagtgagactgcatgtgttaggttaaaagctagacatttaattgttttgctttaaaatgaattgtaaactgctctgacacttttgtagttaattttttttttctttgagatgaagtttcactgtcgctcaggctggagtgcagtggcatgatctcagctcactgcaacctctgcctcccgggttcaagctattcttatgcctcagtctcctgagtagctgagattacaggcatgtgccaccatgcctggctaatttttgtatttttaatacagacggggtttcaccatgttgaccaggctggtctttaactcctgacctcaagtgatccacccacctcagcctcccaaagtgctgggattacaggtgtgagctaccgtgcccggtcttttaattaattctttataaagctattgccatatttttttctacagctttcaacattatgttttgtatatttaggtctttaattgacctgaatattctgtctgggattttgtttagtatttatggattaatttggaaaaaagagatctttaccaacaaattttcttatccttacaaatatttctttctgtattttaggtattcttctattatcttttaataacatgtaaaatttaaatacatttaatatgggttacaaaatggttaggctgatttttttaaaaaacgtatacatcttatggtagtgatcatttgctaaatctgttagattcaaaaattctaaaagtaaatgctttttagaaaaaaattcagaccatgtagaagtcaataaagtacaaatgaaatctggggtcagtatctttgcagcagtgtgtgctgtccactagaatgtttcatgattatggaaatgttgtgtatctgtgctatccaacatggtaaccactagtcacatttggctttgatcatttgaagtgtggctagtgcaactgatgaatttcaacattttatttcatgttaattaaattttaatagatataattagcatatatgatattaaccagtacagcttaggtttattgtaaaattttacatttctttttatatgtttatattttttaaaggtatcttcaaaaaaagttgtatctattgtgtatatgatatatttttctacaacatattctagattattggtggtgtttggaaatgcttcttaagtttgaatattttctcttatttgactaccttgtgacctacattaacagatagtctttggttattctgcttctctccttcaaaattctaaattcttagaatttgaaataaactgctatttgaatctttatgtcatttcacatattgagtgattggtcctgagttgctctggggcttcctcaaaaaacaacctaaattatggatactaaatgaacacagactactttccttcattttgcccaaatagatgctgttctttgggttctttgatgttcaaacttaactttgaatattgaaggaaatggtacttctaaggataagtaaacatagattcttttttaacagttcatttcacagctcaacacacactttttggagcatatgttttatggttactcttttgccaaatactgggaatacaatattaaataactgttttgcctttaagcagcttgtaatctaattgaggagacagatgtggaaagaaatcacttacttcttcacagtggcattatagaatagaggttaagagtgtgctctggagctgtgtgaccttggttatctatggaagctcagtttccttgtgagtaaaataaggttattagggttcttgtgaggattgaatgagattatttgaatgtttggcatatgttagctaatattactggctactgagcttgaaatctctcgtgcctctattattggcaatggagagcacttgagagatttaagcaggcagatgacatggttggattcatattttaggattatgtgaattgctttgtctgtagtggatcaatagatttgaggaggctatagtgataaacctgttgcgagatgatgacttgatcactttagttatgatagaatggttgggaagagagtgcagtaatacttttcgtgttatcaaggtaagacttgattgatttaatgaagagggtaaaaggagttagagataacatttgaatttttggttttggtgactgatggtggtatttacaaatgagttagggagtataggaggaggatatggaagaggggcttgaaagattgaattgagttttgttcaagcttgagatgactatgatatccaggcaggcatattcaggagacagttggatttatgtttttggtgggtagaagagtcatggctggactccttttgtttctggagacagggtcttgctgtgttgcccagtctggagtgcagtgagtggtgctgtcatgcctccctgtagcctcccaggcttaagcgattctcttacctcagcctcccgagtagctgggactacaggcatgtgccctaccatgcccagctaattaaaaaaaaatttgttttttagagatgggtctcactatgttgcccaggctggtcttggaatcctctgacctcattctctcaaagtgctgggattacacatgtgagctacagtgccttgcctggactctttaattgtatttaattttacatagtttgacgcaatattattcaataaatggtagctattactagcactatttttattattatgtggctggtatttaaagcaaccagtagatgaaactttctaaaaaaaaagaaagagtaaaaagtaaaaggagtgggctggaagctagaacatttaatagatggatagataaagaatgagtatagaatgagattaagaaaaagcagaactaagacaagctctgatgaagtatgatgagtttatataagaatagtcaataatacctgatgcaacagagatatctagtaaagtaatgcctaaaagggtcccctgtatttgaatgggatgtcagtggcgccctctgccaggcaaatcacagtgcaaatatggagacagaagccagaaataaaatgtattagcaaataaatgggaggttgatataacatgggccggttttgctgatgtgacccaagagctaagcagtgatatcaatatcttccaattccaaattttaaaatgtcctttaataaaatatgtggctagtcattttgaacaattatcagtaaaatttttaaaataaaaagcataagaaaaattaagaatacaaagagtatagttctattttaggtatttaggtttaaatctagtttaattctttcagctttctctaattgagttttaatcctcgtttactttgctaatgagatttaaaaatattattttcataaaccttgtaactttttgcttttttattctaaccctgtgatttactcttaatctatttctttataagcttcttaaatttcagtccagctttagtctcaaacattgttgtagtgattaatggttttgcccccccattttcttcctttgtaatatattttaatcaacttttttttaaattggaagagccaattaaatatgttgtttaaaatcttgccatatccacactgtctacctgattggttttgccaattctgtaaaactttacttgatactgttgggattctttggactatgtggcaatatttgtagatttatagaaattttactgatttaattcttggaaggcaattttagttccaagtatttatagaatattttattgtcatctgctatgtaccaagtcttaacttgacattaactgtgcaacattaggcatggcacctctcttatgactgtcctatttcagaacttcacagtctgttcctgcgcctttcaaggcactaagctctgtgctatgctgatcttcagaggaggagcacatttgaataaaaagtgtttgtttcagtctcattaaaaggctcttataaaagttatgaacatttaaaagtgccctttcctccctttttgagctaattgaattcttcattttataggggtagaagattccaggaagagggggcagggatgagtatttatcataattgttaaataatgcgctggacactttttgtgtaatgttatttgatctggatagcaaccctgtgacataggcaggtttatcctcattagagaaattaagtggcttgcccagttcagaaaacaagttaatgtcagaatcaggatgatattgcaggttttttgatttgtatctagtgatttttttcactcagttgttctctttgtaggggctagaggcagaataaagaggccccttccctgtgctccctcttgcttccccgtcttctattctttggagtgtatgtcatttttctccagtaatttagggcagaaaaaaatgttgaggactaccactgtaccattttgttgtctctgatttttaggaactatgttcatggtaagaattgattataaaagaatacctatctatgccattagaaaacaaaacatccaaaatataggctgtgctttgcatcattctatgaaagccatggtgggaagttgggttatagctttctactaagttgaaagtaggctctgtcgcctaggttggagtgcagtggcacaatcttggctcacttacaacctccatctcccaggttcaagtgattctcctgcctcagcctccccagtagctgggaccacaggcgcctgccaccacgcctggctaatttttgtatttttagtagagatggggttttgctgatggggtttcgctgtgttggccaggctggtctcaaactcctgacctcaagtgatctgcctgccttggcctcccaaagtgctgggattataagcatgagccactgcgcccagctaatgatttttaataactttatataatactgataaatcactcttttttttttttttttttaagacagagtcttgctctgtcacccaggctagagtgcagtggctcgatctcggctcactgcaagctctgcctcctgggttcaccccattctcctgcctcagcctcccaagcagctgggactacaatgcctggctaatttttttgtattttttttagtagagacggggtttcaccatgttaaccaggatggtctcgatctcctgaccttgtgatccgcccgtctcggcctcccaaagtgctgggattacaggcgtgagccaccgcgcctggcctaaatcactctttttagtggactctaaataccactgtgatttgataccccttttattcatttataaaaatacataaacagcttccttttttgatgtttaaaaattttatagtcctttctgtcttgaatttgcatttctgttatacttttcacaccagattctattcttatatgatgtattttatgcataagttatattttgcctgtaacatgcatacattatgaaggtagtatatttttatgcattacagtctttcatgcatattgattaccctattatatgtctttgcagccagccaaaatgtgtaaattttaaaatatctcttagtcattaaattgtaattagcacacggtaaaataacaaatgtattaaaatgttgctaaattattttttatttattaaaaaaattttttttctccttctctgccttcaaaatgttgcttctctgccttcaaaatgttggtacattattaaacagaagaaaataggccaggtgcagtggctcgcacctgtaatcctagtactttgggaggacaaggtgggcggatcacttgaggtgaggagttggtgaccagcctggccaacgtggtgaaacttcgtttctacttaaaatacgaaaattagccgggcgtgggggtgcatgcctgtagtcccagctattttggggactgaggcacgagaattgcttgaacccagcaggcagaggttgcggtgagccacaatcatgccactgtacttcagcctgggtgacagagtgaaactctgtctcaaaaaaaaaaataaaaaaaaaaaagtttcacagacaaaatatgaatcattccttgtttaacacttaaaaggtttttatactcaggcaatagaatagtgtatagtttcattcacaataggtgaggagtatgtcatcctttttatattaataaaaagtgagaggagcccagatggccgaataggaacagctccggtctacagctcccagcgtgagcgatgcagaagacgggtgatttctgcatttccatctgaggtactgggttcatctcactagagagtgccagacagtgggcgcaggtcagtgcgtgcagcgcaccgtgcatgagccgaagcagggcgaggcattgcctcactcgggaagcacaaggggtcagggagttccctttcctagtcaaagaaaggggtgacagatggcacctggaaaatcgggtcattcccacccgaatactgcacttttccgacgggcttaaaaaacggcacaccaggagattatatcctgcacctggctcggagggtcctacgcccacggagtcttgctgattgctagcacagcagtctcagatcaaactgcaaggcggcagcgaggctgggagaggggcgcccgccattgcccaggcttgcttagctaaacaaagcagccgggaagctccaactgggtggagcccaccacagctcaaggaggccttcctgcctctgtaggttgcacctctgggggcagggcacagacaaacaaaaagacagcagtaacctctgcagacttatatgtccctgtctgacagctttgaagagagcagtggttctcccagcacgcagctggagatctgagaacgggcagactgcctcctcaagtgggtccctgacccctgacccctgagcagcctaactgggaggcaccccccagtaggagcagactgacaactcacatggccgggtactcctctgagacaaaacttccagaggaacgatcagacagcagcattcgcggttcacgaaaaaccactgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggatcgcagttcctcaccagcaatggaacaaagctggacggagaatgactttgacgagttgaaagaagaaggcttcagacgatcaaactacgagctacgggaggaaattcaaaccaaaggcaaagaagttaaaaactttgaaaaaaatttaaacgaatgtataactagaataaccaatacagagaagtgcttaaaggagctgatggagctgaaagccaaggcccgagaactacgtgaagaatgcagaagcctcaggagccgatgtgatcaactggaagaaagggtatcagcaatggaagatgaaatgagtgaaatgaagcgagaagggaagtttagagaaaaaagaataaaaagaaacaatcaaagcttccaagaaatatgggactatgtgaaaagaccaaatctacgtctgattggtgtacctgaaagtgacggggagaatggaaccaagttggaaaacactctgcaggatattatccaggagaacttctgcaatctagcaaggcagccaacattcagattcaggaaatacagagaacgccacaaagatactccttgagaagaccaacaccaagacacataattgtcagattcaccaaagttgaaatgaaggaaaaaatgttaagggcagccagagagaaaggtcgggttacccacaaagggaagcccatcagactaacagcggatctctcggcaaaaactctacaagccagaagagagtgggggccaatattcaacattcttaaagaaaagaattttcaacacagaatttcatatccagccgaactaagcttcataagtgaaggagaaataaaatactttacagacaagcaaatgctaagagattttgtcaccaccaggcctgccctaaaagagctcctgaaggaagcactaaacaaggaaaggaacaaccggtaccagctgctgcaaaatcatgccaaaatgtaaagaccatcaagactaggaagaaactgcatcaactaacgagcaaaataaccagctaacatcataatgacaggttcaaattcacacataacaatattaactttaaatgtaaatggactaaatgctccaattaaaagacacagactggcaaattggataaagagtcaagacccatcagtgtgttgtattcaggaaactcatctcacatgcagagacacacataggctcaaaataaaaggatggaggaagatctaccaagcgaatggaaaacaaaaaaaggcagggcttgcaatcctagtctctgataaaacagactttaaaccaacaaagatcaaaagagacaaagaaggccattacataatggtaaagggatcaattcaacaagaagagctaactatcctaaatatatatgcacccaatacagaagcacccagattcataaagcaagtcctgagtgacctacaaagagacttagactcccacacattaataatgggagactttaacaccccactatcaacattagacagatcaatgagacagaaagtcaacaaggatacccaggaattgaactcagctctgcaccaagcagacctaatagacatctacagaactctccaccgcaaatcaatagaatatacatttttttcagcaccacaccacacctattccaaaattgaacacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaaatagtgtgtagagggaaatttatagcactaaatgcccacaagagaaagcaggaaagatccaaaatttacaccctaacatcacaattaaaagaactagaaaagcaagagcaaacacattcaaaagctagcagaaggcaagaaataactaaaatcagagcagaactgaaggaaatagagacacaaaaaaccgttcaaaaaattaatgaatccaggagctggttttttgaaaggatcaacaaaattgatagaccactagcaagactaataaagaaaaaaagaaagaagaatcaaatagacgcaataaaaaatgataaaggggatatcaccactgatcccacagaaatacaaactaccatcagagaatactacaaatacctctacgcaaataaagtagaaaatctagaagaaatggataaattccttgatacatacaccctcccaagactaaaccaggaagaagttgaatctctgaacagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatacccttgatgaacattaatgcaaaaatcctcaataaaatactggcaaaccgaatccagcagcacatcaaaaagcttatccaccatgatcaagtgggcttcatccctggatgcaaggctggttcaacatacgcaaatcaataaatgtaatccagcatataaacagaaccaaaaacaaaaaccacatgattatctcagtagatgcagaaaaggcctttaacaaaatttaacaacccttcatgctaaaaattctcaataaattaggtattgatgggacatatctcaaaataataagagctatctatgacaaacccatagccagtatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcatttttatacaccaataacagacaaacagagagccaaatcatgagtgaactcccattcacaattgcttcaaagagaataaaatacctaggaatccaccttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttagagatttaatgccatccccatcaagctaccaatgagtttcttcacagaattggaaaaaactactttaaagttcatatggaaccaaaaaagagctcacatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctagccatatggagaaagctgaaactggatcccttccttacaccttatacaaaaatcaattcaagatggattaaagacttaaacgttagacctaaaaccataaaaaccctagaggaaaacctaggcattactattcaggacataggcatgggcaaggacttcatgactaaaacaccaaaagcaatggcaacaaaagccaaaattgacgaattaaactaaagagcttctgcacagcaaaagaaactaccatcagagtgaacaggcaacccacaaaatgggagaaaatttttgcaacctactcatctgacaaagggctaatatccagaatctacaatgaactcaaacaaatttacaagaaaaaacaaacaaccccatcaaaaagtgggtgaaggacatgaacagacacttctcaaaagaagacatttatgcagccaagaaacacatgaaaaaatgctcaccatcactggccatcagagaaatgcaaatcaaaaccacagtgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtgtatacccaaaggactataaatcatgctgctataaagacacatgcacacgtttgtttattgcggcgctattaacaatagcaaagacttggaaccaacccaaatgtccaacaatgatagactggattaagaaaatgtggcacatatacactatggaatactatgcagccataaaaaatgatgagtttatgtcctttttagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaggggggagcgatagcattgggagatatacctaatgctagatgacgagttagtgggtgcagcacaccagcatgtcacatgcatacatatgcaactaacctgcacaatgtgcacatgtaccctaaaacttaaagtataataataaaaaaataaaaataaataaaaagtgaattttaggccattttctgttacttagaatacctgaaactgggtattttataagaaaaggaatttatttcttacagttatggaggttgagaagtccaaggtcaaagggctgcacttggtgagaaccttcttgctgatagtgactctacagattcctgaggtggtgcagggtatcacatggcaaggggcctgaacctgctaatggtagctcaggtctcttctcttcttttaaagccaccagctcccctcccatgataacccattaatccatgaatggattaatccatttatgaaggtggagctctcatgatccaattacttcttaaaggccccagctctcaatattgccccgttggggattaaatttcaacatgagatttgaggggggtcaaatattcaaaccatagcagtgggtttaaaggtacttgtgaaagaggagaccagagaggaaaatcaacatgacctttcaaatggacctatgatccattttcaggcagattaattttaaattttatgaaagggttgagtatgaatgagaattgaagacctgggaattgttgtccattgttgtttatctatttctgtgtacccttcagaaagtctgtttaccttcagcagtacaaatatatggtactgtgaaagatccctgatctagtatttatagcaacctgtattttatgaccagagaaactgagacttaaagatgtagagtacttgcctatggtcacttagctagtaaatggtcaatcaaaaactccaaaacttgaggccgggtacggtgactcatgccagtaatcccagcaatttgggaggctgaggtggttggatcacttgtggtcaggagttccagagcagcctggccaacatgttaaaaccccttctctactaaaaatacaaaaattagccaggcatggtggtgcgtgcctgtaatcccagcttctggggaggctgagacaggagaatcgcttgaacaggttgcactgagtcaagatcgtgccactgcactccagccttggtgacagagtgagactctatctcaacaaataaacaaacaaacaaaaaacacacaaaccctccaaagcttttctttccctcctgtgtcatgctacttagtacatagcctggttcacagtatatgattactatatatttaatgaatgatttacatattatttgtgaagtccaaaatacttaacgttgtagttgttccatcagttttgaactgctgaataagtgtgacattacagatgattcactacagaagaatattgaagatcttcaaagcattgttaaggtgatctcctttcagttcctggagtggtgttcctggaaatgactaatagaacagcaaaaaaccgtctacttgggcattcttggtgttttatcaattaagtcagagacctataacagtgttggagtgcttgttttgaagaggtcagctaacttacgttgacactgtgtgtgtatgaagagtgtaattttcgtttctgttatacaggtattctctgaaaccaaatgaccaaatcttggctgaagacaaacacaaggaactgtaagtgcattaaaccattggttgtaaatagtttactctgtctatgaacttgatatatgtatatgtaaattatctgattttcaaaattatataatgacaaagtataattaacactatgaccttaatcctaacaattatgataacctacactatataatttacactacataaagtttacacaggacataatttctcctgtattcacattaaaagatgtagtgttgtattccatcatctagactaaagtcttactgggaaatatgtcatgctattttctctttccagataaaatattaaattgttcctattttctttctgactgctctaccagaaaaaagtaaaaaataaaaataaattgtcactcttaatttttgggtcttactccggtggatcacccaccttcatggtaatgatagacaaatataattttgtttctgtcactggtttatgcaaaagtaaatgtcaattgtttggtacaaggtaaaacactttattttatttttatttttttgaaacagagtcttgttctgctgcccaggctggaggcgcaatctcggctcattgcaacctctcattcctgggttcaagcaattcccctgccttagcctcccaggtagctgggattacaggtgcccgccaccatgcctggctaaattttgtattttaagtagagatggggttttgccatgttggccaggctggtctcagactcctgacctcaggtgatctgcctgccttggcctcccaaagtgctgggattacaggtgtgagccactatgcctggctgaagacattttattttcacatctaactcaggtcgctcttggtttagtttaatgtaaccttcacttgtactcatttatagggacagtaattttttttcgtagaggacttcaagactattattttcttcttgagattaagtaataatttttttccaagtacttttaaactgctttttaaaaactgtcttgaaccttttgtaaattattttcttctctcctatttaaggtaacataaattgttaattataaaatggcaggaccaatgttcagggaaaggattttcttatgcgttcttaccgtttacacattccactattatgctaacctttcatcagtatttttatatttggcctatccttatttgagtataatctccatagtgggttctcaaatatatatattgtcaagaaatttttttgctctttctttatttcctagtatagtcagtgagggccggtgattgttactgtagcattggttggttattatttataggtctggtaacagagcttcttttgctttgggaattaagtagttggtgagccttaaaagttcctttagtccttagactatgaccaatattaaaaataccagaaatctgcttttaaagaatatgttatttaatatgtaacccattttaatgttttaattcatttgaaagtttttttaactgtccaagatataattcatctctatgggtataacttggcgaactgatacttttttcttacctttttttttgtttttttgagacagactcttgctccgtcacctaggctggagtgtggtggcatgatcttggctcactgcaacctctgcttcctgggttcaagcgattctcctgcctcagcgtcctgagtagcagggattacaggcacccgccaccatgcccagctaatttttatattttagtagagatggggtttcgccatgttggccaggctggtcttgaattcctgacctcaagcgatccacccacctcagcctcccaaagtgctgggattatcacaggcttgagccaccgtgcccagcccctacattttattacgaaaagttttaaacatatgttatgtgttcacccatatatttaccaccaaggttttatcattaacatattactgcacttgttttatctatttattcttctgttcgtgcattacttcatctgttttttggatgcatttcgaagtaaattgtagacatcaatatgcttctctctaaatatttcaacacatataccattaactagagttttatatttcaaagttttttttttttagtttcacctgttctaaaatttcttataaactgagtcatatatatgtcctattttgtataaggcttctgtcactccctgtgtttttgaaattcatcagtgttgttgcatatatcagttaattccttttcatttttgcagattaacattctgttgtttatttgttctattattgctaagtattgccacttgtttgatttgtcattattgatggtcttgatatttttggctgctggctctcttccttgtagtttttgacctacataccaaagaaaactttcagttgaatatggcaccataaaagcagagtattaattttaaaaaattaaaacagttattgaattaatgaatttcatgaattatgaaagctgtttataaataatctcatttgtgtctttgcaactcaaatagccaaaatcttggtagggtggtggtcatggaagtcagagtctgctaaggagtgtataacaactcacctgctgtattaaaaacaaaaaaatctttttgtgttcaagactaagctttaaacaatataagagatatggatataaaacaaaattttatctaatcagtaattccatgctttattctcataaaacattattacaacttcttaatttcagtctgttaaagcttgattaattataaaattgtaaaaatgtgttggcaccatcacattgacctgctctttgaaaattaaccctaattctataagagtaccaataagagagtacagtgatagctctaattatcttgatattaataaataaagagtggcctggcatggtggttcacatgtgtaatcccaacactttgagaggctgaggtggaaggattgcttgaggccagcagtacaagaccagcctgggaaacatagtgagaccccatctctacgaaaaacttaaaaaaggccgggcacggtggctcacgcctgtaatcccagcactttgggaggccgaggtgggtggatcacctgaggtcaggagttcaagaccagcctggccaagatggtgaaaccctgtctctactaaaaatacaaaaattagccaggcatggttgtgggtgcctgtaatcccagctactcaggaggctgaggcaggagaattgcttgaatctgggaggaaaagttgcagtgagccaagatcacgctactgcactccagcctgggtgacagggcgagactctgtctcaaaaaaaagaaaaaaaaattagcctgatgaggtggtgtgtgcctgcagtcccagctgctcaggaagctgaggcaggtagatctcttgggcctaggagatcaaggctgcagtgaaccatgatcattccactgagctctggactggacagcagagtgagaccttgcctttaaaaaaataaaaaaagaataccaataagagagtacaatgatagttctaattatcttgatattaatgaatattaagtatgttttcattaaaacatttttagttcctgaaattttgtgattcagatttcatatacacttagtcactgatgcttcacgagtatacttgtttctctgtctgaggaagattggcatgggaaaacagggaaatattggtcagcagtgacacttgtttttctaagcaaagtggtttttctcaacttcctgtttttcattattctacatactgaagaccttgggggatgattttaagtagagaaagctgagcaattcaagttgtgatgtgatttatctaaaactataggatttatagtttgttctatacatgatccagtaatcaactggtttcattagctttctagtttttttcagttttagttttgtaaatggaataatttaaaataaattaggaaaacatcactattttactaagtattttttcacctactttccattgtgctaggcattaaagaaaagatagtgtgcagctttttatatgtcaattatacttcaataaagcggtttaagaaaaagtaaaagatactgattttatttataaatggaatcttactctccaatagtggcttttcaaaatctttggacacatctgcagttattgaaaatagaaccattttgtttccatgaatatctattttatgaatatataaattttgtattaccttggattatgagatctgatcatatagatttaggtaaggaaagttaaaagttgtctggagttaggggtgaattccaaatgcaaatataaataaattcagaagtatccatactacttaacacagagtaacctggtatctgaagattttttttttgtttgctataaggcaaggggaaaatctctttaaaagggattcacatttatttacttggctttttaagatagctaccaaggtaaacagtgaacttttgtaagcagtgtatactgttctaaatatgaagtgtattttcccttctgatagtgaatgaattccattatgattttttaatgtcaaaaattaaattattttgtcagaataaccccttaaatttttaaatgttgtcttataaaagttaattatattgtgatatttaaatgcttgccaatttacgattatgatgagatggaagaaaataaataaattatgcaataggcatgaaccttcaagggtattaggacgtgctcaggatatgatctttggtgcagtgtaaaaatgtaatttcttagtgaataggtcaatttccaaaccagcaggaaagttataagtatttaaatggaatgtgtagggatatgtcagggaagttagagacaataacatctggtatgctttttttttttttttttttttggtgagatggagtctcgctctgtcgcccaggctggagtgcagtggcgtgatctcggctcactgcaagctccgcctcctgggttcacgccattctcctgcctcagcctccagagtagctgggactacaggcgcccaccaccacgcccggctaattttttgtattcctagtagagaaagggttttgccgtgttagccaggatggtcttgatctcctgacctcgtgatctgcccgtcttggcctcccaaagtgctgggattacgggcgtgagccaccgcgcccggtctggtatgctcttaaattaattgttaatgctgtgacttagcagttctttgaaatcatcaagatcatagactgggcttgtgcctataatcccagcactttgggaggctgaggcaggaggattgcttgagtctacgagttggagaccagcctggacaatatagtgagactcttgtctctacaaaaagttaacaaaagtagccggatgtggtggtgcctgcctgtagtcccagctacttgggagactgaggtgggaggattgcttgagaccaggaggtccaggctgcagtgagctatgatccgtgccactgtgctccagcctgggtgacagaatgagaccctgttaaaagaatcttttttttttttttttttggtaagaatgagctaagaactggatatctgtaaagctaatagaaaaaaatcctgtgaagcaaaaagtcaaaattgaaataagctaggaccgacagcaaggttaaatgcttatttttttttagtgttcataaataaggtacagttttaaaaatatcataaacatttttatgatcctattctcagggcccggttttttttgtatctttaaaattatagtattttgattctagaaatgaacccttgaaccaatatccgtattttatcatgaataaggtgagagtaacattgataaaatgacttgctatagtttacattgctacttaaggacagtactagaccagaaaccaagtctcctgagtcccatttaagtgctgtttttgtcacaccaagcagttctctaagtatatagtcttttttttttttttgaaacagggtctcgctttgtcacccaggctagaaaacagttgcatgatcatggctcactacagtcttgtttttagagatgaggtctccttatgttgctcaggttggtctcaaactcctgacctcaagcagtcctcctgcctctgctcccaaagtgttatgattacaggcatgatctactgcacccagccagtaacttttttttttttttttgagacggagtctcactctgttgccaggctggagtacagtggcgcgatcttggctcactgcaatctccgcctcccaggttcaagtgattcccctgcctcagcctcctgagtagctgggactacaggtgcctgccaccacgtctggctaatttttatatttttagtagagacagggtttcaccatattggtcaggctggtctcaaactcctgacctcaggtgatccgcctgcctcagcctcccaaagtgctgggattataggcgtgagccaccgcgcctggccgccagtaatttttttttttaaagggattaatatccattgcaagacttggtaacggatcacagagaactcattagttaattaaatcagtttcacagtattgtgttttggttttggaaatcacttcagacctataaccaatattgagtgagttgaaaagaattaattacttccaaatacaaggcactttacattcttctaaggagaggatgcaacacaaagctatttggtcagcttgatacaaaagctcttaggtgtgctcatgaagtaagtcaaatgtatacattttacaaccacatattaaatagaattagttttttctttttccttcccatttctttgaacagtcttattcagaatcttcatcattagcaactttgtcatcattggagcccttttctctagaacacatcagcctctttctatgtatgatattttcgctggaaattttatcctgagctataaatgcctctcatgtaagaaaagttttttttttgttttttttttgagacaagatctaactctgttgcccaggttggagtgcagtggcgtgatcatgactcactgcagccttgaccttgtgggcttaagcaatcctcccatcagcctcctgagtatctgggactaccactgtgcaccaccacacctggctaatttttgtattttttgttgagatggggtcttgccatgttgtccaggctggtcttgagctcctgggctcaagtgatatgtctgccttggcctcccaaagggctgggattacaggtgtgagccaccatgcctggccaagaaaagttttttttaaagtttatttttgtatgtagtcataatacttgtaaggtaaccttttcactgtattgctttttaaactaaggtttaaatagttcattgtaataagagttaccgtttgtgcttataaggctgcatctccaggagtaagtactaaatctgtgttagatttctttgctgcttttttttgtttgtctttttttttttcttttactgatatggtcaggtggtcaggttacttccgtaaggatccaaaactagagttgattgagatcatttcaggcttatacataatctacaaatgattctcaaccaattgagatctgagttcacctcttttgctgaacttttaattgtgatcttactgtaaaattctaggatctcataacttctatgaaatttttatacctggattataaaacttcggaaagatttgcttaaatattttgttgcttaaaagaaaataattggccgagtgtggtagctcacgcctgtagtcccagcattttgggaggctgaggcaggtagatcagttgagctcaggagtttgaaaccagccttggcaacgtggcgaaaccctgtctctactaaaagtataaaaaaaattagctgggcatggtggcactcacctgcagtcccagctactcaggaggctgaggtgagaggattgcttgagcccaggaagttgaggctgcagtgagcaaagattgcacaactgcactccagcctgggcaatagagtgagaacccgtctcaaaaaacaaacaaacaacccccccgcaccccccccccccaaaaaaaaacaaacagaaaataattaacactgtcatcaaggaaggtaactcattataaggatttaaaaaaaaaatttttttttgagacggagtcttgctctgtcacccaggctgaagtgcagtggcacaatcttagctcactgcaagctccacctcccgggttcacgccattctcctgcctcagcttcccaagtagctgggactataggcgcacgccgccacacccggctgatttttctatttttagtagaggcagggtttcactgtgttggtgaggctagtctcgaactcctgacctcgtgatccacccgccttgccctcccaaagtgctgagattacaggcgtaagccaccgcgtctggcctataaggaataattttgtgattaaacatggtcttatattcatgaacgataggtgaatgaaaaatgtgtgttattggtggtaaaatcttaaaatccttaaagaattaatttaaattgctaccttctacttatgaagcactatatggtgccctggacttagcattagaagaaacttagtttatgtatgagttttgccataggctgtagtcttggggtattagttagaattcaatgccactatgatattaagaaatttattacaggaattaaatcttattcaatcatgagaaaaactggggatattaaggtccctaaaatgtgagagaaaaatcgctaaactgccttttgatgtaggttaatgaattgcgtgttctgttaatagggaaactgtgaaggaggttcgtgtgttgtgggctctttgcaactaccacctttatgggcctttagtgaaaaatctggtgataggcttggtcctggtagttgtggacgtaaggtagagtggggatgagtaaggacagattacagttctgcccatacctttgtgtctgtccttcctgcctctaaccaatgactgcctttggaatgtaatggctactgcttcaattgcatcccctaaattttttgcaaatttctcttgtgacatatcttaagctgaaaccatataggagaggaaattaggggaagtgtactccttcttgacatagtttaataccttaactttgtttaatcacttagtcttccaaacttaagttcctccgatatcattttgggtttagattagtgcttttctgtcattgtccattaaacaaatgatttctttcattacctacttctcttttagtctgttcagtgatccctctgggtatagcttctgaatttctagcataaaactcttcaacaataacaaaaaaggataatgatctttcctgtcaatttttagggggaaggataaggtgtttcctagaaactttattcagagcactttagtcaaagtgtagttcattgatccttaactgcaatttacttgacaagatatatttatgggatgaaatttattgagggtaacagaatggagagagaaactgctggtgtgatgaattctctttcttcttggtctacaacaaacagaaatattttgagaatgtagctatggcagattttaatgtaagagttatgccaacactatttccccttaagggttgagtcagaccttttgggaatgatatagacttgggggtcttgagtgaacttttagtatttattagcagccaatctaaccttgaaaactctatgttgatttctttttggaaagtgttgaacaattaaataatacatgttaaagaacaaggaagaagggcattgttttaattattttgtgatctaatttaatccccacagcaactctgtgaagcagatattgtaatcattcccattttacagatgaggaagagacttcgtaacttggtttatataagaaaaggatagaactgtttagatctttttgattgctttccattttgtataagttcagtgacttaggaaccttttttaaaaaacttctttggaggagtgatattgttcattatgaacatacctacttgaaaagtatttaaaggtatttttcatggaaattatattttataagttttagtatggttcactagaaatacgtcacaatttgtaggtaatactgtgttttattttgagttggctaattgttaaggtaaaactttagaggataaagtgagctcatattgatgaatggtaatctgatatttccaacagactaggtctttttttgaagttcatgtattataactttattctttgtgatactagctccctctgtagaacttcaataagattgcaactggactttttcaataatttagaaaagtgatctaaacattatctataacatttccctgtaaaattttactttgtattctaatcagttgcaagtgggtttttaaaagtataaatgtaacatttataaaaatgtttcactttgtacacacaaagttttaataacatatacaaaataaaactttcttcaaacattcctataactttaatgcttttttatttaggaaggctagagagaggtgtgatttctaggtctgtaggtctgtgttgagtaaagcctgatggaagccctaggggaaaaataaattttgacgtttagctggatacttgaaattatcccttttttttttttttttctgaaactttccggtttgacttgggtgggaaaatgttcataagggattttttttttttatcttgtagagaaggggaaagcaaacttctacaacaggtagaaagagcaaagagaaaatcttagcaagatccagaaatttagtggagaattgcaggaaaacattcttgacatttacggtttaaaaaaattttcctttttctttttttcttaagaggtggtctcactctgtcgcctagactggagttgagtggcatgatcatagtgatcgttccacctcagcctcctaagtagctgggactacaggtatgtgccaccacgcctggctcctttttgtatttttagtagagatggggttttgccatgttgcccaggctggtcttgagctcctggactcaagtggtctgcctacctcagcctcccaaagtgttaggattacgggcgtgagccactgcaccctgctcacatatatgagttctatgagtttatgctgttgttggaaaatcctttgttatcaaagtctaccaattttcctgtgtgggagtgagcttacttattttaccaccactttttctcctttctttctgctatggtttgaatgtttgtcccctccaaaactaatgttgaaatttaattgccattgtaacagtaataagaggtggaggcctttaagaggtgattagatcatggggctctaccttcatgagtgcattaatgcaggagtgggttagttatctcttagagggttgttataaagtgagtctggcccctcaagcacttgcttgctgtttgccttctgccatgggataatgcagcaagaagttgctgagcagaagctggcaccatactctaggacttcccagccttcagaactgagaaacatattaatgtttctttcctttataaattacccaatctcaggtttctgttaaaagccgtagcaatcaaactaagacactcccctaaaccattttatattaaattgtaagttgtataattagctcttcaaagatgttttctcagacataatgtaagctcaatgaaggcagaggaaatatgattgacttgcaacatggaatttagaaaaatgagcgaactgatttcaaccataaagctagggactaaaacatacaaatgaggataagaaagaactgaagtacatatgctctttcagtttctaaaaatttaactgtattttcttctaagtagattgaaggatgttcttaggattatgcttgagtaggcttttaaacaattttgtgtggataattatctttgaagcctttgttagtactaaacatctttattctgttataatacagtttattcaaacagacgtacagtgtgtattgtggcacaaagaaattcaagaatgattcttattctttttgtttgttggccttgactaaatttgataccagataattgctttaaaggataggccaattttattggtataacaaatctacccttcattatccataaaccacttatatagtaatctggttttcctatacaggcacaccttggagatattgggggtttggttctagactatcacaataaagtgaatatcacaataaagagaaatacatgaagattatattccccagtgcatataaaagttgtggtgatatcacactgtaatctattgtatacaataacattgtgtataaaaaatgtatatgccttaatttaatgtaatctattgtatacaataacattgtatataaaaatgtatattccttaatccataaaaatactttatggatgaaaatgctaacaatcatctgagcctttagcaagttacaatcattttgctggtggagggtcttgcctcagtgttgatggctactgactgatcaggatgttggttgctgaaggttggagtgtctgtggcaatttcttaaaataagacaataatgaagtttgctgtgtcagagccttcctttcatgaaaaatttctctgtaatatgcaatgctgtctgatagcatgttacccacagtagaatttggaaaattggagtcagtcctctcaaaccatgctgttactttatcaacttaagtttatggaatattcaaaattctttgttgtcatttcagcagtgttcacagcatcttcaccaggagtacattccatcttaggaaaccactttttttgctcatctataagaagcaactccctgtccattcaagttttatcatgagattgcaacatttcagtatccatcttcaggctccacttccaattctagttctcttgctatttctaccacatctgcagtgacttcttccctgaagtcttgaagcgctcaaagtcatccacaagggctggaattcacttcttccaaactcctgttaatgttgatgttttgacctcctcccatgaatcacgaatgttcttaatggcatctagaatgatgaatacgttgcaggaggttttcattttagtttgtctgatccatcagaggaatcacggtctatggcagctatagtcttgcaaaatatatttcttaaataataagacttgaaagtcaaaattacttcttgatttgggggttgcagaatgaatgttgtattagcagccatgaaaacagcattcatctccttatacatctccatcagagcacttgggtgactgggtgcatcatcaatgagcagaaatattttaaaaggggccaggcatggtggctcatgtctgtaattccaggactttgggagactgaggcaggcagatcacctgaggtcgggagttcgagaccagcctgaccaacagggagaaaccccgtctctactaagaatagaaaattaggtgtggcagtgcatgcctgtaatcccagctactcgggaggctgaggtaggagaatcgcttgaacccaggaggcggaggtcatggtgagccaagattgcaccattgcactccagcctgggcaacaagagtgaaactccatctcaaaaaaataaaagcctagcctcccaaagtgccaggattacaggcatgagccaccgcgcctgtctgtccgcccgtcttcttttttaagagcaagaaaaggtttcccagaagtactctggtagattcttatcacacacacattcctaaaccagttactggcaaagaaaatagaattatcatgattaattagcatattctgaagtacatgcttccttataactgaacaaaaattagagctccactggcaacgcggaaatggctgttgacttggcaactaatagtgaattgctcacaatgtttaagtgaaatggcctgtcagatttcctgggaacacaggaaccagggccagacttagaaacggcctcagtaagaggttttctaaaactattttctggtatcgtaattattcctaattaccttgtgcactaaaaaaatttaaaaattttaaatttagaattttaaacacatttcctgacagtaaccaagatataaaaatgtgtaaaattgagtgaatatattttaaagcatggaagatttgtgttaccctcagacttgaaagggaacctgcaaagttatggtctcatgggaaatattgtttctttttgccttgacataattttcaggctctttggttttattctaagcaacccagcagggcacctttaaaaagaaacaaacaaaattactgtctctaaaccaaagaagatagaaaaatacattcaggagaatagtatacattgaaaactgccactttagctagtgcttttttttttttttttttttttttaagacggagtctcgctctgttccaggctggagtgtagtggtgcgatctcagctcactgcaacctccaccttccagtttcaaatgatacttatgcctcagcctcctgagtagctgggattacaggggccagccaccatgcccagctaattttttcatatttttagtagagagtactttttaactgagaagagatgctgtaaagttttaggaaatcacagtggggacagtagtcatacttctactttcttctgaatataatattgtttcttttttctcctgcagttacttattttttttttctttttgctttaaggcttggtagttctgagaattttagattcagttataatcgaatgtaactatcaacacatgttatggagtagtataaattgttacttgatgtttggagttgttttactcagtcactcagcaaaggtaagattagatctccgttagatgaaaagtattatctcttatgcaaagagacattggttagctctggatgaagacaatggctatggggtcagtcaaccttgtagaaagaataggctaggcacagtggctcatgcctgtaatcccaccactttggggtggtcgaagccagtggatcacttgagcccagcagttcgagaccaaactcggcaacatagtgagagccccctctctacaaaaaatttgaaaattagccagggcatggtggtgtgtacctctggtactagctatcaggaggctgaggtgggaggatctcttgacctggggaggttgagtctgcatgcagtgagccatgattgcgccactggactccagcctgggtgagaaagtgagaccttgtctcaaaaaaaaaaaaaaaaaaaaaaaaaagacacaataaaagtaaaattgtataatctctggaaaaaacaaaataggctgtcatgttctaatactcaatatgtaaggatgtttagtatattagtgggtataattattaataaaatattctatttagttatctttgaaccagtttgtaataaccaaaccacaaaaattcaatttgctttgtatgtaaaaatcttttaaaatagaaagtcctgccttaactttcataaatctgaatgtgagcatatatttatgcttttcatttctttgcacagctttttttttttttcctctaagacagagtctcactctgtcactcaggctggagtatagtggcacgatctgagctcactgcaacctctacctcccaggttcaagtgattcttgtccatcagcctcccaagtagctgggattacaggtgtgcaacaccatacctggttaatttttgtatttttagcagagacagggtttcgccatgttgtccaggctggtgcacagcattttgttgttgatgtgtgagacttgtaatataacagtaataatgctgtcatttcttaaagatgatatataatcctatcaaaatattcctgggaagtaggtatttgtcagcctgtcagtgttttccttttattttgtgtgtgtgtgtgtgtgtgtgtgtgtgtctgtgtgtgtgtgtgttttagtacattctcccagatgctgaaattttccctttaaactgttactatgatgtatgtcttatttctttctcttttttggtcctaattatgctctcaggagttaagacagtataaaattatgttttttaaaggaaacttcatcaaatacttggaaattagcaaatattttttagaggtagaaactgtcatttatattcctaagacttgtaggccattgtatttgttgactgactgatttgactgagaacctagtgtgtgataacgtgtcactgtttctgtcaacttatataattgagggtctttttaattgttcttaccttagaccactatatacttgtggtcttataaagtatatttgaaaattatatgcattttcatgttttgtctgggcctgggaaaaatatttattttaaaactgtaacatcttaacctttaaaacccattgtcagttatttggaaaaattagtattatatgatatgaagcacttctttttattgctgatttcaggtttcactatctgggaaactccggtgtggagacataggtctgttaactgtcttctttgttttatctggaatgttttattgatactataaaacaaaacttatcagtaagactgatttggaattcatattgtttgacagcattatcactgtcaataattatccattgtcagtatttgtaaagcagaataaaagaagccattatttaagtttaattcctgagatgattcagcatacggtgtaatatcaatctgtgggaattttattttaaactttttcttagtaaagtttactttttagagctgttttaggttcattcacagcaaaattgagcaaagatacagagatttcccataatcctcctgccctcacacatgaatagcctcccccattttcagcatcccccaccagagtggtacatttgatacaattgatgaaccaatattgacacatccaaataaaactattttttggggaggggagacggagtctctctctgttgcccaggctggagtgcagtggcgagatctcagctcactgcaacctctatctcccgggttcaagcaattctcttgtctcagcctcctgagtagctgggactacaggcacacgctaccatgaccggcaaatttttgtatttttagtagagacggggtttcaccatattggtcaggctggtttcaaactcctgacctcaagtgatccacccgcctcggcctcccaaagtgctgggattacaggcatgagacactgcgcccagccgataaaactcttagaacaagattaattgattgattgagacaaggccttgctctgtctcccaggctggagtgcagtgatgcaatcatagttcacagcagcctgcagctcctggcctcaagtgatcctcctgcctgagcctcttgagtagttgggactatagcttgtgctactgctcccagaagtctcttatttaatctgtctcttctaaagtatagatgtatagttcatacctttagaaatttctgagtttttatggtggttctgcaaataaacctgtttgcttcttatttctgccttcccttccttctgagcctttggtttttgattttctcttatatgctggttcagctatccttgtttctgttgctttaaagccttcaacatattatgaacattttccaccaaacatattgttcttatgagtacatcgtaattttagggcaagaagcagagatgaactttgctttaactcttttgtgttgaagtatgctaatggcaagcatgttttttaaatataaaagttgtacaagttgagatgtttaattcctttactttaagaaaaagcatcataattagaagggagaattgctgttatctggaaggtgttcagacagtttggggagaaaaaaacaaccaaaacagctgcagtgtaatttccataagggaatgggcttatatctttgtttatttgtgtttgttttccattgtacactcagtgcctagcacggggtaacacagtatgtgattaaccaacagttattggaaaaatatattttagtgtgttattttagataattaaaagtacatttaggaaatatgcaacctttttgtttggctttattaatcagctttaaaatgctgatgatagaagcaggaggcagagaaattataggcaaataggggtgggtccctggtgaaaccccacctccaaggtgaaaagcttgaaaccagcagcccaaagtgagaacttctattcctgtttgcctgcactgtcctgattggttctttctgaataatgtctttttaccaattgaatgttgccttttccaaagctacctatggcctgccccacccgcatcctgtgcctgtaaagccccggactcagtaggtagagaggagagattctgccagactttcgggaaaagagatggcttgacttcggggaagagactactgctgtacttcagggaagaccacctactcttcccgtcccctctccagctcccctctccactgagagccatttccaccgctcagtaaaattctccaccttcaccatccttcaagtgtctgcatcacttccttcttcttggatactggacaagaactcagaacccacggagtgcaggtacccaaaaaggctgtcatactggccctttgccctcgctggcggagggcagccaccccacgcaatgtggtaagggaccaactgagctgttaacatgcacacagacagacggcagagctaaaagaccactgtaacactttctctggggttttggggtcgtgggcaccctcacctgggtgctgctgtgggacctgcatggagctttctctcgctggctcctggagcagccggccaggtcctgcactctcttgctaacatgctccctcctgcagggggttgagcgctgtggcgtgagtaaactgtcgcccttgttgcaagtccaatgaagggaccaagaaaaatcctgcatcactgatatgaaatgtaccaaattaagtaacatcatcttatttcttctgattttgttttcagtttgtttatattcctttccataggtattatgtgtctgttttagttcataaaattgtggcctaatttatattttgaccattattcagcacactgttagtactcaggactaatttcagttgcttatttagacacatcgaaataaatcacattttaaggctgggcgcagtggctcctgcctgtaatcccagcactttgggaggttgaggccaggagttcgagaccagcctgggcaatatggtgaaatcccgtctctactaacaatacaaaagttagctgggcatggtggtgcacacttgtggtcccagctacttgggactctgaggcacggaaatcgcttgaacccaggagtcagaggttgcagtgagccatcacgccacactgcattccagcctgagtgagattacgtctcaaaaaaaattttttttaaacataaataaagaccacactatcttttttgaagattatgttcacatttcattctctccattgaactgtatagatgtattacctgtatataaagaatgtaaatttttttgtattaaaaatcgacaccttaaaaaaaaactaataccaccacaaggttaagctctgaggagatttcagctttacaataattacattgttacaataatgtttaacttctcaataattaaaaaccaaagcaatgttgcaaccttggttcaatattcaaatatatttttcttggtaaccaagctacttcactatttatagtactttataaatgatttagaattgttatgcagttttttcaaagaagtattcataaggtaaatttagaaaattattttaaaacgaaagtgatgcccaccagatggtgctatttcgcctgttttatctgcgacaataagtaggaaaaatgaatatagaacttcaaaaaagtgtatggaagatctagaatatttgggcattgtattttgggtgtagatgagctcagtggaaggaagcattcaaatattctaaacttgtgtttagtactgtatgtttatcttgataaaggtaaagatgaattcccagagttaatatgccagataaccttttatttagtctaaatgttaagtagattttttgaaaagttgacctatatgcaaattttattaacttcatagctgtatatgcatgaaaaatgaaattatttattagatatgtgttaccaaaatttgtttcaagatttctttatattgttaagtaaacaatattactatctcatttgagttacattgtgatttacaaattaagggaaacattttgatttttttatgtgtttgtaattattacccagaaacttaggcttgaattcactatttttacaaaggaaagagatgactcttctaaattaatttttgtattaggaagagggcaaactatgtggtacagtgttcacttagatgcagccattgaatgacgatccattagagtcaaaatggttagttagctaatgaaatacacttttcagtaaagctggaaagatttagccagctcttaaaagtgtttctaggattttaatgtagtctttttcccgctgattttattatcactctgtattcttctctggtcatgagattgaaccataaaagtcatgtagatgcttgttataagtatttgccaaagtcatcattgtcagtgattttattggcatgtgtgaaattagagattaaacttgcttttaaatcttgcatttgaatttttcttctggaagggtacatgtataactttcaatttaatgttcaattattggtaacagaatgaagcatctctctataggccagtaaatatatatagtagattttattgtattcctgtactgtttttgaatgaatattttactaattatattaacataatcctcatacatacccttaagattaggacctactataatgctttatttgaacttgtttcatagcatttgtcttttttaactttggattatagttttggaatataaatcagatccctcctacaaaaacataaagttcttcatgctttctctcattccacttatcacaatactttacatgtagtagatgaccctatatattttttatataaatgaatagttttgtcatgccaagtattgatattagtattagtgacaacaagtattcctcattccatagtttttgtttttgttttttttttttttgagacagagtcttactctgtcacccagggtggagtgcagtggcagaatttcagctcactgcaatgtctgcctcccaggttcaagcaattctcctgtgtcagccttcttagtagctgggattacaggcatgcaccatcacgcctggctaatttttgtaattttagtagagatggggtttcaccatattggtcaggctggtcttgaactcctgacctcaggtgatccactcacctcagcctcccaaagtgggattacaggcataagctactgcacctggtctctgttctacagttttttatcttatgcttttctgaaatgactttttatagttgggtttaaaaggatcatctcattggaatctcatatcacagttatgatgcattctgtcatgatgaggataagtgtatattcaggttaaaaaaaatcaaaatattattgtcagcctgcatcagtattagagattgtctggtccaggagttctcagattgtgattcaagggcctcttgtgggaggggggggtcaggggtccttaagaccttgacagaagttctgtgagggcagaactatattcaaagtaatactaagactgtgtttacccttttcattctcattctctcatgagcataggtggagttttctagaggttgcataccatgccatactgattgaatgtacaagttatatgaaactctagcagttctgtcaaaagacaaagttacaacaaatttagtttaaagatctcagtcagctttattgtgattctagaatcaggcaatacttcattccataaagtagagtgtgtgttctaatgagttgagcagatggttggttttatagacagaaagggctgaagaaagcagattggtcatttcaaagtgaattctcttgtaaggtctggatggggagacaggacaatagaaagactggttaatatcaggttacttcagattagggattaaaacagaggaaacttcattatcatgcccattgaatacttcattatcatgtgcattgaatattgaaaattgtcctgtttgggatattaggctgttatctgtctctcctgattttttagaaagtcaagataacaactcagtttgggtttggtgagcatgggtgactccattttgatttttagtctggtcttcttttggagcctagtgtaggagttttgttcaaaacagtggcctataattttggcttcataagccagacattaaagagatttgcaaagattataaaacagtgcttctcttgtcactaagatgttttttagtttggaaatagttattttcataaaatgttacattaacatttaatgaatttattcttaaaataataaatatttaaaaaagttatattttaacttctaatatgataactagggctagatattaaagctccttgaattactcgatactctttttaaagtgtaaagtggtcctgagatgaaagtgtctgagaacttatgatcctaattctttatcctcatttcatagatgagaatactatgagcccagagaggttagtttagttaagtacactcatccagtttttggcttagctgattcttggatcactgacatctggctttttttgatttttttttttttaagttttttttttttttttttttttttgagacagagtcttgctgtgtcagctaggctcgggggctggagtgcagtggtgcagtcatggctcactgcagccttcactgcctgggctcaagtgatcctcccacctcagcctcctgagtacctgggactacaggcacgtgccaccatgcctggctaatttttgtgttttttgtagagaagggtattttttgttgcccaggctggtctcaaactcttgggcttaagtgatcagctagccttgacctcccaaaatgttgggatgagccaccttgcctggcctgatatattttattagcagttttgctgtttagatattcttcaacctaataccaaccatcagctcctttaacagtttcttcatttgatattttaactaactttattaagtacatgagtaaattaggaatattgacctactttttcaacaacaataaaatggtgtttttttaaactcaaaaaatgtctagaaaaagggaattgatatatgaaacagtgtaaccttagcgtcagaaagaataatgttgagggcaaagaaataggttcttgtgttttagagactcttttactgtcttttttcctttttttccccccttcttcaacaacaaaacattggttacaagcttccctgggcatttatggcagcccacctacagaagaacaagtgttctgttttaaaattttaaaaattttatcaagaggataataattacacatatgctgcttttttgatggatatgtattatttctcaggttgagcctcatggtgggggtggtagattctaaccccctccttttaattgttgaatgaatttaaaactatgtcataaagaaactgcgtaattttaattcaaagaaagataattaggatatacataatatccctcttcctttgaggggcttccttcgtgtagaagacatggactgagtgatttttgctcaataaaggaaaactttctagtagtaaagaaatacaaaaatagaatcagcttgtttggaagtagtgagttccctttcttatgaggcattaaagcatagaccagattattgactgttagtaggagtactagcaaatgaatcagtagatggagggttaattgggttacatgacctttcagattgcttttttttttgaggtggagtctcgcttgtcaccaggctagagtgcagtggtgcaatctcagctcactgccacctccgcctcctgggttcaagcgattctcatgcctttgcctcccgagtagctgggattacaggcacgtgccaccacacctaattttttgtatttttagtagagacggggtttcatcatgttggccagggtggtcttgatctactgacctcatgatttgcctgccttggcctcccaaagtgctgggactacaggcatgatccaccgtgcccagccttcaaattcttttattaagtgtttgagtatacttgttcaaaataactttttaaacaagtataaaaaggcagttggtttagcagatgtattctacttttatatcagctgctctgttaacctaaagattttatggatctgtggtctcaccatgatcactgacatcaattctccttgaaggaggatgagttttgtttgttcattttattgcaaaccatttgaagagatgatagattggtagcagaaatttggcagagaaaaggatgataaacattagaaaggaggataaagcccactggaagacataaatgaattgatgatattttggtgtatattttctcattgctttatgattataaatattttctgctgctttttgccactatctatttttcatgtcttccaataaagtattccatggccaaaatttgtgtgaaattctcttcggttgttgctggttttacaagttatagggttctttggaatataattactgaaatgatgactacactaaaacatatttcttcttaatttaacaaagtatttagtgggaggaaggctctagcttttcttattttctttaatgttttttaggcatgctagaggaaaatagtgttcttactattagttttgaacattttttatgactatagagttgaaagcccaaaacactagaagtaaatggatcattgcaaaatatttgttttgttttcatttgtgagtggggcattcgtgtgtcactgtgtctatgcttctatttttctctgtatatagtttatatccttaagactttcagaaagaaattgagatgttatgttgttttattgtatatgcatgtacatgcatacacacacacacacacacacacacacacacagttttatttgttcatcatatatttaaggcctgacataggtcttacaaagttcaattactatagggcttaagtaggaaatgaatggtaaaatgagccaatttgaagcaataaatactgattgatagattatcaccttcttccaaataagatatgtggcatcgtagaatcttgctcttagatacacagatatgtgtgatgtttaaatagttgagaaattcaaccagaaatgaatgaaagggttttcccgttatcctgtcatacgcaaattaccagatcattcagttcttcaatttatcaattcatgtatttattcatttaactaatatttgttagttttatactatgtgtaaagccctattttagacactgaatacagtgccagacagtaattttcctgcactcatagtttatactctaatagagaatgtagaattgagctttaaatttcctattcaataagtatttttagtaatatgtgaagtacaagagcttctgaagacttattgcgccactctctccctattcatccatttaccagttgttactgaatgcttactctatgtactagaaatgcagagatgagtaagatacaacctggccctgaaaaaaattcagtctatttggagttatagacaggcagtaactagctattatatagtgtgatgatggctatgatataattacaaataatattctgcaagaacagtaattttctctagctgtgaggtatgcaagaagctatcatagagaactaatatttgaggatgagtagaaatagtcgggtatagggagatcaaaggagaagttactcctattccccaaatagagggttcttcatgaacacacagaagtaggcaaggtctgtttggagaatggtgagatattgtgtagtttgggtaaaacactgggtatgtcatggagggagaggtaaaagaagaagctacaacgtaggttcaggccgaattgtgaaaagttttatatacaaggttaaagttggctttttattttacagttagttggggacctgtggaagatttttcagcaggcaaacatacttagtctgcagtttacaaagatagttgatagaatacaggatgaagtagtgagaagttgaggctatggaaaggcaggtataccagtttgaaaacttcataatagatatgaatgaaataatgagggtctcttatagggtagtagtagtagtgactttagaacacagggatggattaaaaatcaaattcagaggtatttttgttttgcttcatttttttgagacagggtcttgctctgtcacccatgctggagtgcagtgacatgatcacagctcactgcagctagggctacagatgtgtgccaccatggctggccaattttttatttttatttttatttttggtagagacaaggtctcattatgttgcccaggctggtcttaaaatcctgagctcaagcgattcttccatctcagtctcccaaattgctaggattacaagcatgagccaccatgcctggtccagagttagaactgacaggatttagtgagtgatccatatggagagagggcgttgaaaaagattttgaagttttgtgtttagtgtctgcataattaaatgctggtactattaacttcaaaaggaaaagcaatatggttgagggaagcaatgaatttggttttgtaatattgagggcaggagtaaacctaagggaatgttggaggcatttaaattctaagtggaggagatgcctattcaagagaaaggaggaggagtagggggaagagatagctgttcagtgtgtcattaaacctctcaaatcctcagtttgttatttatcatatattggaggtagaatcaataatttttctggttttgaaataacctgtgttttagttatcacaaattctaaattagtagtacaaaaattataataattatagtttatatgttatagactgatgataatatttattgattacttcctgtgaagtttaggtaaaatgctaagcattttgcattcatcatccatttaattctcctagcaatatgagttaaatattattactatctggattttcagaaaagggaagataacttgaccaagattgttacagcaaataagtggtggatgggtattcaaacccaggacaatctgacattaaaactcaagcttttaaccactatattatttgcctgtcttgtagaacataagagttgtaatgaatctaaaacatcatctagccctttcctgtaatcagatttatgtcatagctaaggtctgtaattaatgtcaaaattagctatccaatttacttaataagaagcttactccacagccattcattactgctgttttccttgtggcagatacttttttttttttttttttttttgtcgactcacctctttaccgtgtgatgtgagtaaattctgtatagtctaggccactcatgattatcccatttttcttgctagtcattaattaagacctgaacataggactgatatctgaccaataactcatttgtggccaatgagacatgaggggaggtttggtggaggggcttcttggaaaggtaacacctcctctcccctcatttttggatgtttctatctagatgggttcttggaattgtgagagctatcttggaattatttggggcctaggtcaggataaaaccaaaacactggatggcacagtgaaaagatggtgagaacttggatccttaatgatcttgttgaacttctaaattacccattcctaaagctattgtgcctcaggactaggtcttacatgaaattagagggaatttattaggctgtgtgaaacaaggactttttaaggctactaacagtttttttcttttaaacgatacttatcactgaaagaaacctaactgggatctgcagtgtttatctttgtctgaagtaaatagaaaggcactgtagggcttgcattactgttgagacacaattaaaacaggaatagaagacaatttttgtgtcactgcacctaatttaattggtgtagaagttggagatgatcatgctctagaaaacagatcttatatatgttaaaggtagcaaagtgtcattgaggaaatgagtctgattattctgacagtttctgtaggtaaaaggaatagaaagtaagtgttcagattaggttaggaaatagaaatggatttagtttgtagacagttaacctacgtttcagggtccttccaagactctggaagaatctcaagcaatgtgttaacataatattttgggtgaggcggggtaagatttgcaaaagttaggtatttaatccattaaaactgctattccttttcacttagactttccctgtatcataccctcatattgggtggcattagagtggcctgagctaagggaaaattgagtagaggatacatttagagatagtatatggttagcagttgtttatgtgtccagttattttgtaggcattacttccaggaatgttattactgtccactgtgtctacttccctggccttgtgatacatagatgtagttttgcagggcaggtgagccccaaagtggggctcagcccgtgagggttcttggctttgcccagaaaagaattcaagggcaagccagaggtagaagaaaatagatttattgaacaggcagtgttacagctctggtggtgttatagctcggtgactgctcctgcagagcagggctaccccgtaggcagagagtagcagttcagggcagttattaatacccttttttaataacatgcagattaaggagtggtttatgcagaaatttctagggaagggatagtaacttttgggtcattgggtcattgccatggaaagtggtggtaactcctgggtgttctcatagcagtgttgacatggcacactggtgggtgtgtctgatggaaagcttcttctgcctaatcatctttcagctagtcctcaatttaattgggtgtctgaacctgtctctagagtcaagtcctgcctcctaactcagtaggggcaagggtcttagagcattataaatatgttctttgtggtagaggtagaggaagagaaacatcgtttaagtgtttagagtgagaaactagtctggaaaatttttctaaatcttggaacttgattgtggttttcgtaaatttgataatattcctaagaatgtatatgacattatcagtaataagttataaagaagttataaagctgatataaactctctacactgcctttttttttttttttttttaagatggagtctcctctgtcacccaggctggagtgcaggggtgtgatctctgctcactgcaacctctgcctcccaggttcaggtgattcttttgcctcagcctcctgagcagctgagactacaggcacgcaccatcatgcctaacaaatttttgtatttttagtagagatggggtttcaccatgttggccgggctggtcacgaactgctgacctcaagtgatccgcccgcctcagcctcccaaagtgctgggattacaggtgtgagacaccgtgcctggcctacactgtcagtactaaaaattgatcaaacacagtagtaaaaagataaaattatctttctattctcttaatgttgcaaaattgttatatgaagaggaaatcaagaaatgcagccagaaatgtaagaaaataagagcattatagagatagattaggcaattaataaagatatgctcttctttttgaaattcatgtttttggcatttgttagccttttaaagttagtgtttagttgtaatttattttctcattccagatatttacttcacacctaattttgtattcctttccttaaatagagtcccacaaattgtaaaaaaggaattagctcaccaaaaacaccaaatgcagtatttttaatatttacctttcaggttcggttgctggatctagatatgcctcttttttttatttcctcattttttcttctaaaaagaaaattatgtattttaatgtcagattgcttttgattaaaatgtttcatattaaaattgtatacctgaaaaatattattcaataacacacttcaaaaagttgacagttaaaaaaaaaagaatagcccttgttacttttcttatctaatcacagagtttgtgtagtgaatgtaaaaagaaaaaaaaattgttacaagtttggagcaaagagctctgtgtttaaaaggaatctccttctttttttgtgtgtttttccttttgtaccaatggggaacctaaatctgttttagttgcacagacacaatggacaaatagtcattttgtatttgccaagtgtgataccttcctttgtttatttgctattaaactgttgagagttttatggctagtggataatcattgttcaaactttttaataactacagtgaattgtgttaatataaaattatgctgtacagtattttcttgttatgttgatggtcaaagtgaacatcagatattaaaaatttagatgagtaaaatattaaacagcctatttttgtcatgtaacaaaagaccatgagatccatggaggaaaaaaggacagctttatttttctatagaaaacaatagtaggttggggatatgcagcctgtggtgtaaaatgaaaatgaggtcctagttgggggttggagagttagaaattataaaggcaaaaattgtaggacaggggaggtggggtcaaggaagtaaggaataaagtcttgattagatgacctttaatccccaaatcaccagtgtgtcttagttggttgtttccaggtggttggtcagttggcaccaggtggtcttttggtgatcatttggggaatttccaaatgatcaccaaaaggaactgttctttgacttggtggcagaaaaacaggttttgcaacacttttaaggacacagggtataattgctcccttaccctgtcattgcctcttggttctgcttttacctttgagccacaaggagtctatcttgtcaattaactgggggcataatttgacagtccaatatgtataatgatgacaacagctccactaacatgaatgccattcttagaatttctcatagatcctggcatttggtacatctgagttgaataaataaaagtctggggaatgaatgaaagaaaaattagttcaatgtcctataactttaagttaatttattagaattgccaccaacaaaattagctctagcatttagatactaaaaggaatttgttaagcaaacttacttttgcagttatctctccatggacagtcagaacaggtattcttcatttctaaaacatactgctgttctttaagaccattctttggcactgtggaactttagtcattttctagacatttgttagccactaaatgtctcataccagggactcatatttgtaaataatagtgtctgcctttgagaagctcataactgggtagtcaacgaacagtcacagtgcagatctggaatcagtgttgagggagtacaaaatcctttgggtgttgtaatcagagtcaagaaaagcttcacagtggcgataggcttaagcttagttgaaggaagaggaagctttcaagtggaggtggcagagaaagcattctgacatgtgaaaaggcaggaaagcctgcgtgcagcatatttattagttttgtctcccttggagcattttgtaaattttattgagtattcagagttgacagaaaggcagtcagggatcatttcatggagcgccatgctgagaagattagaggattttaagcaagtgatgtggtcaaatttgcagttttgaaagagtacttaacattatcctggttatatgtttagcagatttggcaagaactgattgttatgatttgatagtcatttaatacaaaaaggaacctggaatgctcttcgtctttagtgaacattatgtaacctatcttcatggccttcttagtgaggtaaacattttttttttgaaattgtaaagatttaaactttttgaagggtaaactttctcagataattatgcttagttgtgagcagaagtaaaataatgtttttacaggccagagcatttaattaccagtgcaagactgtccagactactctttccatttaccatgataactggtaaaatgtgagatggtgattgctccatcatcttgggtactgagatgaaaagatgtggggtggagtcctcaaatgacttatgatgaacagctagtgtaagcaagaaaatgaccttattgttttaagccactgatattttgcagttcttacctgataaatggtacatgaacctaacgtgtttttattgatgcaaccatatatcaaaacagtatttttgaaggaatcattgtagaagtacagacatttatagaaaattttttacctctctgatttagagaaatttttgaaagcacaataacttaggtaacatagtaacataaaagttctcataatatgtgtaaaccaaaatgagttactgcaactaagagtcattttgaaagagactaaaattgacttatctttaatttgttaaataaaagtgtgatattaaatccattacaaaaatgggtaaaaattgaagacaactgcaattttataggttactgaactttatattttacatgatattacagtcatccttcagtatacatgggcgggtggttccaggacccaagtctacaaatatgttaagtcccacagtgggtgctgtgaaacctacataaaggaaaagttggctctctgtatgcgcaagtttcgtatcctgtgaattctgtattttcaatccacatttggttgaaaaatttcagcctgtaggtggacttgcgcagttcaaacccacttcattcaagggtcaactgtattttatagtcagtatttgcataataaggaaatctaaatggtactttgatattcaaagtttcataataatctatatgtatgttttaaagtgagtgtggtgatattaatacttaaatgaaaaatatgagttaataaagcaatttataattttatatcaattgagcatattgtttttgaaatttaatttagaataatcatctatacataatctatagatactttagtctttctatatgacattcttatggtggtttattgattatcataactatgaataatgagtaaaaattatacaactatacaagccaatatatgcttgaaattattatttattgatagtaaattagattttgacatgaaatgatttctgtttaggcaataaatttaaactatagaaaaaaatgcagtgtaacttgtactgtaaataaacgattagcaatgaacattacagtgagagctgatagtttatgaattattcactgcaaacttattgtctctgtgtcattaacatgtaagataatgagcctaattaccatggctttaaactcaggggagttagcaatttatgtgtaaaagtttctgggctgtagttaccacccacaagggtattgagagaactgcagacactacttctgtgttttgtttcagaaatgttctttttcctcacttgcttccttcttaataaattagtttttatttatttttatagtgagaattatgagcttttcctcttgcttgaatacctttttaaaggagttatgagaaatatttaagtatttttttagtgtagtttagtgttgtaagtagacaaaatattattagatgtattcttttatttgcttacataagttggcatcacttactatagtaaatgaccactaatagtgtaatttcttggaaaatctagcctaaaaggtcaatattaataattggttttctcctctaaaaggatttgtactaagatgatttactttcaaagtactcagtattagcctatagccttttttctaatctttaatattgtatctttgatcttaatttaaagttttgatgaacttgttgcttctattttctctcttatagtataaattatctgtaataagccaccttaattaaagttggtaaatctacaactgcttcaattatacactaatcaattatacactaatttaattctacttagcaggatacggtacatcattaatcagttttagacttaatacaacagatttagaagtaatcaaaattgaagcattttatttagctgggaaaaaaatgaagggtcataatctagtaattcacatatcaattctgataaaaatcaaagattctttgctaaaaatgaaggaatgtagctgttatgtttactgttgagtgccatgggctgaagctgtgattatataatatctttagatgttaatagcataatagttttgtgctctacctttttctttaaattgttattcatgttactaaatgggttgttttctgtaacatgattgtttaacgtatacataatataagaattccttgagtgaatatcttttttgttgttgttgtttgtttttgtgttttttttttttttttttttttgagacggagtctccctgtgtcgcccaggctggagtgcagtggcatgatctcggctcattgcaacctctccatcctgggttcaagcgattctcgtgccttagcctcccaagtagctgggattacaggcatgtggcctagctaatttttgtatttttagtagagaagaggtttcgccatgttggccaggctgatttcgaactcctggcctcaagtgatctgcctgcctcagcctcccaaagtgttgggattacaggtgtgagccactgtgcctggcatatagaatatttactagtagtttgttttgaacatgtaagcatgtgcacaaatgtatttttttcagaattatgttaaataagatgattagatataattaactcaaaaatctttagcaaaatgatctttgttttctgtgattgaggtggtgacaaatttgccttagaattcttggggatgtgttataaactcgatgtaatcatttttcttttccttttttttttttttttttgagacggagtcttgctctgtcacccaggctggagtgcagtggcgcgatctcggctcaccgcaagctccacctcctgggttcatgccattctcctgcctcagcctcccaagtagctgggactacaggcacccgccaccatgcctggctattttttttgtatttttagtagagacggggtttcaccatgttagccaggatggtctcgatctcctgacctcgtgatccgtctgccttcgcctcccaaagtgctaggattacaggcgtgagccaccctgcccggcccatttttctcaattatctgctcattgaattaaatgactcagattgaatttcattactcattctttctatacatgttcatattattggaaacacttcttgtcctgctcagctttctttccaataaattagtaattctttgctcactcgtcttgtattcctttataagaatgttctagatagggatattctaagttttgaagactatgtatgttaagtgcattttacccttttgagagagttttagtaacaagtttcagggaacccctaggactctgacccattatagctttggccatttaaaaaaaaaaaccttcaaaggtaatatgtgtacatggttaacaatcaaatagaacagatggtctgtctaataatgaaaaacaagaaaaatcttgccctatgtttctctgttcccactccccccaaaatcagccacttgtaactgattctgttttcagtgcttattgtggttgtctcaacctgtagtagaattatagattcttttgtttgtttgtttgttttgctttttaaattagagacaagttcttgccctctcaccaggttggagtacattggtgtgatcacagctcactgaagccttgaactcctgggctcaagccatcctcctgcctcagcttcctgtgcagctgggactacaggcatgcaccactccacccagctaattttttaatttttttgtagaaacagggttttgctgtgttgtcccttgaatgcctggcctcaagtgatcctcctgccttggcctgtgattataggcgtgagccactgtgcccagccttagaaattatttctcaatgcttttgctcttctgtgttctgtgattaggtgactctttatctcacaccacttctaccttttctccatccttccaagttgtgatcactgttttcgttcctaaattggttatttttaaacttcaaataattcaggtaaatttatattttatgttttgttaactgtgttccctgcttactgtttcttccattaatttaaatatcatcgaagttgataatgctaagaacttgtttgtgttaaggtaattctcacatgtggataaaaactgattagtgccaaaagtttacaataaaatataacagtctcctatcctaccctgggttctccagaagcggcaacttataatactgttagtttgttctttctgatactagcttattcctaaataatatgtgtattcagcttttctgattaaccaattttagatgttatctattgacctttttattggggcctgggatacagatcatattatatacctgtgcacccagttctgaaaagttatataataattttggttcaatctataagcagtctataatcgttatttatattatagtgactatgtaagtattgagtgctgtaatatagcacattacattcatttgcttaaacaaatatttggtccccctttcccaccacattatttatagccttgtttattcatttgcttggtttcctattggctaatttgctaatctcccccctcagtgtttcagcagatctctccagcacctcccattaatttttctttgtttatcataggttcgaaactcaataattttttttcctggaagtttctctccttcagccctctattctactttaccaaggagttgtcttactcttttcagctctgatcctgggacttccctttgttgctcttttgggggacaatttgctttttgattgtttttagtcttattagtttatgcccttgttttgctcaagcacattctccagagcttcctgagaaaagaatatgtgagaaataaaatttttccatacatgtaggtctaaaatgtctttattctacctttacataggttggtatttcaattaagtctggaaatgcagattgaaaataattattcctcagaaacttgaaggccttgctccattagcaaccagtgtttcctatgtgaagtttgatgccacactgattgctgattctttatatgtgacctatttttttctctttggacattcttagaatctcctctttcctcctggtattctggcatttctcaatgtgatttttcttattatggcttttttttttcattgttctgagcatgtaatgggcccttatagtccagagacttaaatgttcttcctgccattcatgcaggtttttgaaatttcttctctactattttctttagagctatgagttatttttattagccagttttctattaatagacactggatttttcaagttttccaccacaaaaaacactcatgggccgggtgtggtggctcacacctgtaatcccagtgctttgggaggccgaggtgtgtggatcacctgaggtcaggagttcaagaccagcctggccaacatggcgaaaccctgtgtctactaaaagtacaaaaattagctgggtatggtggcaggtgcctgtaaatcccagccacgtgggaggctcaggcaggagaatcgcttgaacctgggaggcagaggttgctgtgatcacgccattgcactccagcctggatgacaagagtgagacttcatctcaaaaaaaaaaaaaaaaacaaaaaaactcctcacatatattatcttttttgcatgtacttttatataattgtgccagttcttctgtaagatatacatggcttttatcttattactttctctgagaggtagagggtggggcagggaaggcaaggagaggaagaagctttgagattctcctacctgaacttcagattctggtgtgatacctcaatattgagttagaatggctttatcaagcatgtttatttctagtttttcatattatttttgtcttagtcatgaagcacaacaaaccaacatagaacccatttcatactgatgaataaacaggtagcttcattcatgtattcatttattcattcagtcatgttgtgatactctttgggaatacaaaggtgatactgtacttgctgtcatgggatttacaattctagggataagtaggagtgtaattgataaaacatgtatttgtgcttttcaatagtaatattgactaactcaagaaaacttttggagacaggctttctttgaatggactgtgatgcttgcttgtttatgttttcatgaatacatttactagcttttgattttttatattaggagagaacagagtgtcttgttgtggcagaaatacctaatatgtaatcctctgaattcttcaattgttgcaaaacataaacatttactaaagagttcagcagagtagattaaatgttatttaaaacatatgttatattgacctcatggctaaatggcctggtttaggaatccatgaattatcccacaggtaatagcaaagttttctccctgcctcgtctcccaccccaaatatttgatttccacatatactgcacaggggaattgaatttgatgtcgaaagccataagaaaaagagaaactttgctttttactgcttttactaggaaatagaaaacatttttagtgacaggctatgcttcatcatgaaaatacggttgggtgttttaggccttcacaaatttgatttcattgtacttagtgatggatgttagtaagctgtgtgagatggagagaaattaaagaataaacaggaacctctcaaacttgctagtgatgttctacagtttgtagcatgaattttcttacttttagtttttccttatgaaatactttatgtagaacaaactagcagtactaaaacaaacacccatgtacccaatctgtcaacacttagatttgttgaagatttgggtgggcagagtcttccacccaaatggtaaaaggggaatacattacaagtacatctggggttctctgtatacctgtcttcagcccattttctgtcttatttcaaagttcactggtgttccagttttgtttttagctgtaatgcttttcttagtgcttaaaatatatgtgtatatattcataagcaatatgaagtattgatttgcgtgttctaaaacatattttacagtgcctctccttcggctcgctttttcgtgtaacattgaatttttagatttttccctgttaatgcacgtaatttatatgtaatttattttcacctgtatagacttgtatgaatacatcacaatttattctttggttgaggaattacaggtttttcagtattagaaacactactgtgtttaaggttcttgtactgatctgtttatgcatatgtgaaagattcttgaggactgtattttaaatatgtggatgtttaaatttcaattaattaaaattaactcagttcctcagttacactagcaacatttaaagtgtttaatagccacatgtaactagtgagtaatgtattggatattgtggatatggaatcattccattatcataaaaagttttataggctagtgctccttggggtttatacctgtgtgtggaattgttgtgtcactgggcttgcacatgttgcacttcagtagatgttgctgagttgttctttccagtggtatctgagcattccctttctcaattgtcttgctaagaattggtataaacagaaattctaatttctgttttgtaggtgtgaactgtatctcattgtggttttaattgaattttgaaaatatatagtgaggctgagccttttttcttatacatgtgtttaccttttacagttctcatcttgtgattgcctcttaatgtcctttactcattttttcttttgagatattttaaattactgatttgcatgagttttttttgtattttatggatacaaattctttgattatatttgccatatatctgtgcctagtatgtgacttgtctttcattttgtggtgtcttttgcctcacacaagttttaaaatgaaatgtaatcacattatcaatttttaaaaatgctttatcttcttatgccttatttaagaaattacttcctactctaaggtcagagtttcccatatgtgctttgcagaggtagatctttcatctggtagtatgtaatttttgtgtatggtgtgaggtagagttggagacttgagtttttttgcatatggataaccaattatctttgtataattttctgaaaacttcattgccttaatagttttttgtttgcatgggggtcaatttctgggttctaattctgttccattggtctatttgtccctataccaatgtttcagttgaattttcctttttgtcaaagtacctatttttttctttattttttgtagagacagggtcttgctttgttgggtagactggtcttgaacatcaaatgattctcctgccttggctttccaaagtgctgggattacagttgtgagcaaccacacctggccaaattttcttaaaatgaaaataacagtgataatttaggtccaagccctcttcccaaaattgatttagctgatgataagctataatattggaatttataatataaaatactacaatttttttttttttttgagacggagtcttgctctgtcaccaggctggagtgcagtggtacaatctcagctcactgcaacctctgcttcctgggttcaagcgattcccctgcttcagcctcctgagtagctaggactacaggtgcgcaccaccacgcccagctaattgtttttattttagtagagacggggtttcaccatgttggccaagatggtctcaatctcctgacctcgtgatccacctgccttggcctccaaaagtgctggctgagattacaggcgtgagccaccgtgcctggcctagaaaatgatattataaccagcagatgtgaacaataacatttttttctgtgatgatatttgagaaaagcgcaacttaattacaaaagagtgaaaaacaatcactttatcaaagtcagaacttctatacactttcaagtggtgaattgagcctcacttaaaatctaattttcacttttaatgccatttgttttcttttgagatataactgattcatttaccaccaatttttataaattggatttgtagtttggccattgtatgaaaatatttttttaaaaaagtatatgggtcatatgggtagtaatcaggcaaattggttttagatttgcagtacctgttcaattatctgagatttaggggatctagggcatgtgagtagaggttctattaggtttataaagtgcttgtgatgataatataggttaaggaccaagtacctgggaaagatcaagggcatactaaatagttgttcctaaagtaatgggacaattgcagagagagggatgagagaaggagacttaaggatgatgtgttgatgtgtatgtatatataaatgagacataaatgacttttggaaggattactaaagaaaaacagcaatagaagaagactagcctatgtccagcagcaaaaggaagtagaagacagtgagtcagatagtgaccagtacaggacgctaggtggtgccattagtcttagactgcttatttgaagtctctggaggctcagtaacctcagaatagaaagatcgaaaggcggccgggcacagtggctcacgcctgtaatctcagcaccttgggaggccgaggtgggtggatcacgaggtcagcaattcaagaccagcccggccaacatgatgaaaccccgtctctactaaaaatacaaaaattagcctggcgtggtggcgggcacctgtaatcccagctactcaggaggctgaggcagagaattgcttgaaccggggaaggagaggttgctgtgatcggagatcgcgccactgcactccagcctgggtgacagagcaggactctgcttcaaaaaaaagaaaaaaagaagaaaaaaaaaggcactgcttgtatagtaaatgagcgaattgtcttattgagtataacccatagtatattatagttcttgatattttcttctccagtgatcattttgaaaaattttctggaatttgcattgtaaagaagtttgtccaccaaataaactgtgttttaaaagtaatagttcatttctttctaattttaaaggttgtatataaaaaggtattttcatttaaaattcatattaaaaaagataattgaaattttcatattgaaattatataatcagaaggaacttggtgttttaataagctttagtggccttttcctaggtcaatgtacaattccactgaatttttttgaaatacatatccatgggttccacattggtggattaaaccgtggaaagaaaatattagggaaaaagaaattgcctgtgtacagagcatgtacacatttttccttgtcaatattccctaaacaatatgacaaaagtttacatacatttccattgtattagatattgttagtaatctagagatgatttaaagtttggggaggatgtatgcaggttatatgcaaatacagttgaccctcaaacagcacaggtttgaactgcatgcacctacttatattagtttttttccagtaaatacagttggccctctatatgggttggtttggcatctacaagcaaaaatggatggaaaatacagtattcaaggaatgtgaaagttgtgtatatggagagaagggccaactttttggatctatgggttcaacagggccaactgtggtactttagtatgtgtgcattttggtatccaagttgggtcctggatccctcaaagatactgaggaatgactgtattgaagatgattccttgattcctgttacatttttttttaagattccagattgggaataattaagtgcattatttgatttctggagatgagttacaccattaaatttttgttgatatgtgtatcgtgcaggtgacagaaaccctaactcatactggcttaagtaaatggaaattattggatcacatatctaaaaagatgttggtatggctgattttaggtgaagcttgatgcagaggttcaaataattttatttggaccctcttcacctcatcttctagaggtagggtactgccatcagctattggcttatatccttatttgtgtgtgtgtgtgtgtgtgtgtgtgtgtgtgtgtgtgtctgtctgtctgttttagtggctctaaaaacaggtgtaggattatgtcatattaggcctctttggcttgtttgggttccatatctactctgcaactggagatagagttaacactgctggaaatttatggattaagagtgttgaagggatgattccccaaagaaaatttggatcttattagggaaataaagaatggttgtaaaattgcacttatttctttaaggaagtcatcttaaagctgtttttctttgccaggtatggtggctcacacctgtaatcccagcactttgggaggctgtggtgggaggttcacttgaagccaggagtttgagaccgctctgggcagcataatgagatcccatttctacaaaatatttaaaagttagccagagatagtggcatgaacctgtagttctagctacccaggagactgaggcaggaggattgcttgagcccaggagttcgaggctgcagctcgattgcgccactgcactccagcctaagcaacagagcaagtcaccatatctttaagaaacagcaacaccccccaacacatgaaaaacttttttttttttttggctaagctgttcttacactattgattttatttcactagaatttgtttttactttaatctcatttgtgctacttattagttgtgtgacttctcagagtccatttcctcactggcaaaattgttgatacaactattgatatagttatggtgatgataaaataagataatgtgtgtgaaatacctagcctagtgcctggcatatattagatattacagaaatgttagtccacttgtaagcatggttattacccagacatgtttggattttatcagtctttgctatatgttttaaattagcctataatctgtaagtatcacagatgttgtagaatgatcaattttcagattatcagtttgatttattgattaccgctttcagtgctgaaaatgacagttggtagatattgtccaattcatgacttgccagtatttttatcctagtacttaatgtgcagatttagcttctgtaagatttttacaattaatctatgtggggaaatataaattatctttaaggagtagcagtaagtgtagtgaaattatgataaatggttttattgtttggggaaataatatcaactgcttcatgtgtttgaagaataaaaggaagttggcagcaagggagaaagatgaatgattaagtatggcttaaacttgttttttaattaaagtgcttcattgttgtacacaatattcaaattatatttaaatgtaacattaatttttctattaacattcatctttattagaaaatattgcttgtatttatcataatttttttccccaccaactataacactcttataatctatttgggttaatgcgtgtgtagtctcaagaaaagagcctccttaattgtttttaaactgtttgaacactagagatttagtaacctacatttccaataactaacaatacatatgaaactcttgatagtgatggaatagaactaatcatttccttataatatagtgatacatcattatttgacttatggcatatttaactctggttagctacaagcagctttatactggtgtcttttattcagatttgagaagtatcagtgtaacatataaagaacttatttttactaattttcaccatattttatagacacaaaccacatgagaccaaaaatagtgtatactgacctggctggtcattttatggttggttattgtgtttattattctgtactatgtttgttgtatttgtgctttagttgctatttatttttaagaatattgtgttatataggtgtaaaagtgataagaatgtgccaggtatggtggctcactgtaatcccagcactttgggaggccaaggcaggcagatcacttgagctcaggagttcaagtatatcttttgtaatcccagcactttgggaggctaaggcaggtggatcacttgagctcaggagttcaagaccagcctggccaacatggggaaaccctgtgtctactaaaaatacaaaaaattagctgggcgtggtggcacgtgccagtagtcccagctactcgggaggctgaggcaggagaatcgcttgaacccaggaggtggaaattgcagtgagccaaggtcatgccactccactccagcctgggcaacacagccagacttcatttcaaaaaaataaataaataaataaaagtgataagaatgtgacatgttaatagggagagatattagtccgatggtaattaaaagcagagaaagttttaaataaactaaatggtgaagaattggtttgttcaacaataggagttattttgaagaataaagcaagtgattaaacatgtgaaaagtaatgtgcctatgccccaaagtgctattgcttagtgggttatatctattgataattacaatattagaaattaaaatggaaacggttgaaaatattcaatacatttaaagataactgtaataaacccagtatttgctagcataaacacatttttctggaaaataatgatattttctaaaccagaaaaaaatagttaaaagaatggtattgctttttgcaaatctctttaatgtctgacttagtagaagacagctggattttcatctgcttctgcctgccatctgttgtaatatattgaactgatccagaactcctggtctcaagccattgttccacctcggcctcccaaagagctaggattacaggtgtgagccactgcacccagcaaagcaaatagttttaaccttgttggttccctgaaaagattttgtgggacccttgtagtccttagactatgctttgagaactgctggccttagcaattgaacgtaagtacagtaggagacattggtagaaatgcttttgaatttacagtagagtctgggcatcaatattagatgtctattgatcttttattaaaagactaagagtttgagaatttaaaggctaaaacattataggtcctgctgatcagacttttcatagccagatagttctgtaggcttaaggccctttaaatccagataatgtccaagtaagtggcaaggcagcaatttggattccatagctgctaaaaagttttttacggcatttgtacatagatcattaagaagagaggaattatttctcacaaccaatttttagtgtagacaaaactggaatattttggagaaaaatgtcttaatagaatgcatatagcggtaatgtagtcttctatttggcaggaatatatatagggatggtcactttagattaaagaacaaataaaacttaacctacttataaacagaggcttctgtattgagaatttttcttagtataacatatattcaccttagtatcaagttgtgggggtttttgatacccccaaattgacagttattcagctgaaacttggagataggacagaccttgattaatatttggcaataattgtcagttctaatgttggaatttttgctctaaccttgttgattaagcatttaacttatttacatttttatgcttagggattaaaagtatgtctactttacatttatattcaggtatatatatatttttgttgttgttgttgttttttcttattattattatactttaagttttagggtacatgtgcacaatgtgcgggttagttacacatgtatacatgtgccatgctggtgtgctgcacccattaactcatcatttagcattagtatatctcctaatgactatccctcccccctccccccaccccacaacagtccccagagtgtgatgttccccttcctgtgtccatgtgttctcattgttcaattcccatctatgagtgagaacatgcggtgtttggttttttgtccttgtgatagtttactgagaatgatgatttccaatttcatccatgtccctataaaggacatgaactcatcattttttatggctgcatagtatatattcaggtatattttaaggcagtttttaagtatatcttttttctttaatagtacttacaaaaatgtaattatttgatatgacaaagctgcttcatattttcatattagcttgaactttccattgatatgtcaagcaaataaatacttagtttttttctgagtagaaaccaactgtactgcaaaccccattgatagtaaattaattgcagggatttaacatgtagggaaaccttaattattctgaatatacttatgttatgatgtgtagatgatttgtttactgtctttaatgtgactgagtcaaaatatgtgtagttatttgcataaaagggaagtgttgctaatatattttgcattacttaatgttatatataaaattaattttccttgtaagggatgtgagaaatttttttactcctcatttctgtttattctcatctatttctttgaaaatgtagatttaatttatttaaatactgtgtgatgaaaacattacagatatgttcttgctctctttttttttttgagacagggtctcactctgtcatctaggctgagtgcagtggcataatcatggctccctgcatgtcaacctcctgggctcaggcagtcctcccacctcagcttcctgagtgtttgggactacaggcgcgcactaccatgccgggttaacttttgactttttgtagagatggggtctcactatgttgcccaggctggtctcaaactcctggatgcaagcaatcctcctgcctcagcctcccaaagttctgggattacaggcatgagccaccacagccaatatgcttcattttctacctctgattataaattaaaggatagtattataaatgcttaattttataacctccaaatagtgatattgtattgctccttattgtgatggataaattataagacatatgtgtttaactggtttggtggcaagtctgtttacagaaatttgctgttaatttctcagttgttcacatgaacttatctgatttatagctttggccagcaatttacaaagaaagttcagtctgtagggcttcctgttgctctgagtgggggctccttctacccctgttcaacttcagtcagcccatggtctatagtatacctctcacaaggtccttatactgcagatcctctctgctgcagatgcttgggcttttgccttaagcacactggtgtaattagaagaagtagaaaagaagagaaagggtgaataataagagatgagaggatttaaaaatggttgaaacaggagttgtgaagtttgagtgtggtggatatggagatgtgcagccctgatcctccttcaaggaagaattgtggcccagttgtggggaggtcagtcatcagaaaaccttcagctgtctggcctacagaggacagccagaaaaaaaaaaaaaattgccttaagctgtcagctccttcaggctctacctcagttgcggagagcctccttgcttaaggtcacatcctttccagggcagcacttatcctgcaatcaagcaagacatgtttaaaggcccagccattttgttcaggcctgagacaactctgacaggtgatataccaccagagatctgccaggttgcttgaggctttgttgggcctgaattgcaatttgatttttccctctgcccaattcggctttcttccccaaatctcttcttcttctttttttttttctttgagatgaagtcttgctcttgttccccaggctggagtgtgatggcatgatcttggctcactgcaacctctgcctcccaagttcaagcaattctcctgccttggtcccctgagtagctgggattacaggtgggtgctaccacccctggctaatttttgtatttttagtagagatgaggtttcaccatgttggccaggctggtctcgaactcctgacctcaggtgatccacccgcctcggcctcccaaagtgctgggattacaggcgtgagccactgcgcccggcctctccccgaatttctttcacagggattgactgctaataaacatcatatacccaaaactacttcagtgtccattttcagagaatccagcttgcaacaggcaggcgtatcggcttcatgttgtcctaaaccttacgtaaagttctatgcaattttttttgtgaatttgcatttttcttaggaggtctgtggcttccattatcttctttaagatagacttgaaaattaaaggtttttctcatcaaggacttaagaaggaaaggcttaaacattttttttttgactcaagatcaaactaaatacacttggccattgaacaatatgggggttagtagtgctgaccctttgcacagttgaaaattgacatacgactttttactctcccaaaacttaactattaataatctactgtgtaccagaagtcctaccagtaacatagtctataaacacatattttgtatatgtattaaacactgtattcttacaataaagctagagaaaacaaagtgttattaagaaaatcatggccgggcgtggtagctcacacctgtaatcccagcactttgggaggccgaggtgggtggatcacctgaggtcaggagtttgaggccagcctggccaacatggtaaaaccctgtctctactaaaaatacaaaaattagctcgtggtggtggcaggcgcctgtaattccagctactcaggaggctgaggcgggagaatcgcttgaacctgggaggcagaggttgcagtgagcctgaaattgcgccattgcagctccagcctgggcgacaagagcaagactctgtcttaaaaaaaaagtcataagagaaaacctgtttattattcattgagtggaagtggatcatcataaagatctttatccttgtcatcttcatattgagtaggctaaggaggaggaggggttgctttttaagagggggcagaggtgattagtaggagaaaaattttaatgtgtgtatatatatatatatacacacacacattatatatatataattttttgtagagacagggtcttactttgttgcccaggctggtcttgaactcctgggctcaagtgatcagcctgcctcctaaagtgctgggattaccagcatgagacaccgtacctgactggaggaactacgtttttgatatggtactcagagaactgagtgcagtacagaagcttatacacccccttttttttatagggaagtggggaaatggagaatgtagacagttcttttgagggccagtaaatcatttaggtgggaggcagacattgtgggaaggtgagaggtgaagctgcaggttgtcttaccatgcagatgaaggccccctgggtaatctgttggagctgccctgggaagaatagatgaagtctttctgggcagtaatgatcatgacttccagcttcttctcatgtagtcgacctttcctgatcatttgatgagatccctaggaagggagtttaagacaattgcatttcttttggaaagaagcttttttgggctgataaggaaataccagagagagcccctctctgcgctggggtgggggacacgacaagttagagggatcttgattgtgaggcagcttctaaggcctttaagcatgtctaagtgccagtctttgggggtgtggtttgagagaccaaaatagatgcccctttattaactaggacagatcttaaggttaaggaaacaaagttacctatcggtagaaagttcagggccctgctggtgtggcaaatttctaaattcctatggctacaagaaaaatcactcttattaaactctctaacaataggagctttcagacaaattatcacaattctgatttacagcccagactactacaactctggacagaattcccaacttagaaacattcttttcttttcttttttttcttctttgagacagagtctcactctgtcacccaggctggagtgcagtggcacaatcttggcttactacaacctccacctcccatgttcaagaaattctccagcctcagcctccagtgcggaccactatgcctgggtaatttttgtatttttagtggagatggggtttcgctatgttggccaggctgttctttaactcctgacctcaggtgatctgcctgcctcagccttccaaagtactgggattacaggcatgaaccactgtacccagcccttagaaacattcttttctgataagctttatagaccttgagtttcaaccagctttagaggctgggcacaaattgtctttgcatcgtatagtttttatcttttgatgtaaagagccaaattccaccttattttaatgctaaagccccaccccaaagtgagcataggatgtatattacacatatgtttacccattgcacgtgcgctcagctcttctcgtaaatatgaatagctttcccctaaatctgctgaatatatatgattctgttgtgtaatatgggccctgtgaggcataaaacccaacctatccttcccctgtttgaagacagagcacctttggtttgcactggagactttttcttcgctggttgcaaacccatattcccagtaaagctctcctttctactacgtagcttctggttatcttttggatgacaggggtattgctttctgggccccaacactgggaagcagcacttaaccattgtaagcaaggagaagggtgtattaattttctgtttttcagataacaaattgacacaaatttagcagctttaaaacaatacccttttattatcttatagttctataggccagaaatctgatacagtgtgtctcactcagctggttctcagctccaggttttacaaggcagaaatcaagatgctgggaggatagtgtatgttcctttctggaggctctaggggtgaatgtttccaagctctttctggttgttagctgaattcagttacttgcagttgtaggactgaggttcccatttacttgctggctttttgggaagtggtgtttacctgtttaatctcagtggtgtttacctgtttaatctcagtggtatgtgtagttatatgggattgtgtgttttaaattgatctcttttgtacctttcctttctattcctttgatttttgttctttttcatctccttttactttctttgggtttatctattgttccttttcaaatatctttttttttttgagacggagtctcagtctgttgcacagactgcagtacagtggaacgatctcagctcactgcaaactccacttccccagttcaagcgattctcctgcctcagcctccggagtagctgggattacaggcgcctgccaccacacccagctaattttcctgtttttagttagagacagggtttcaccatttggccaggctgatctcgaactcttgacctcgggtgatccgccctcctcagcctcccaaaatgctgggattacaggcatgagccactacacccagcctttaaatatcttaataagaatacttagctcattcatttacagccttttttcatttctaagatgagcacttaagtctatacatttttctcagaataccttttttgtgtgacctggactgtgtgagatagttttttactttttcattttgaagtgttttaaatttcttttgttttgttttgttttgttttgtttttttgagatggagttctcactctgtcgcccaggctggagtgcagtggtgtgatctcggctcactgcaagctccccctcccgggttcacgccattctcctgcctcagcctcccaagtagctgggactacaggcacccgccaccatgcctgggtaatatttttttgtatttttagtagtgacggggtttcaccatgttagcccggatggtctcgatctcctgacctcgtgatccacctgcctcggcctcccaaagtgctgggattacaggtgtgagccaccgcgcccagctaaatttcttttatggtttctttttgacctgttgattgtttgggaattgtttagaaatacgggtttttaaaaagctattttttctttgattgtacattgtggtcagagaataagttccatgtgatatctatgcttagaaattttttagatttatattttgccagtacatgactacttttgtaatgttttatgtatatttgataaaaatatagattatctaattattggatgcagaaattcatatattccatatatcattatatgatccatacatattcaagcttgttaattattatttcctgaatataatctttgtttatttatatgcttgactggtcagtaatagaaaaatgttgtgtcaaaatctactgggaggggtggcgacgtagctcacccctgtaatcccagcactttgggaggctgaggtgggtggtctgcttgagctcaggagtttgagaccagcctgggcaatatggcaaaaccccatctctactaaaaatacaaaaattagccaggcttagtggcaggcacctgtaaacccagctactcgggaggctgagacaggagaactgcgtgatcctgagaggtggaagttgcagtgagctgagattgcaccactgcactccagtctgggtgacagagtgagaccccatctcaaaaaaaaaaattaaaaaaaaaaaaaaaaaaaacaaccctaaaacaaatctactgtgatgttaggtttgtccatttttttccagatttttttggcttgatatattttgagactattttattagatgcacatacttttaaaattactttgtcttactggtaatgtgaacttaaataattttgttatgatcctttctttcctagttgatcatcttttagtttaaagtttatctgataacaattacatgtagttaaacttctttcttttggtcaacatttgaccaatatgtcctttttccttctttcactttttttatttttatttttagagttggggtctggatatattgcccaggcagaagtacagtgactgtttataggcatgatgatagcacactacatcctctaacttgtggcctcaagcgatcttcccgtcttagcctcctgagtagctgggactacagatgttagccatcacactcagcttctttcacatttatacattaggagtccttttgctttttatatgtcttttataatagccattagttggattctttaatcttataatctttattttttaacataatgatttttgatttttgttcatccctcttgttcttggcttcataaaaaaaattgaggccagctgggcgcggtggctcacgcctgtaatcccagcactttgggaggctgaggcaggtggatcacgagatcaggaattcaagaccagcatggccaagatggtgaaacctcatctctcctaaaaatacaaaaattagccgggcgtagtggtgggcgcctgtaatcccagctactcgggaggctgaggcagggagatttgcttgaatctgggaggcggaggttgcagtgatccgagattgcgccactgcattccagcatgggtgacagagcgagactccatcttaaaaaaataaacaaaaaataaaaattgaggccaggtgcagtggctcacgcctgtaatcccagcactttgggaggctgaggtgggtggatcatggtcaggagtttgagaccagtctggccaatatagtgaaaccccgtctctactaaaaatacaaaaattagctgggcatggtggctcatgcctgtagtcccagctacttgggaggctaaggccagagaatcacttgaacccggaggttgcagtgagccgagatcgtaccactgcactccagcttgggtgacagagtgagacttcatctcaaaaaaaaaaaaaaaaattgagtgccttttacccagagcctcaccaacagaattgccaaacttttgattttttctttttttgccagtttgatcactaaatagtgatgtttcatcttacctcgaatttttttttttcatgagtgaagttgagcatcttgtttaaaaacatttgtggccaagtgaagtgctcaggtctgtaatcccagcaagttgggaggctgaggcagaggattgcttgaaaccaggaatttgagatcagcccaggcaatgtagggagaccccgtctctaaaaaagaaaaattaaactggtgtggtattatgtacttgtagtcccagctattcagaaggctcagggaggaggatcacttgagcccaggagtttaaggctgcaatgagttattattgcaccactgcacccaacctgggtgacagagttagactagatctcttaaaacaaacaaaaagtttacttttctcttttctgtaaaatgtctgttcatatcgtctctaccacacttatttttttggtgggattgtgtctttttagtgatatctgtgtttttttgttttttgttttttgttttggagccagggtcttgctcactgcaacctccaccttcctcaagcgattctcctgcctcagcctcccaagtagctgggactacaggcatgtgccaccatgcccggctaattttttgtatttttagtagagatggggtttcactgtgttagccaggatggtatggatctcctgaccttgtgatctacccgccttggcctcccaaagtgctgggattacaggtgtgagccaccgcgcccggccttaaacaagtttaaacacacacacacacacacacacacacacacacgttttttagagttggggcttgccttgtagcccaggctggtgtctaacttctggcctcaagtatttctcccaccttggccttccagatagtttggattatgggtgtttacccctatgcccagctctaaataagttttaatgccaaccatcacttctatttgtagagattcctaatgccacccagtgtaatgcttttggggctatggcagtgtaaatttggttttctcactgctgtttataattcagctttcttgggtctattgagttgatcactgcacctcactctgctttccactgtccaaaattttgtcaccattatttttttgtttttcttgtctttcagagttttagtgaggtttcaggaggaatcagaagttcatgcatgtattaagtcctttggttttactgaaagtttgacacatattttgaattgtagttattttgtctttcctaatttagatgcaaaattaagttgtctagtgagatactcagttaatcaagttgagatattaagggttacaaaaaggtttaccacactggtttatatacaggttaagtatccataatttgaaaatttgaaattcataatgctccaaaatctgaaacattttgtgagccgacaagagactcaaaagaaattttgaataaggtatactcaacttggataatattcatttgaagcatgtaaaggaaataatggctgttatgtgttatacacaaatgtgaagatagtgttgatttgatgctttacttttgataatgttgatctgatgccctggttttgatcacttaacagatacccatgtgctttatgggaagttgagttcttcttatgctcatgggctgagcccgaattaatccaaatcagtaatggtaattttatgccctctcccattgatttgatagtgagtggccttgagagccagttcattgggggaagttccccacttttttggtaaagaaacataagcaaggggaaggcagtctctcttatgatcctagacattaaattgttacttgcaactagtgtagctactttgaaaccgttaggggacaaaaagtcatcacactaaagatgacacaggaaaaacaaggaaagaacttaggtccatgatcttgatgaggcatcataaattacctatccctggagctgctgtagctctggactttttgttatatgagataataattcctcagattgacttagaataccaatcaaaataactattattttagctagctaagaaaaaaaatctgagtaaataccataaggttcagattacataaatatgaagatcaaaactgcaagttttctgagaagttagttattattgttttttactaatatgagctgcattggaaatttattttctttttaaaaaattattgctgtctttgtccataacttttatggacctgacattttagttgtttggaaaaattggtaattttaatcttttgttttggtatgattcaggttgacctgacattttaatacatctggctcctaggactgattaaagagacattttatttgttgaaatatgcacattttcttcatgaaattggttttcttttttatgtgtgacttttcttgcaaaagcttacaaggcacatgcttttgatagcagtgttacatttttaattaatattttagatgtaaaaggtgacagtttaaaagattgttttattagtgggttatccttaaaagcaagtggcatttggttttattttacaatagagtttaatcttacatgttttttgttaaagtaatgttaccaaaaaatctcttattgaactatttgtggtgaactttttaaggatgtttaagatttcacatgcagtttaactgatcacagatgaagttgtaaattaatacctcatgagcgtatttgactgcagggcattgttgtgaatcaaaaccgctttgttcctgtaaactgtgaaaggggtttaagcatatggattaaaattgcatggtgataccgaagtacttatgaaaagacactgtagttggatcatttaaaatgtactaaaatattacgaatagccataaaatataataattccctgaagcttttaagagtggtaagatttagttttatttctttgttggatttaactactttaataagaaattgttttgttgcttttggaactatgcatagtaatgagaataaccatgatgatgagaacactggaagcttcccagaaaacatgtatttcttcagaaatgttcttggttgtgacaaatatatatatgaagcttttccttgttcccatctgagtcattcccttaccagaacctttagaatgaaaggtttaatgatatcttctagtataagattatgaaatgagcattgtttagtgtaaaatcatatttttcttttgctgttaattttgtcttatagtatatgaaaatcacctggtgtagaatgtatttttcctgccataagaaactgtcaagaatctattgaaaaaataccatgagagtagttgttctggatgacaatggtaggttctgatttactgacgtagaagcaagcttcagttagccactttagtcataggtaaacactagattagcctaaggaaaaattgttgggaagcttttggagttctcatctgtgtcactgttttagatctcttcaagttctttgaaaattttggtacctccctgtttaacaaatattctgttttctgctatctaattagttctcatgtagatgacgtttctaatactaattaccacactttcttggactcctcttttataacgacctttatctccattccatttgatcaactgttttttaggactatgttctgaacctacttcctacccaggactgctttaaaaaaagtaatctatgttagcttcctgtttggcttcttcctagtttgactttactctctatatacagcctgagtggcatgctcggttatttcagctacatcttaccattactcagttctctctcccttttgaccttgctggtttctaaatctgggtcaatttgtgtgccttgcttcttgacttgatattacaattaacttattttgtcatactagatgttttcagccatctttgatccccaggttgctcaccaactcttattatcctttgaaatgactctcaaatcttacccctctttttgacttttatgtttgttgccctcatcttcatcttttttttttttttaatgagacggagtttcgctcttgttttctttctttcttttttttttttttttgagacagagtctcgctcttgcccaggctggagtgcagtggcgccatctctgctcactgcaagatccgcctcctgagttcacgccattctcctgcctcagcctcctgagtagctgggactacaggtgcccgccaccacgcctggctaattttttgtatttttagtagagatggggtttcaccgtgttagcctggatagtcttgatctcctgaccttgtgatccgcctgcctaggcctcccaaagtgctgggattacaggcatgagccactgcgcccagctcgctcttgttttcttgttgcccaggctggagtgcaatggtttgatcttggctcactgcaacctccgcctcctgcgttcaagagattctcctgcttcagccttctgagtagttggcattacaggcgtgtgccaccatgcccggctaattttttgtatttttagtagagacagggtttctccatgttggccaggctggtctcgaactcccgaactcaggtgatccgccagtcttggcctcccaaagtgctaggattacaggcatgagccaccacgcctggcaaattctattttttttttttttttttgagacggaattttgctcttgctgcctaggctgtgcaatggcacgatctcggctcaccgtggcctctccctcccaggttcaagtgagtctcctgcctcagcctcccaagtagctgggattacagacgtgtgtcaccatgcccggctaattttgtatttttagtagagacggggtttctccacgttggtcaggctggcctggaactcccaacctcagatgatctgtctgcttcggcctcgccaagtgctgggattacaggcgtgagccactgctcccagcccttcatctcttacattaggtgccatagcactcacctctgtggctctgtttcttctatcccaacagcacatgagggattgggtccccttccatctctccaactccctactcctactaccacataaattaacagaaactccctttagtagtaattctcaaatgaggtgccaaatcttggtctgtatggaatgtgtatttggttttaaaaaaattctaaaagtgattctcttctgaggtcctaaagggtcttttgcaggacttcctcaaattcgtcttttacaatgctataggagtcatctttgtcaaacatagatttactcattttacaactgtgtaacaacttattttttgccaagtattgggatagctactggagttagtaaagtgaatattagggtgcttacttttgagaaaaatgctaataatatagtatagccatcatttactggaacttttttaagtgctaggcacttcatgtatttatccttataatagtccttcagtgtagatattattagccactgtacagatgagcagccattctcagaattctgaggactcacatagtaattcattaggcaagtgataagctttatgataaatacttgaaagggacctctaagagcatagaggagggatatctagtttagagttggaagattaacagaataggcttcacagagaagatgatgtattaagctgagtatttaaagacaagtaggaacttagacaaaatgatagattggaaaatgagtgtgtggcatggttatatttgtgaatagtctttgtacagagatataagagaagcattttatgagaacacctggtgctcacttaggcaacacatatactaaagttggagaacagctcaatatgactgaagcatagtatgtgagatggggaatttagagtggtttagatataaagacattaaactaggttgtattttatatatttatacatctatatctatatatctatatctatatgcatctgtggtcccagctactaaggaggctgaggtgggaggatcgcctgagcctgggagatcaaggctccactgagccgagattgcaccattgcactccagcctgggtgacagagtgagaccctgtctcaaacaaaacaaaacaaaacaaaaacccagttagactgctggaatagtccaaataagaaatcaggaggccttgaaacgtgtcagtgggattaaagaggagagaggtggaattgaaggttatctggtaggtgcaatcaacagacttagtggtttaaaaagtgagtgagaggttatagtcaggttgggactatgtattaatcctttatttttttaatttactgtactgtactatgtattattgttaatatcctttatttcagattgacatatacccttaaatattcttaagatcatatccttaaggtcttaatagtctctgaataaatattggtataagctgcttcctaaatgatttcccatttatttactggtgtttttatatatctatttagagactgaatctcactatgttgcccaggctagagtgcaggagcatgatcatagcttactgtaacctcacactcttgggttcaagtgattctcctgcctcagcttcccaagcagctaggactacaagtgtgtgccaccacacctggctcattttttaatttttgcagaaacagactcttgctatgttgctcagactggtctcaaactcctggcctaaagcgatccttcagtccctgcctcccaaagcagtgggactgcaggtgcgagtcaccatggctggcttgaggagtgttttttaaaacatcctggccaactgtgagcattgagacatcaatttatcaaggctttactgagtgctcaagggcccaggcacattctaagtcctggaagagggagcacagtggaagttctaggacttagctatctagttaaatatcttcagtttaaacagatttactcattttacaactgtgtaacaatttattttttggcagtttctgaacttccagttttcacgttctctagtattgacaacaagctgataatcttgctagacacaacagactcttgaggaaggaattattcattgtggtttatagacaatgatatttgaagttaacttgccccagggcaggagtatggttcttatataatgtaggaaaaggccagtcaacaccagacctcagagctaccatttaatgcattgtggcaaatgattcgcatgtattatcacacttaatgctcacaagaatactaccatgaaatagttaatatttaaaacaaatttttttattttttaaggagactgggtctcactatgttgcccaggcttgtctcgaacccctgggctcaagtgatcctcccacctcagcctcttaaagttctgggattacaagcatgagccaccgcgagtggtctttatcattattatcgctgttttacagatgagaaaactgaggcacagagacctgcttatggtgacacaagtaggaattgaaaagatgagatttgaatctagctggtctaatttatcctgaagttcaagatagcaatacaagaattatgaacatataaatggagtgagtggatatgatcgctcaagataaatctcttggccgggcgcagtggctcacacctgtaatcccagcactttgggagactgaggcgggcagatcacgtggtcaggagatcaagaccatcctggctaacatggtgaaaccccctgtctactaaaaatacaaaaaattagtggggcgtggtggtgcacgcctgtaatcccagctactcaggaggctgaggcacgagaatcacttgaacccaggaggcggaggttgcagtgagccaagattgcgccactgcactccagcctgggtgatagagtgagactccgtctcaaaaaaaaaaaaaaatctcttggatgagaaaactagacttaggatttaaggaaatctacgttaatggactggccagaaaaacaagtcataaaggaaaattaggaagtaatcatgagagagggggatgttatgtcctattacctgaagcagaaatataaatggaaaacatatcagtgttattaactgaagggaaaagaaaatataaaaatatatctgttataaaatatattctgtataaaactcgaataccagattgttgtttgcattgacgttgcctgtaatcccagcattttgggagggtgaggtgggagagctcaggagttcaagaccagcctgggcaacatgatgaaactccatctctacaaaaaattagctgggcatggtggtacatgcttgtaatcccagctactcaggaagctatagtgggaggatcacttgagcccgggaggttgaggctgcagtgagccataatggtgccactacactcctgcctggggcgatgtactgagaccctgtctcaaaaaaaaaaaaaaaaaaagagaaaaaaaaatttttaagtacttttttacttagaacctttcaaatgccatgttatgtgtctttatatacagaaaccctgggcaaagacagtatggctctttttttaagaattaggagacatgagtgtaaagcatatttgtaaataacgggcaataaaattaatgcggaaggtttggcttacattatttggggagggaacatataaaattcaatattcaaattgttacatcaacttgaagtacagtgaatcatgactcagaaaatgtatgaagatgagacaaggtagttgcctattggaatcttaaatgatacttttagtagagatcatgtaaatctgtgttgatgttaaagaaaagtgaacataggctgagcgcagtggctcatgcctgtaatcccagcacttcgggaggctgaggcaggcggatcagctgagatcaggagttcgagaccagcctggccaacatagcgaaaccccatctctaccaaaaatacaaaaattagccaggcgtggtggcgggcacctataatcccagctactctggaggctgaggcaggagaatagcttgaacccgggaggtggagattgtagtgagccgagatcacaccactgcactccagcctgggtgacaagagcgagactccatctcaaaaagaaaagtgaacataaacttttaaaacttcattacagagtaaaaagtcttattacgtttttctggccaaaatttataaacttttaaaatatttcagtgaagttgagctatattagaggtatctctttatgtacctctggaatggaactttgataactgtttattacagtagaaaataggatctaaaatgggtaagttcattatttcactttgctttcttaatattcatggaaggtattttgccgaaattatttttggagagtatatgaaaagtaagtaatattttataaaactgtattgcagctgatttggagaatgagtggctactttgaaaattgtcagtagataggaaataaaaataacagaatgaagcagctcacacacttcagagtttattctcaatattgttgaattgggccataatgaagcataatgcctggttaaactttattgcaattcaaacatcccaccagaaagaaatttttaaaaactatatcaacaaataaattcactgaagtctgtctatagcttcttctaggaactacaatttatttatttgtttattttaatattgttttttgtagagacaaggtctcactttgttgcccaggctggtcttgaactcctgggctcaagtgatcagcccgcctctgaaagtgctgggattacaggcatgagccaccgtacctggctgaaggaactacatttttgatatggtactctgctttaaacgcagtaggtactctgctgaattgggctaaataaacatttcacctctcaaaactatgtgaatatttggcttaagcaaagatagcctgggaccatgaagaaagctaaaacacttaaaaaaaatgtacccttatttaaaaagtagcatgtttctttctgatttggagtgttatgtttttgttgaaaaattggaaattacataaaaccaaaatgaaaaatatagagatgatcagtaatttcaccatgaatataatactcctcttatcattttgtattcccttccaactaatttttctcttaaaagtggcactatgtttttgaaaaagctgactactttaagaaaatttctctcagtttactttcttaatcgtgtgcttttctgaagagttggctctgacgttgactactatagtaaatccaattttgatgagtttttcttttttagtgggccaaaaaaaaaaaaaggaaagaaaattctcctttgtagaaaaaggagggaggatggaatgtatattgtagtacacctgaaaatccataccttttcttagccatatacacaattagtttactctttctcaagataatatttttatagtaaattaggattctttgttacaagtgatgggaaaccaaactagtgctatgctaggttaaaaaaaggaatttagggactcaagtcactaaactactcacgcgcacacacacacacacacacacactcacacacactcacataggggttcaattgggccttaggaatggctaaatctaaggtctcaaaagctgtcagtttttttccttcggttcgttctttgtctctgagagttagcttcactttgtcagcctgcttctttatactcttcctgtttttcactctgacttactgtgtttataattatcttgggttagtttttcttattgctcatttggaaaaactatcagtacttctgattagtaatttcagatgtttttatattttaattttgtatgcaaaataagtatccgtgatattttaaaaatatttactaagtatttccctagtctttctctaaagggtaatctcaaatgaaacaactggaactggattctcatttgtttaatgactgaagaagtcttccaattactctacaaaccattgataacttttgttatttgtgaccagtattcatctagtaagatgttaaatgcttttatgaaagagacaagtgttttacctaaagaatgagaaaaaaaaaaccctaattttttgtgaagttttctccttttttgctgagtgcttaaagaaaaaaagtttatgttgttttaggtttttcttcttgcttatcaccctaggaactaattgtgttactttttaaatgtttaaatttaatttttcctgtcccttccccatgcttgctaattatgttttttaaaggtgaccctttaagatggctcttatagaataaagagagacactgaattttctaatcttgtggaagaggttatatttagccattggtattttaagttggagcacttcattctactgtgcctttagtttatgagtcatctggagaaaatgggctgcttcttgcttttaggaagagtctgtagcaaataataataataagtgctatgggagattttttgccaaataatttaaaatggaaaatgttttgtaatatattttattgcccatatgtaaaatacgtactaaagaatataggagtttttggctcattattatctttagctcataaaaataaacaaaagaggctgggtgcggtggctcacgcctgtaatccagcactttgggaggctgaggtgggcggatcacgaggtcaggaaatcaagaccatcctggctaacacggtgaaaccctgtctctaataaaaaatacaaaaaattagccgggtgtggtggcaggcacctgtagtcccagctactcgggaggctgaggcaggagaatggcgtgaacccaggaggtggagcttgcagtgagctgagaccgcaccattgcactccagcctgggtgacagagtgagactccgtctcaaaaacaacaacaacaacaacaacaataacaacaaaaccctaatgtcacatataacaaaaagaaagcattttctaccaaaacattatatagattgttatgagttataggtaagtggaaagcaagcataaaccatatgaaattattttatatgcaggatgtacagcagtggtcaaatcttaatgataattgtcagtaactggggagaatattgtgattattgaagtattgattttttttcaaatatttttatattacatgtggtaactttttataatcttgttttatatctactttagtatgatagctttaccatactagatattctatgaggggtagacagttggcaaaggatgtgatattgattctaattttggctacctttgtattatgtgtatcataatgatttcacgcttcagttttctcatctgtacagtattttgttcttcgtgacttttcttgcaggaatgaaaggaggtagcatggaacaaagaaaaaagtgtatcatattgtaaaacaggaaattttaaagtcctagagttcagattttaaatccaagatgtcatttttgaggtaaatttgtcaggtctccctgggacacagaatgactgcatcactagaatcatgagcccgtgggattgtttttttctttttctcaaatgtatttatttaacatctctctccctctctacttacctacctgcctacctacctacttacctctgttgtgaaacttttgggagctcagtattgtctactataccaagaataccagtcctttactcatttttttgcattacaaagatcatatggaatatactggaggggaatttaggtcttttggttctgtgttagaagagcccattttgtttttccctgcatgtggtagtcggtgtataggcctgtttctgtgatgggaagatgacaccttttgtcaaatctctatcctttttgtatgtcaaggaatcatttctttgcagtgaagtagagtgtgccctgtagtatagcactctgtgtccttagtcatagcaatattggaggattggagagttaatcatgtttgagaagttaggggacttgttctttcagcatctatttaatgaatctgcttgtatttttgatatcctaatgtgtcccaacactgaactcctaatctttcctctaaaacctgttccacctgcagccctctctatttcacttgatggcagttttatccttctcgttattcaggataaaaacctgagactcattcttgtttttcctctttctcttatatcccacatctaatccttaaggaaattatactggcaccacttgtgaaatatatcctgaaatctgatcacttataccatctaaatcgctaaagtcatctgtacccccacctctcttttgtgccaccatcatcctttgcctagatttttgcagtagcttcttagttactttctttccacctttgctgccttcaatatcttgtcagcacaacagattggcggacattttaaaaacgtaagtcagataatgacactctaataaaaatgagaaaggtttaaaaatagtaaagataggaagcctggacaacatggtgaaacaccatctctacaaaactagctgagtgtggtggtgcatgcttgtggtcagctactcaggaggctgaggcaggaagattgattgaacctggaaggttgaggctgcagtgagctgtgattgtatcacttcactccagcccccgtgactgattgaaaccctgtctcaaaaaaaaaaaaaaaaaaaaaaaaaaaaggaaatattatttgcaggtgaaatggttgtatttagaaacaagaacatttaagtggcaggtagttacagaattgatacacacaaatatattttttatacttttgtatgtttaaaaaagccacaaattacaaattatgttaacagcaatataaaaagaatgaaacatgagtggggtttattctaagctgagttgttcaaaattagggtatctattaacataatttacgatgcttctcagagggtttctgttgttcactcagtgactgcagacccactagtactaatgaactactctcttaacttgttattgaactacaccttctccaatgagtctgagtctttaacattgcatactcttttaatctgccttggggtactatatagagctttcttatatcttatagttactcttttattagagttaaaatacttctttatgttaaacttctgtttaccttactctgtgatttatatcttttgattagaaaagactaatgtaccatattagtaggtttttggataaatttttatattattttcatagatgctagaagagcatttgccaaaattcatcattgattcttttattaactttttgtgaattaaagtataacatacatagaaaggtataaaaatcataagtgtacagctgaaagaattactgcaaagtaaacatacttgcttaactaccatttagttctagaaatagaacttggccagcagcccagaagcacccctcacccccaccttcttccccaaaggtatcttctgtcctgacttctaacattggagattacctttgctgttttaaactttaaatatatggaatcatatagtgtgtactttttgtctctggcttctttggctcatcattataagctttatccacattgttgaacatagcagtgcttttgttcattttcttttccatgtcctattccatcatatgaatttatctcagtttatttttatattctactgttgatgatgaatatttgggttgttactagtttggccatattacaaataatgttggtatgtgaacattcttgggtgtgtcttttggtgctcatatgcacatatttcttttctttctttttttttttttttgagatgaagtcttgctcttgttgcccaggctggagtgcaatggcacagtctcggctcattgcaacctccacctcccgggttcaagtgattctcctatctcagcctcccaagtagctgggattacaggcacacgccaccatgcccagataatttttgtatttctggtagaaatggggtttcaccgtgttggccaggctagtcttgaactcctgacctcaggtgatctgcctgccttggcctcccaaagtactggaattataggtgtgagccaccacccctggcccaaagtgttatctttagaacagcagaaatgggagttccagtttttccactgttattttctatcttcagacaaacaactgtttagttatactggtaaactggcagtggtatatcattgtagttttaattgtatttccttgaccatgaccactaataaagttaagcttttaaaaatttatttatatgttgatcaattagatatacttctttgtgaattacttaagttttttacccagttttctattgggtgtttaagaatattttatatttatttatgtatttatttttgagacagggtcttgctccgttgctcaggctggagtgcagtgatgtgatctcggctcactgcagcctccgcctcctgggttcaagtgattctcccacctcagcctcctcagcagctaggactacaggcgtatgccatcatgcctggctgatttttgtattttttgatagagctggggtttcaccctgttggccatgctggtctcgaactcctgaactcaggtgatctgcgtgcctcagcctcccaaagttctggtattcatctgcaagccaccacgtccggcctgtttaagaatttttaatgaatttggctggatgtggtggctcacacccgtaatcccagcactttgggaggccaaagcgggcagatcacctgaggtcaggagttcgagaccagcctggccaacatggtgaaaccccgtttctactaaaaatacaaaaattagccgggcatggtggcacgtgcttgtaatcccagctgcttgggaggctgaggtgggagaatcacttgaacctgagaggcggaggtggcagtgagccaagatcactttattgcactccagactgggcgacaagagcaagactctgtctcaaaaaaaaaaaaaatttttttaaatgaaaaatctctgtactcagggctatgacactttttggttggcatatgtctttttggacttgttctttcattctttaaatggtgtctttgatgaaccgatgttcttcattttaatatggaccctctttttggtgttcctccctttttttagttttcagaagatattgtctatgattggttttacttctattggttttatttcttaaatgtttggtggaattcactggtgatacccttgaagcctggagttttctttgtaggaatgttccattaaaaaaaaaatacttaaagggctttttagattttttttcacttcttaaatcaactttggtaaaatttctttttctaagtatttgtacattttgtcttaagtgttaaaatgcgttagcataaccttttccctacagtatctttctgtgatttttaaatatgcatatgacctatcatttctgctaatgattatttgtgccttctttgtaagagttcatcaattttattagcgtttcaaagaactaactttggctttgttggttctctgtagatcatgatgtatgttttctatttccacgtatttagctccttttttttttttttttactttctttgggtttcatttgcagtttttttccttaccctaaccctacagttgtttttaaaaaaagattcttgagatggatacaggaccatataaaaaattttttttatgcatggcaagaagtttgcataaagtcagaagacaaattacaaacttgtaaaaaaattatttaataccaattacatcaaagtccaaggcctacttctttaatatgtagtgagtttctaaaagtcaataagaaggaaataattatgtattaaaaatgagcaatgtttgtgaagagttgatgtgtagaaaagttaatattaatggcagtaaaacatatgaaaggatgttcatcgtctcatgaggaattcaaaataaaccttctattattaaattggcaagtattttaaaaatcagtaataagtagtatgggcaaagttatagagaataggcgctttcataagctatcataaggatataaattgctacaacctctttgaaggagaagtttacattatttatcaaaattttaagtattcttttttttttttttctttttttttgagatggagtcttgctctgtcacccaggctggagtgcagtggcgccatcttggctcactgcaagccccgcctcccaggttcacaccattcgcctgcctcagcctccggagtagctgggactagaggctcccgtcaccacgctgggctaatttttttttgtatttttagtagagacggggtttctccgtgttagccaggatggtcttgatctcctgacctcattaaccgcccctctcggcctcccaaagtgctgggattacaggcgtgagtcatcgcgcccggcccttaagtattctttaattcacgaactatgtgtataaagatgtttatttccatattacctataaaagccaaaaaactagacataacctaaatgtttattctagagactaggttgtagctacccaatggaaaactatgtagccactaaaaggcaatagactgttggtactggttgttacagaacaagctccaggaaagtttttttgcagaaatacacattttattaaacgagtttgtgggtgaagtgtttgtattttgtgtgtgcatagtaagtttctgaagtgcataactttgtgtatctcactaggtaaatttgagtgttgtatttatggagttggatttacaacatctggtatttactattcagtatcactttaggttatgtttcgttttctcacttatattgtaagctcatagaaaatggaagatatggactgtgttttatgcttcataattttctccacattgcctagcatagtatattgagtgtgaaacagacttggtttttaaaaaacaatttaagaacaaatttaacactaaatatttgttttccagtttcagaacctgttcacattatctttggtgagctgtattgtagctctctgtagtagataggtataatactcattaatttattcatatgttaccatagggcgaactgagcccaagtgaataagtgagttatttaaagtaggggttggcaaactatgagctgtgggctaaatttgtcccacctcttgttctttatggcctagaagttaagaaaggtttttatatgttttaatgtttgggagaagaaagcatattttatgacacatgaatgttatatgaaatttaaattttagtgttcataattaaagtttattagaagacactgatgcatattcctttatgtattgtctatggctgccttcccaccactatggcagaattgagtcgttgcaacacagattggagttggcattttcattgcttcacactgctgcttggcatactacacatctcagtaatgcagttataattcaacagtgtttcaagtgccatatgtattgctgtgctataacactgtattttttttttattactagggcatacctatatgtcaaaacaagaaaaggagaaaatctcatggttttaaagcacagtggactggggattattttatccaattagatggtaaagcattaggtttattatgcccttctaaagaaatagaatatatattgccattaccaggctaagcacttacagtgttccaaattcataggaacataattctcataaaaattcaaaaatttgaaatgtaatatgttacaacagcagaatttttcatgcactcactttttctctcactcactctcacactgaaaaggaggctggacttaatataagattttgaatgacccatttgttagcaaagcaaggagagctatttactaatggtaagttagtaaattttcattgtagcagctaaagaatattttcagaaaaaaattacatttttaaaaatatcattagccatttggtgaccatagttgctttaagaattgaggacattaggctcgttgcagtggctcacacctgtaaccccagcattttgggagtctgaagcaagaggatcacatgagcccaggcgttcaagaccagcctgcgcaacatagtgagaccctatcttttcaaaaataaaaataaaaagagtattgaggattttaggccaggtgtggtggctcatgcctgtaatctcagcactttgagaggtgaaggtgggagaatccacttgagccctggagtttaaattcagcctggacaaatggcaagaccctatctctaccaaaaaaaccccccaaaaaaacaaaaacaaaaacaaaccagaattgaggacattagccaggcatggtggtgtgcacttgtagtcttagcttcttgggaggctgagatgggaggatccgtttgatcccaggagtttgagttcagcctggggagcatagcaagaccccatctctaaaataaaaacaaaaaagtgaattgaggacattgggtgtaacatcggtagtcagttaaagaagatagtggttttacttggctctgatgaaccaacagatgttactgacactgatcagttattcaaagagccaatgctgagtttgaagtgactgaaaaattagctttcatgaaaagtcgatgaaacatctgcagacgtgaatattttcaaaaaatttgagaaaacactaattcagcataatctgaagtagaatctgttaagatgtgttgctactgatagtagtaaaaatatatgtggaggccgggcacagtggctcaagcctgtaatcccagcactttgggaggctgaggtgggcagatcacttgaggtcaggagttcgagaccagcctggccaacatggtgaaaccccatctctacttaaaaaaaaaaaaaaaaattagcagcgtgtggtggcatatgcctgtaattccagctactttaggaggctgaggcaggagaactgctcgaacctgggaggtggaggatacagtgagctgagatgatgccattgcactccagcctgggtgacacagcaagactctgtctcaaaaaaaaaaaaagaaatatatatatatatataaaatatattaaaatacatatttatatcataaactttgtagatttctccacttaacctttttgctccatatatattttaaatatacattatacatatatatggatcagaaaaaagggttaattggagaaatctacaaagtttgtgaaactataaggttgtaaagcctatggctattcattgtattatttattagcagctattttgtagacaacatttgaatctatgatttattatttgaatatcatttattattgaaccagtattatcaacagtgaacttcatttgctgtatgaagagatagttctgtaagtttttatcagaaatttaagctgtatatttgacttgcctgaccacccatcagtttgattactgcagttgtttgagcttatggtcaagattcaaatttttctaaacaaggagaagctccttcaactactgttattgcatatgaaatggctttgaaaattagcttttactgaagactttatattgtttcttttctttcttcttcttcgtcttcttttttttttttttagaaacaggatcttgctatgttctccaggttggtcttgaactcctggactcatgtgatcctcctgcctcaagctcccaaagtgttgggattataggtgtgagccatcatgtccctggctaatacattatttcttaatgatactgatattgttgttgtttgtttctttctttctctctctctctctctccttgtttccttccttccttccttccttccttccttccttccttccttccttccttctttccttccttccttccttccttccttccttccttccttccttccttcctttctttctttcttctttgtctcttttctcttttctcaacagggtttcactctgtcacgcaggctggagtgcggtggtgctgtcttggctcactgcaacttccacctccctggttcaagcaattctcctacctcagcctcccaagtagctgggactacagcctcatgccaccatgcccagctaagctttttgtatttttagtagagacaggatttcaccatgttgaccagcctggtctcaaactcctaatgtcaagctatccactcactttggcttcccatagtgctgggattacaggtgtgagccactgtggcagcctttatatggtttcttaattttgaggcataccagtgcttatatgtaaaacttatactatggtaaagttatttgacagcagctaatgtagtttgaatcacaagtaatgtcaagctgctttatatacaatgtcccattctgtcaaaagttaaaacaagaagtgatacttctatttccacacacatttgtagcagatgtttgtgggctcaaactatagttttagcaatattgatgccagagcagagataacttctttatttcaaaatccatctaacactgcaatcacggagcttctaccttatgttacattagaagtgattaatctgcaatctacatgctaaaggggaaatatcaagaaaaagctctgatagaattctataaatgctttctaagtgataaatatgcttaatttaaatcatatgctattggatttatatcagtatttgggagtatctatttgtatatagagacattcaaagttgaaatatgtgaaattattatagatcaatgttaacagatgaatatttgcgatcaattttgattgataacagtaactttggccaggcacagtggctcacacctgtaatctcagcactttgggaggccgaggcaggtggatcatgaggtcaggagttcaagaccagtctggccaatatggttaatccccatctctactaaaaatacaaaaaattagctgggcgtggtggcgtgcgcctgtagtctcagcttctcgggaggctaagacaggagaaacgcttgaacccgggaggcggaggttgcggtgagcccagattgcaccactgcactccagcctgggtgacagaatgagactctgtctcaaaaaaaaaaaaaaaaaaaaagtaactttaaacaccaattaaatgaaatgttatttcccctaaaagaattacattcttctcattactaaacctgataaacaaaaaattttattgttattaatattcctaaatttgtcagtaaaagttttttgttttataagtacctagataatgtccttggtttttttctcattacccatagagcccaaactatttactacctggccttttacaaagaaagctttctgaccctcatcttcttctaaaagaataatagatgtctaattagaaaccagttatgcattgggttgagtatcctttattagcattttaaagttcttgcatttcgaaaatactaaaaatactcaaatttagaaaagttagttgtcttcataatgtaatttaaatgtttgaagtgttacaaaagagattcacctgcaattaaatatcagcagagtgtgtcctgtacccttatcctgcaacacttttctcctatagtaactgaatgactttggaattcagggctttgtatttttacctttttttaaagcttatttttgctttcttttcttttctgttttttttttgtttgtttgtttttttttttttttttttttttttttttttttttttgagatggagtcttgctctgtcgaccaggctggggtgcagtggcgtgatcttggctcgctgcaacccctacctcccgggttcaagcgattcttccacctcagcctcctgagtagttacaggtgggaccaccatgcctggctaattttttgtattttagtagagatggggtttcaccatgttccctgggctagtttcaaactcctgagctcaggcaatcagcccacctcagcctcccaaagtgctaggattataggcatgagccactgcccccagcctgtttttgctttcaaatggactgttgatggttttctcagagtgctttacttttgaagtccagtttgtactggaaagaatttatattccaggctgggcacagtggctcatgcctataatctcagcactttgggaggccaaggcagatggctcacttgagtccaggagttcaaaaccagccggagcaacttggcaaaacctcgtctcttaacaaaaatattttaaaatgagctggttatagtgctgcatgcctatggtcccagctacttgtggcactgaggtaggaggttggcttgagcctgggaggcggaagttgcagtgaacccaaatcgtgccactgcactccagcctccattacagagggagagcctgtctcaaaaaaaggaaacgaatttatattccacattttactgagtctagtgtgagtttttgtttaaaaaaaaacaacccaggaataatttcttcaaattcataagcatggcaggcagttttattttaaattctgtgggaaatatgaatttaaggatctcatgtaccatgccttgataatcatttctctgtaatgtatattttggcaaatgatattgttatgaaacatacttttgcattaatattaactttatgcataataaagatgcatcttcagttttttgtttgtcctatgagagtttacagctggggacatcttttacaaaagtatatttataacctgttcagaagatatgaaacacaataatgagataatcacctatgtatttttcagttagcagttacaaaaggattattgacacttatagttgttaatatctcagtaaaaacatactcttgtgcttattttaaaattgaacgctagtctatatttttaaagtttccttttatggaatattttgtcttttggcactttgcatctggattatagttcccccatttaagaaagaaacctgtttctattcaataggattaaaaacacactttcagttttagagcagatttatcatctacccttcaggctattctttaatatggagctcttaaaaatgagtatattaagatattccccagatgttttaaacttcagcaaacttgtggttttctttatttgtagtatttggaagatgaaagaaagtatctccagtatctaaacacttttcatattggttttaatgttgttttttttttttttttttttttttttgctagaaaggcatgcacaagataaagcttctacactgataaattttcaaagtccttgcttttaaaatatcaagctgggtgcagtggctaacgcctgtaatcccagcactttgggaggctgaggcgggtggatcacctgaagtcaggagttcgagaccagcctggccaacatagtgaaaacccgtctctactaaaaatataaaaaattagctgggtgtggtggctggtgcctgtaatctcagctattagggaggctgaggcaggagaatcgcttgaacccgggaggtggaggttgcagtgagctgagatcgcaccattgcactccagcctgggcaacaagagtgaaactcttgtctcaaaaaaaaaaaaaggtattgtcaaaatgagagttgtattagcagtaatgtaaaagtaatattgtatgtctgtatacttttgaatttacattgttatgtgattcatatttgttttgtatagctgtaacatttggttaattgtttagtgggttattgaatagattattttcttcattacttagtacagtggggattgagaatgctttgtatcaagtgtcttacaagtattgggaagttcgaattaaaaatattaaagatgtcagtcatttacttctttttttttttaaggtggtagcccaattgaaaattttctgcaaaatcagtaactaagttatttttccacaattataaacttagttgatggcatttattgagtgcttactacgttcaaggtaaatgaaatgaaagagtggaatagtgcattatacacgcacacactcaagggaagcaagtataaacaccttatttcatctcacttgtttagaaatttgattttgttttttcttgctgggtaacatatctgtgttaatcgaaaatttatgacttagagtggaatttctctaaaaagcagtaggtgacagggatacaagataaataatttcatcagagaatagaaattcttttttacaatggataaaattgtgcttgtaacagggatacaagcacaaaccaaatcaatgtttaattattttaaaaatattcaagggaaatctagttttgttaaaatttgtataggttggtagtgtgcatgttcttaaaaatccaagaacaatagcagcagcaattcttatttaatctttctttagtgtgtccattcaaccattcattcatcaatttttttttctgtgtacccattattcatcaggcactatgcttaaatatcgtggaacacaaaaagaaatagtctttaatgctgtgttttacaaatgaggaaacctaatctcggagaacttaaattacagttgtcctttggtattcatgggggattggttccgggaacttcctcagataccaaaatccaaggattctcaagtccctgatataaaattctgtggtatttgtatataacatatgcatatcctcccatgtactttaatttctagattacttataatacctaatataatgtaaatgctgtgtaagtagttgttatactctcttgtttagggaataatgtcaaggaaaaacactctttacatgttcagtacatatttttccaaatattttcaatctgtggttggttgaatccatggatgtggaacatacggatatggagggccagccgtacttgccccatgtcatataattagatgaatatagaattaaagccaggtccgtctgacagagcgtttgcttctaaccattgaggaatgttgcctaccctgatgactctactataggaaatcatatattgatatcaaattgatcttatatgtctgtagtgaggaacttggccatgttggacctatccccttccctccttgctcctctcctttcttcctcccttacccccacagcttcacccctcccttagctcttttttctgacaggtggctgtttccatccctgtttgctggcaccttctccacttaaattttggtatatcccttggttccactctctgtgttcttctcttgtgtatgagtgtggattttgtgtttgcttatcctgtgtggagtttctgagcttgaatctgttaagagtatgtcattaatcaaatttggaaatttttaagccatttttttttctttctttcctttccttttccttttttagaagcaggttcttgctttgtggttcaggctgcagtgcagtggcacaatctcagttcactacagcatcaaactcttggactgaagtgatcgtcctgcctcaacctcctgagtagctgggactacaggcatgcatcactatgcctggctatttttatttttttgtagaagtagggtctcactatgttgcccaggctggtttcaaactcgtgggttcaagcagtcctcctgctttggcctcccaaaatgctgagattatagttgtgagccaccatgcctggtcaagccattattttttcaatttttttttttctgcaccgcacttcttttcttctgttactcatgcacaaatttagatcttttagtattgtcctataggtctgagtcttttttcattttttaaaaaaatcctttttctgtcctgcagattggaaaatttttattgatttatttttaagtatactgattaacagtcttcttcattttactattaagcccatctagttagttttaaatttctagttattgaatttttaaattctaatatttttattttatcttctttatcttctgtttctttgctgagtcttttcactttttctagctgtctgaagagtcctagtagtttgtggttccctggagctctccgccttggtaatccagccagagaactggggctttattttctcagctctgcacatacttcctgtgactgtaaccatgtctgggtctaagtagtaggcagatactcttctcttgcttttttctttcttgtgttttagtcaaattattttacctcttattataactttgtttattattatttaccaacactttatatgcaaattgtagattattcagattgtatcttctaccagagtgttcactcttttctgtatgaggctgatacggagtgaggggagagcttattaccttaataaaaattaagggttaagctaggtcaaagttgatttttcagtgttgacagttcagttgagcctgtttgcttctgttcctagagcctgaacctctaggacttttaattgataccagtggtctccgctctgaaacagtccaccagaatgagggtaccaaactgacctcagaggtttccaggttaatgcagaggtttctagcttaatttctttctgccttcaaaatttggcaattatgtcaaaggggaaaatgatcttttgttttaggttttcagtttccaatgttactacttcagccttatgtaattgctaaaatccctactgttttccccctattgcccccttccttatcattatcttctgctaagcacaaagtgtgaattttcaggttccacatgtaaccagtataagtatatccttccccccaaaccccagtggaaatgtgccacggatccttatttttattctccactccttctagggctttcatttcttgcctattatgtttttagttgctcttttcttgttctgtctttgtaagcacagctagagtcagagaactttctgcttttggaactattttggttaacctctttaacttagcattcagtttcagaattcagcaaatgtgttttggggcaaactagctgtgtgttttaggtttgggaaatgtcaaattttgtttctctgtcttcatgcttctggctgcaaatgttggcaggtggaacaaaaagctgccagttctggcctgcccctgtgaacaggtctcacctctccggaaatttatccactttgtccttgttgcttcagagctctttggtaccattaacaatgtgacttatgatttatatggccttcctaggtgtcatcagtaggaatgttggctgtgatgcagtatatgctacccagaatcggaagttccatatattatgttttgataagagattttaggtgtttgagtatttctgatgagtgacattttttgaagtttgctagagagaaataattagctagttattgcttaactactctctctccatatctattacatatgtttctggaatatttctatggtcagagaaactcaggcccattataaaccatggactctggtagaaatagaagctgaaagcaaaccagtaagggaggtggagtgtataatttgtgttttggaagtacctgccggtggacttgggggtgatgctctaggtttaccatgagattactcatctaattttgagaaccactgtcctgcagtatttttcttttgcttacatatgactttttctttttatgatttaaaactaaatgtcaaccagttactatttaatgaaaatcataaattggtttagtgaaattttgttgtgttcttacaatgggtagaaacctaatgcacttatcatgcatctaaatttaggaataattcattttattttaatcatctatacttatatacaaaatgcttttcagcagtatatttgattatcttaggtacaatgatcttcatgttcagagttataaatgggaataattaaacctttaaacatattagagttgaataagggcttatctaagcaatacatgcttaaaattgctttcttatcaaaaaaataaaattggaggttcaagaagtgtctttaaattacaatccttatgaactaatagcttaaccttagttttgaataactgttactttttccgtcttttaaaaagatgcttaaaaataaacgcatgtcgaaaatgttattttggcttttagcaaactgacatttgagttttttaaaacctcactaaacatttgtggtaaaagatttcaaagctttgaattttacaatttgcctgtcgattccccccctgtgttattctattaacatttgatcttaataagtataacctgtttagaatgacttatgtttttaattatttgtttagatgagaagtttaaggaataacttcatcagaaattctacttggcagttatgaatgctttcttaaggaagttaaatttttggaatttcactgtaaagattttaatcacatgtcctattcttcatacatcaatctataaatgttcaaaaattgttaatgttgtttttatgctgtgctgatgttaacacaacgtgaggtcttctttcttctcctgataatatgctgagcgcacacacactctcatatgctcactcgctctctctctctctccttccctcccacccctgagtttgaaataagttagtggctttagtttctttgaaaatggaaagcaattgcccttaggtagaactggaaattgtaaagtgttggttttgtggacattttcctgttcataattcttgttatatcttatttataagtacttttattcatataggaataaatgattctatgttgaagggtataatcatgaagtcttttttattttttcgtgttagataaggagaaaaatgacacattaaaaattacagtgctatttgtgttttaaaatttcttctgtcgcttttgtattccttattgttctcttcactttttctattgtttttctagcttttcaggatacattttctaaatgcatcctaaatataacttacaatagttgccttttatttaaaagtaatacatttagtttccaaccacaaagtgtttaattctacatatttctatttttattttacatgatcttaatatatccttgattactgtgttgatcttctagtttttaggctgccacttataccatcaaaagccatttaaactggacttagaggataatgaatctaaattttcttatcttcctcaaaacaacagatacaattaaagtcacaaataagctgtaccttcagaattgctaggagacagaacatagtaagaattcaaatctcttataagcagagttataaacatcatattccaatattgattctgctgctttgtctgtacatttggagagcagaggtagcagggaggtttaagagactgaaaaaagggagaggggtgtatgaagtgtagatcagtaacaaacaccatcactcttgaaaagaaaaagtccaacagaggtcctagacctgtgttttagacaggtgggaggacagtaaattaatttttaaagacaaaataattatattgaatgaatttattgatcattttgttgaacagttagtataaggacatcccgtattatatttcagctttcataaactataagtgtttatgtcttatattttgtgttctttcaactttatcttaatttgcttctgttatttttaatgccatttttgtacatttgtttaatattactatattcatctttgttgtaattttttcctgtaataatgtaacataaataattataatattacaaagtttattaaatttcttccaatgataattaatatagtaggcttgtggtggaaaaatggatcaggtactgtccttccaattctgtcaggcttttgattgaggtgtttatatggccaccccgttcagacaaagaatgtcaaccaaaaggagaaagtaagaaggaatctataaattactaaaattcccatactttatttcctatggaaaaagtcatgtaaggaaaatatatagaagtttcccgtaaaatgtaataatatcataaactctttcatccttaaacacctgttagtcttgccacagcacaatcagttccctaaagataaatatttcttggtttgttagttggctacttaggagttccttttccttcttatgagttttcttctctcctgtatttcttttctaacaccatccaactggttatccaaactagcaacctcagaattttcatccctcttccacatcttacatttctttatcacatcctgtgtcttcaacttcggaatgattccttactttggtctcgtctctctatcctgtctttcgtatgagctattctaaaggcaggtggtctgcttctctttactctgtccagtgttatcatcatttttaaaaagtctgcttttcacactgttgctaaatagagtttaataatttctagtagccttcagaataatgtctacacttattagcctgatagttaccttttctttgtcagtttttactactttgattttgacctgcattttagtctgtgtttaactggtttttctgaatacgtcatgtttattgttttagcctcaaccctgaattttttttttctcccttaagtgtcaaatttcaattcagatgttaaactttccctgcctttttcattcagaatcacttctttctttgctcttgttttttattcagctttgttctatatatggttctttaaaaataattgtatggaaaattgctatgttcttttattataaaatgaagttgatttttcattacaaaacagtttatatgcttattgcacaatctaaacagatgtataaaagagccataattgttcctaatttggcgataactactgttaataccttggttgtattcttccaggttcttttcagtagacatgtatattgggtaattttgtttacacaaaaagattacattgtgcatcagttttcataaattagcacttctcatttgaaataacatggaaaatacctatcaatagatgtaaatctattttaaatctgtaacatttaaaaatgtttaacacttaagtagaagcaacacatacacatagtaaaactacatcaaggtggaaaattaaacgcttatttgaagacttctaattttgggaaattgactaattctgctattcttcaggatttctcaggccaaaattcagaacaaggctaaatttgcccatttccacctactattatttattctttctttatattatgctagagcttgtaggctctgtactaacacaagaaaggggaagaaaaaaattgtccttattcacaaatgataattatgtttaatttattaaaaacacataaatcattggagttaattaaatattagaaacttggctggaaaaaattgatataaagaatgtttctaaatatcagccacaaataaagattaaacaatatcataatagtattaaaacataggaagtatgaagtagtgatcagaataaaagatgtggaggctttgtggcaaacattatgaaactttgagagatactgtaatcatggattagatgatttaatattggaaatatatcacttttcccagcatagatatagataagtagtgcaatcactgttaaaatcctaacaagttgggctgggcatggtggctcacacctgtaataccagcactttgggagtccgaggcaggcagatcacgaggtcaagagatggagaccatcctggccaacatggtgaaaccccatctctactaaaaatagaaaaattagctgggcatggtgggatgcgcctgtagtcccagctacttgggaggctgaggcaggagaatcacttgaaccagggagtcagaggctgcagtgagccgagatcgcgccagtgcactccagcctggcaacagagcgagattctgtctcaaaaaaagaatcctaacaagttggtttttggagtttgacaactagttgtaaatttatatggagtgcaaaaaaccaagaacggccaaagcactcatgaagaacaacagggtaaggacacttgtagatagagtgtgtgtgtgtgtatgtatatatatgtgtgtatatatattatatatgagagatagttataagatactggggtttctaagtcagtccagtgtgttttttcttaacctgggtagtggttacacagacattcactttttttttttttttagaacagaaagtttctaagaatttatagcaccaagacattcattttttaaaaattgcacatttattttacttatcctagagaaatttataaaaaacaaaagtaaactataaacaccagttaaaaaaatccttttatattaactccatagagatgcaaatactgttaacagttaatgttttcaggggcctggctccatggcttgcacctgtaatcctagcactttgggaggctgaggtgggaggatcgcctgagctcaggagttcgagatctgctgggcaacatggtgaagcctgtctctaaaaaaaaaaaaaatacaaaaaaaattagccaagtgtggtggtgcatgcctgtattcccagctatttaggagactgaggcgggaggatcccttgagcccaggaggtggaggctgcattgagctatgtttgcaccactgcactccagcctggatgaaaaaggaagattctgtctccaaaaaaaaaaaaaaaaaaaaaaaaaagttaatgtttttagcttaccattataagtctaaataatgaatttgtgcttatttttaattaacaaacttatacaatgtctgtaaactctatactggaagatgaagaatgtagtgcacttacactgttttgcctttttattcttccttatatttgctttagtttgattttttattgattgactttatgacttcaacaatatatttaaaacctttttaaaaacttgatttttaacatttgagatatttatggagtcttctccatgaaagggagaattttgcatgcaatagtgtatgatgggcacttttaacttttttatggctttctttttcaaagtcatacaccactttacttttcttttaacctaattccatctttcttctgttttttttgggggggagaggttggaacatctccttagtaattttttccacataggaaaaaggattattaaatattactttgccttattaacctgataatttgagtacatattgaaaatttctagtttcaaaaatttcctcccttctcagcatagaatacattactccattatatttttagcatccggtattctttgagaagttaagtattagtctgatttttattccttttaaggtaattattatttttcacattatatgctttaaaggttttatcttaatatgagagattaaacaagatgtgtccaagtatggggtcctagtccctaatcccttgtaaaactgcttgatgtttggaaaaatctgaccatatttatgtttcaccttttttttttccaacatttctctcttactcttcataatctctattttccctttctgtatttcctgttaaacagatctcagaccacctaataaattctctacaccttttaatttttatttcatatttttaatttcttatattttctatctacttttttggtctttttaaaaatttcaacttttctatttttatcttagtttttacccatgcatattttgattgctcaggtaatccatccaactattgatttttcaaaaatttttcaataattgttagtgtacagaaactgtgtcattctctagctgcatcttttcatataattagataggtctgtttgtggcatctttctttccttgctttacaggcagtactgttatacttttgtttatttttatacataaaacatattttttgacgtttagtaagatgtggaagaggaaatgaacatatacttcatctcttttgaagtgtaaggtcttataattttcatacttcttgaactgattccaagggtaacattaagtgaaattttgtttagtttctatagaaaactctgttagttgtctggaatgaggagaaatacatgctgatttctgtatgtttgtagtaacaagtgattctgagactgggattctgattttgacttaaccagtttgccacgtgacctccatttggcaatctattaattattacttttactttctgtttagtttaatggccaattatggacagtctgttttaaattcttaaattcttatagttgtacacttatggaaaacatttcttaaatgtggaaatttagtatttttgttataagatatttcaattcatttattcaacatacttaaacaataaaaacattttactatttgtgttttaatactcttctgctcagaaaagtttactttgttgcaactcacagaaggtaacttacttttttctactgtgatttccttataggtttgatgaacttgtgaaaaaattcaaagtcgaatatcatgctggtggctctacccagaattcaattaaagtggctcaggttggttaattattttaaaagttaaaaggattcaaaatgattctagacccatgtctattttgcataattgtttccttttatattgtgttgctgtagaatagttttgttcatttgaattgggattttagtagtcattgcacatctaatcaaaagttattttaattggtatttctttggttattggtaagcttgaacttttaatgtttattgttcatttgtgtttcttcttaaattgtttcctttcactatcattttataatttttcatgttacagatttgtagaaacttcatattttatagatagtattcctttttattttataagttgaaagtatttattttttgttatgtgtacattaactcttacagtgtcttttactgtgccttagttcttaatgtaactttcaaagtttttaacgtaattaaactttatggcttcttcatttcctgcatgtcccccttacgaaggacgtttctgccacaagatagtagaaattgctctgtattatatatagatatctatatacataaatgtacattcatatattcatacctaaatatctatgtatagacatatatgttggtagatatgtatatgcatctatatatctataccggtgtatatcttttataaatctatatatctgtctctattcccatatcttccaatgagtaattgaataaacccattaggcatatactctttgagttaccagcttaacctaatcttgattgagagagttagtgatctgtttaatcttccagctttgaaagatatgaacaagttttacatacctctggttcttacctctgcagtttgaagttaactcaaaattctgctcattgcaatcatgtgtcagttctgcctacactagatttctttttcttttttattgattaatgctttccccttgaattctgattaacttcaagaactggggaagtggaaaattgacaaataaaatccagaatgatttcttttcaagtaactcttagttgattgagacatatagtatgattattccacatacttccaagctcagatttaatcatagttttcaaatattttgtaaaaatgaatctttaaggcggtcattaatatgaagtggcctgagtctttgtattggtcaattgatttgtattgtttttggtaaaacatcctggtggtcactttatgaacttccagagtaatagaaaaaggatgatttacggccaggcacggtggctcacgcctgtaatcccagcactttgggaagccgaggtggacggatcacttgaggtcaggagatccagatcagcctggccaacatggtgaaaccccgtctctcctaaaaaaatacaaaaattagccaggtgtggtggcatatgtctctaatcccagctacttgggaggctgaggccagagaatcggttgaacctgggcggtataggttgcagtgagctgagatcatgccactgcactccagcctgggcaacagagtgagactccatctcaaaaaaaaaaaagagagaaaaaaaggatgatttacttaagccttaatttatcaaggcacgttttgcattttgcagttttcagtcttttctcctgctagaactgggggtgatatggttaggctttgtgtccccacccaaatctaatcttgaattgtaatctgtataatccccacatgccaaggaagagaccaggtggaggtaattgagtcatgggtgcagtttccttcatgctattctcctgatagtgagtgagttctcacaagatctgatggctttataaggggctcttacccctttgctcggcatttcccattcttgctgccttgtaaagaagatgcctttcttctcctttgccttctgccatgattataagttttcagaggcctttccagacatgctgaactgtgagtcaactaaaacttttttctttataaattacccagtctcaggcagttctttacagtagtgtgaaaatgaactaataccgggaggctattagctgttcactaataaattgtctcctttcttggggatcttcatcagtttctgccttctaaaagtttattaattatataattaagttctccctcagctttctccctgatattagtctcataataaaacagtcattgcctacttttattcttttgcacttttttttttacaatatttcacattcattctaacaacgtattctagtagtggtttatttgttcctgtctttagcaaggtaataaaaggaatttgaagctttgggtaacttattctgtcagatcttactagtaatcatactttcatgtatcaagtgatatggcaaattatgtcaacaagaaaatgtccccaaagctcttaggtattttgatatgtcaaatcatgtttttgaagattttaatgaaaccataggcaacaaaaacaagtatggttgatatcttgtccaaacacaattctagatttatttgatacacagcacaaatgtaaattttggtaaatttcatttggtctgaacttcttcctaatgaaagtgaaaagttcttatctgctcaatatcctgcacagcatgtatataacactgctaaaaaggggtataacttgcttaagtttgataattgatgctttcttaatgaacacttttggttactttgtcagtttttaaaaaatttgtagaagcacttaatgtgagttttgacttgaaagaaatggaaaaacgttggcattgtgactcatgcctgtaatcccagcattttgagaggctaagttaggagaatcgcttgagtccagtagtttgagaccagcctggacaacatagtgagaccctgtctctaggaaaaaaaaaaaaaaaaagaaatggaagaaaatgacttccttggatatgtgcctaaaagatggctattattgttgctggacatagatgccctgcagtacaatattaacaaaatatgggaccaaaggaatgcccatctctgatttggcagtacattgagaatgagaatggaaaaagaagattatagtaaaacaaatatttttatgctgtttctggtttttttgtttgtttgtttgtttcaagacggagtctcactctgttgccaggctggagtgcagtggcgcgatctctgctcactgcaacctctgcctcccgggttcaagtgattcttttgcctcagcctcccaagtagctgggactataggtgtatgccacaaagcccagctaatttttgtatttttagtagagatggggtttcaccatgttggccaggatggtcttgatctcttgaccttgtgatccacccgcctcggcttcccaaagtgctgggattacaggcatgagccaccgtgcctggcctgtttctgtttttgaagaggccacaagtgggctagaaaaaacacataccaaaaaaatactcaaataattttatttgttcattatttattaatttttttgagacagaatctcttgctctgttgcctagactggaatgtagtggtgtgatcatagctcactccagccttgaactgctgcgctcacagggtcctccttcctccatctccacctccatctcctaggactacaggcacaccctaccatacctggctaatttatttgttgtagagacagggtctctgtgtgttgctcagattggtcttgaacttttggcctcaagtgattctcctgtgttggcctcccaaagtgcgaggattacaggtgcgaaccattttacctggctcaaatggctcatttttatatattaagagtgcttcagaactcaagtaaaaaagtcacagaaaagagcaatgaggttaaataaaactttttttcagtttctttactaaaactgtaacttacttggaatccagttttgacatcagaaattcaaattcaggtgttttaaaaccatttctgcaagaaagaaatttaagttaggatgatagccaatgtctttcagagtgttttaaagtgatggacattttgaacattgataagcctatataatgaatctgtaaacacaagggatatgattcataaagagctggaatgccaaaacctgcatttagctaaaagatagatggatatttttatagaactataaactaattcctatatctaaacacctattattgatagtaattaaaatcctaagtattctatgtttacatgcttttgttgagaggatatttagcttaatgtcattgcactggactgacatcaagaatgtgggcttgatgcatcagaggtataagtcacagtgaattttacctttgactgtattacgttttaccacacatacaagaaggattgacctaatggctctagtcaagtatagaaaggaaacataaaagtaaaaatattttattatttcttaggcaaaaagaagcatgcctttattctttttaattaaatattggtaaaatgtttaatccaactgtggttacgttatttttttaaaaagtgtgatagaaataaacaacagaataatatatgattttgaataagttcaatattagtttgctagggcagtcttagcaatttcagagactaggtggcttaaacaacaaagatttattttctcacagtgttggagtcccagatcaaagtgttgacaccttgattccttcagaggcctcgcttcttagcctgcagatggctaccctctttctgcctctttgcgtggtggtttctgtgtacatatgtacctctggagtgtctctgtgtgtcctaatgtcttcttataaggacaccagtcagattggattaaggcctaccttactgccctcattaatttaattaccttgttaaagaccctatcttcaaatgtagtcacattgtgagatactggggtttagggcttcaacatatgcatagtggcaggagggtctgtggaggggtgtttataattcagccgataacaactatgtgtttttaaatttttgtgtctaagtaataaaacatgaataagttaatttttggtagtgttcttttttgataccttcttccttttctttcctgtatatgttttagttacttttattatttaccatttgaattacaatgaacattctaaactcataacaacctaatttgaataataccaatgtagtttcaataatatacaaacactctgctcctttacatctccatcctcttcttatatattattacgctcattgattacgtctttatatattgcatgcccattaacatagatttgtaactattcttttattcatttgtcttttaaatcatataaaaataaaaggaattacaaaccaaaagttcagtgatagtggcatttatatttactatgtagctacttttaccagagttctttacttcttcatatggcttctggttactatcaaatgtcctttcatttcagcctgaaggactctctttagcattttgtgtagggcaggtctattgttaacaaactgtcttagcttgtgtttatctgggaatgtcttaaatagcccctttattataggatagttttgttggatatagaattcttggttaacggtgcttttcttttagtatgttaaatatgtcaactcactgctttttggcctacatggtttctgatgagaattagttcttattcttactgagaatcctgacttgtgaccagttgcttttctctcactgatttcaaaattctttccttgtctttgtctttcagcagtttgactataatgtgtcttggtgtgaatctttttgtgtttatcatgtttagagcttattaaattcatgcttcaagttcatgcttggatgtgtagattcattcattttatgaaagtcaggaagttttggaccattatatcttcaaaaatttttttcttttattttctctttgttttccttctggcattctcataattaatatgttggtctgtggtgattgtttagtgataaggattctgattaaataagatagaaaaaaacaccatggtgagtaagcaaagcagaaatagaaccccactgttttaactagtaacctcagcttgctttttttaccggagatttttctctcatcctgagaaaacttcaatttttacttctctaaatgttagagattttgagtagtgtttcacatgctttcttcacttcttactgtcttcttcaatttgggagtaattgtaggttgtcagagagagtgtcgaatatgcatcactttaaatacagttatcagtaaatggactctttcattcatgcttcccagagatgacagttttccttggtgcctagatacctttttgttccttggagattcatagtattatgtgactcattgaatttttcagaagcctgatggtgagcttcgtgaggtatttctatttaagttgtaagttcgcttgtttttaagcttcctgcaatttaacttacctatagtatttttaaatttattttaaaaatgccatcttggggtatattctaggcatctcaaaaattttaaataccatcttatcctttgttaactggaatataagcaggtaatcatttgaatcattttttttcctgtaattattataacattgaggctatatggatttttttttctttttttaatttgaggcagagtcttgctctgtcacccaggctggagtgcagtggtgcgatcacagctcactgcatccttgacctcctgggctcaaggaattctcctgcctcagcctcctgagtagttgggactataggtgcacaccaccacacccaccttatttttaacttttttgtagagattgggttttgccatattaaccgggctggtcttgaactcctgggctcaaatgatcctcaagacattagcttggtctcttctcaaattagcagatccttatttctgtcttataatttctaatctgcttttataattattgacttacattcaatcttccagtttttcatgtctcttccaattagataagcctccatatttgtatttaacttccagtaaaattttaaccatgttgtttcatttttaattaaaatttaagaggactgcctaaatgccagtgtgtttatgttgtatacatctcggggcatgcttttaagtgttttcttgatgtaaaacatcacataataaactagtgttcataattgtattttaaagctttccaaaattctatgtaaaatgagtttctaaaaacactaaacaaaagaagttttaggaattatgtttgaatgaaatagaaacattgaactcaaaattgtaaagctgatatttcaagaactaccaattagtgtaacattactaattgagttacagtatttagaagttaaaactgatgtaaatcaaaggactcatgttgtttatctattttgaatccttttttgaaaaaagttaatctttaaagtttttctgtattaaaaaaatctgattatctcttgtgacctattttacctagaaaagctagttagaggttaaaaggttttttatgagacatacttctgtgcatcggaacagtccagatgtaaatttaaaaagaagaaatgacaatgaagtgatcaaagagaattctgtgttcaaatgctttcacctggagcagttgtagaaatgtcagtagcacaactgtatttataattatagcaggatgtggcagatggtgatgcaacaccgtctcgtcaattctttgtgtcattgaagaaagtagtaagtattaattctgccaattttatgattaatgaataattttaagtaacacaggccctacgaataaggttgactgttcaaattgtgatacctcattatagtttttaaagtttaaatatgaattaatactcctctttgcctttctgttctctttccttttcaaattaggttgttaagttttcatagctaaaataagatgaaggaagcagtggcttgctgtcctcaattatatttttgatgtgtttgtgaaattattataacttagatcagattctttaaagaaaaatcagtatttcattttttcctttcctcccttttctccctctctcctttccttgtctctctcctttcctttctctctcttcttccctttacccctcctctccccttcccttctttctcctcctcctcccttcctcacatctctttcccttctcctcctacccttcctcttccctcccctcttcttcctttcttcctactttgttttatgcattatgttaagaaattgttttactgctattagtgataacatgcttttagttctgtcttagcagttatggttgtgctctccaggataaatctacacatatcacagttatccacttcataaaagaatgacatatctctactcttgtgggccttaatgtcatgcagtgtttctgggtatgacattaaacatgggtacaatttgaaattgtatttttctgtctaaaagcaaaacaaagcttcatcaagaaatactacaagcagtgggacctaatttcatcaaggggataaaactctattcctttttattctattttggaattggaattcagaaacatttttttttggtcctatggatggtatattcacttatttgaaatgaaaattgaactcagacttttctgaaagagtctcatttgttaattggttgacaaggatggtctttgccatttaaatgatacagtggtactgtcagctgtcattgttcttgaaagcaaagaaaatatttaattgtattgattttctgacttacgttcgaattaatacacatttccttcttctttaagcaactttattggaatatagttcacgtacaattcacctgtttaaaatgtataatcttgtggcttttagtgtgttcacagatctagctagctgtgcaaccatcaccacagtcagtttcacaatattttcttttcttttcttttttttttttttgagatggagtctcgcactgtcgtccaggctggagtgcagtggcgcgatcttggctcactgtaatctccacctcccggggtcacaccattctcctgcctcagcctcccgagtagctgggactacaggcacccgccactgcacccggctaattttttgcatttttagtagagacgaggtttcaccgtgttagccaggatggtctctatctcctgaccttgtgatccgcccgccttggcctcccaaagtgctgggattacaggtgtgagccaccgctcccggccccacaatattttcattatcaaatgaagaaactctataaccattagtagtcattccccatttctctctcaccccctcatcttctgtccattcaaccccttggccccagacagtcacttatccagttttgtttctataggtttgcctattctagacaattatttttatttttggagatggcatcttgctctgtcttcgaggctggagtgcagtggcacaatcatggctcactgcagcttccaactcctaggcacaagtgatcctcccacctctgcctcccgagtagctgggtctataggtatgtgccaccatgctcagctaatttttaacttttaaattttctgtggaaatggaatcttgctttgttgcacaggctgatgttgaattcctgacctcaagcaaccctcctgcctctgcctcccaaagtgctgggattacagttgtgagccactgtgcacagcctttcaccaattgtcaaaaacttattcatgtatgtgattgtagattctttgaccaacatctctccatccttctacccctctaattacccaagcctctgataaacaccattttactttctccttctatgagatcagctttgttatagttcacatatgagttgagattatgtagcatttgtctttttgtacctggattatttctgttaacaagttattctccaggttcctccatgttatcacaaatgagaagattttgttccttttttttgtggatgaatagtattccattgtgtatatatatcgcattttatttattcattcattcattgcctgataaactcttaggttgattacatatcttggctgttgtgaataatgaagcagtaaatatggacgtgcagatatatcttaatcatttccactgaatatgtacccagaagtgggattgctggatcacatgttgtaccgttaatttcttaaggaacctccatacctgttttccataatggctgtgctagtttacattcccatcagcagtgtacagggttcccttaatatttcgggtactatagccttttgtaatatattttgaagtcagatagcatgatgtgtctttgtcatttttgctcaagattgcttttgctatttgggatcttttgtggttctatatgaattttagaattttttttctatttctatgaagattatcattgtcatttgagagggtttactttgaatctgtagatcactttggatagtatgggcattttaatgatattctttaattacatgaatgcaggctgtcttttatttgtgtcttctttaatttctttcatcagcgttttatacttttcatcttagagatcttttatctccttggttgaatttatcactaggtattttagctatttttatagctattttaagaggaattgtttacttgatttttgtttttttcagatagtttgtggttgatatatagaaatgcttttgtatgtttattttgtgtcctacaactttactgaatgtgattattagttctgacagtattttggtacattctttagggttttctgtgtatgagatcttgttgtcttcaaacaagaacaatttaatttctacctttccaatttgtatgccttttatttctttctcttgcctaattgttctggctgggtcttctagactatgatgaatagaaatggtgaaagtatacatccttgtcttgttccagatttcagaggaaaagctttcaatttttccccattcagaataatagctttggatttttcatatatggcctttattgtgctgagctgcattccttctatacccaatttgttgataatttctaacatgaaagaatgttgaattttgtcaaatgcattttctgcatctattgaaatatggttttttcctgcatttaatgtgatatatcacagttattgatttgtgtatgttgaaccattcatatatccatgggatgaatccacttgatcctggtgaattatcttgttaatgtgctggcttttttttttcttttttaagacagagtctctctctgtcacccaggctgaggtgcagaggtgctctacctcctggattcaagtgattcttccgcctcagcctccctagtagctgggattacaggcaccaaccaccatgcctggctaatttttgtatttttagtagagaggggtttcaccatgttggccagggtggtcttgaactcctgacttcaagttatttacttggcctcccaaaattaatgtgctattgaatttggtttgctggtattttgttcaggatttttcttctatgttcatcggagacattggcctatagttttcttatttttgttgtgtccttgttaggttttggtatcagggtaatgctgattttgtagaatgagtttagaagaattctttcctctttattttttaaaaataatttgagaagaattcgtattagtttcgctttgaatatttggtagggtgtgttggcttacgccagtaccccagcactttgggaggctgaggcagaacttcaagaggccaggaatttgaggtcaacctggacaacatagtgagaccttgtttctacaaaaaaaaaaaaaaaaaattagcttggtgtggtggtacacacctgtagtctgagctacttgggaggcctcttgggaggctgaggcaggaggattgcttgagcttaggaggtggaggctgcagtgaactatgatcatgccactgtactccagcctgggcaacagagcaagaccctgtctctttaaaaaaacagaacaaaaattttggtaaaatacagcagtgaagccatcaggtcctaggcattttttcttttttctttgatgggagactttttatcactgatttaatctctttacttattggtctgttctaattttctatatcttcgtaattaaattttggtagattatatatattcagaaacttatttcttctaggttttctagtttgttggtgtataattgttaatgagagtctcttataattctttatatttctctgggatcaattgtagtgtctccttttttgtttctcactttattatttgtgtcttctcctttttttcttagtctagctaaaggtttgttgcttttggctatcttttcaaaaacctaattctttgttgtatttatcttttgtatgttttttaggtctctatttcatttatttcttctctttattatttatttttttctgctaatttggagtttggcttgttcttgtttttctagtcccttgaggcgcaacattaggtttatatctttcctctttggggatttatgtgttaattactataaacatcacttttagacctgcttttgctgtatctgataggttatgctttttttccattggcattgtttcaaaaaatctttttgtttctctttaattttttcattgaccatgttgtttaatttccatgtatttgtagagtttttgattttcctcttattattgacttctagtttatgccattgtgatcggaaaatataatctatgattttgaactgaaacttgttaagacttatgttgtggcttaatatgtactctatcctgaagcatgtttcatgttcaattgagaagaatgtgtaatcttcagccgctggatagaatgttctgtaaatgtctgttaggcctatttggtcaagagtgcagtttaaacctaatgtttcttttttggttttctgtctggataatgtttctgttgcttaagtggggtgctgaagtttcctactaggtagaggatcagaaaaaataaatattacatactcagcttagtatctgggtgatgaaataatctgtacaacaaacccccatgacacaacctgtacatgtaacaaacctgcacatgtaccgctgaacctaaaataaaagttaaaaaaaaaagttgtctactatgattgttttgtactctatctttccctttagatttattgatatttgcttatatcaggttattttaatctagtaacaacttaactttgattgctaaaaatgtttaataaacactgtgtactttaactcctctttttctctcacattttgaatttttttctgagatacagtctcactctgtcacccaggctggagtgcagtggtatgatctcagctcactgcaacctccacctcccgggttcaagcgattctcatgcctcagccacccaagtagctgggattacaggtgtgcaccaccttgctcaggcaatttttgtatttttagtagagacggggtttcaccatgttgcccaggctggtcttgaactcctgacctcaagtgatctgcctgcctcggcctcccgaagtgctgggattataagcatgagccaacttgtccagccacatattttgaatttttgatgttacaacttacaacttttaaaactgcatatcccactatcaattgttgtagttataattatttttaatagttttatctttaatcttcatattaaagatataagaggtttacatactatgcttacaataggccgaatagccacttcccactcattttttccaccatagaaaacttgcatccaggggacttctgcatatgtgggcttaggggaagggtgttgcagtcaaagcaccatttcccttactgtctgatatggtttggctctgtgtccccacccaaacctcatctctagttgtaatccccataatccccacatgttgagggagggatctggtgggaggtgattggatcatgggggtggtttcccccatgctgttctcatgatagtgagtaagttcttacaaatctgatggttttataagtgtttggcagttcctccttcactctctgtctttttctcctgccaccatgtgaagaaggtctttacttcccctttgcgttccagcgtgattgtaagttttccaaggcctccccagtcatacagaactgtgagtcagttaaacctcttttctttataaattactcagtcttggatatttctttatagcagcgtgaaaatggactaatacactgttctcagatttttctcagctctgtggtacaatgagacaccatcctgagttccaagagatccagggtagtcgtcttgccactgagaagatactaattgtgacaagttaatgggtgcagcacaccagcatggcacatgtatacatatgtaactaacctgcacattgtgtacatgtaccctagaacttaaagtataataataataaaataaaataaaaataaaataaaatctaatcttctgtgcaggcaaaaaaaaaaaaaaaaaaaaaaaagaaattctatagggtgtggagaaccagacaacaattcctacccttccattttgcaagcatcactctgccatattttttaaagaataatgtttttagagtatttgtgttctttggtacttttgctgctgagattcttgggataacaaagtaaaaaaccaaatagtctagattgtaacataccacagtgatttggggcaagaaggatgtgcagtagaattaagccaagctgggcaagtatgaacttgggactgtcaccaaactctgtctcattcttttctccttatttaattctttccatatcaagcatttacaacccactatgtagaggtccatacaccttggcttatagacttcacttggtagttactgttgcccacctatctattaaccagaattttcatttaaaaatctctacataaaaattagcagttatgcagtggagttttcaaataaggaagaagattggttggatggatggatgttaggtgaccactgggaaactatggttttagaacgagtagctggtaggttgcaggtggcatgtattttaatacatgtagcagaaaactgaaaatttatgagcattttagaaattagagctctgtcaaaataagagaaaaacttagatttaattttataaaagcagtactaatgactttatgaagatggcatatgatttatgtatgtatgaacaattatatgtatcattaaatagatcagataaattttttgttcttttaagaataataggccagatgtgatggctcacgcttataatcccagcactttgagaagccaaggccagaggatcagttgagctcaggagttcaagaccagcctgggcaacatgacaaaaccctgtctctacaaataataaaaaaaaaaaaattagccaggcacggtggtacatgcctgtcatcccagctagtcaggaagctgaggtgcaagaattgcttgagcctgggaggttgaagctgtagtgagccatgattctgccactgcattccagcctaggcaacagagctagaccctgtctcaaaaccaaataataattttttaaatatttattatctaatgtgggtttttgctttatgttacagttgtcacctactccaatatgaaaaatgagaagaaagccaggtgtggtggtgcatacctgtagtccctgctactcaggaggttgagatgggaagatcacttgaggccaggagtttgaggttgcagtatgctatgattgctcctgtgaatagccattttactctatcctgggaaacacagtggcatcctgtctcttaaaaaaaatttttttttaaagcatgttcacaagttctttaatacttctccattgaaaaggtagaacctaatttcccttctcttgaatatggcccagacttagcgacttgtttctaataagtagaatgtatgtaatgatggtgtgctatttctgaggctagatcattaaaggcatcattacttccatattattttttcttgggacacccataatggggaattcaactgctatgttcttgaggatacgcagtcagcctttgaagacacccacatgggcaggaacataagccttccagcggcaaccagcaccaatatgttggccttgtgagtgcagccagctccagtcaaatcaccagattactggagccctgccttacttaaccgactacaacctgatgagacaccccaagagagaactgttccactaagctgctcccaaattcctgacccaccaaaactatgtgagatagtatttcttatttatagccaccatgttttgaagcaacaatgactattaaaataataaaataactttcagacattgtttttaatccctcttttctgtagtccctgtactttcccaccccaatttatatttcctgtttctatttgaacttttttcttttttgttttcatttcttttatacataatcgttttgagctataagaataatttatgccaaaaattatgcagctaatattttacacccgtattgtaaccagtatactggtataaaactagataataaactactatggctgtgttttgcttcttacagatggaaggaaatgcctaaaatttaattttatataccacaatgtgttttgaaagttttgaataattttctggttttgaaaacctgttttgatttttttttctcacaaacacgatattcttaagtaaaatagagtgatttatgattaatagaaataatgaagattatgcaagttattttacttcaattgaaatagcaaggccagaataatttaatcatgttttccagaagaataataaaatagaatcagtggcaatactagtaaacattagtctacatttctatttatttatttatttttttagacggagttttgcctttttacccaggctggagtgcagtggcacgatctcagctcactgcaacttccgcctcctgggttcaagtgattctcctgcttcaggcctcccaagtagctggtattacaggcgcctgccaccacacccagctaattctttgtatttttaatagagacgggatttcatcatgttggcaaggttggtctcaaactcctgacttcaggtgatccacctgccttggcctcccaaagtgcagggattataggcgtgagccactgcacccagccaacatttatatttctttaacttcatatcatttgctgtagttagctggatcatatttcttaaattttactttatttatttatttttgagacaaagtcacgctttgtcacccaggctgaagctcagtgtttgcgatcttggctcactgcaaactctgccttctgggttcaaggaatcctcctgcttcagtctcctgagtagctgggattacaggcttctgccaccatgcccaacaaatttttttttgtattttttgtagagacagaatttcaccctgttgaccaggctggtattaaactcctgacctcaagtgatccacccacctaggcctcccaaagtgctgggattatggccatgggccactgtgcccagacaaattttactttcatagtaacattttgcaaatgtaaaaattttataatttgattagtaatgtcagactctatcaaggtgatgctctcttaaaagttgttgatgataatattagatgagagatgtatgtagttatgaaagaccctgaaatgattgtatttttttatttctgtacaaagtttactcacatttctatgtctagccatagctattctaagccatagcacaaagaactgtattgtgatggtgagactataaaaaggtaaatttagagaaagcttccagatctgctctagaatttattaccatctggtctctttggagactagtataattattcatgggaatgttttcaacacagaaaagcatggtttgtgtattggcagaaagtaaaaagtaccagtggtttaaaccatatgtagcttttttagagttaggcaagggaaatgaactgaagacctaattgagagtcatcagtagtgatgcaatttgtgtcaattttgtcagaatctgttcataatgaacaaaatattgcacaacaagaaaaactgaaggtattagaaatataactccatttgaagagtattactttatcttaatttaaccaatgaaatgtaagatggtgtcagctaagtatttgtgtaaatctctgaaataacataaggaatatatgtcaaattttgatgacttttaaaaatgaaaacactcatgttaaaataattttaagcttgaacactggaagaatgtcttattaaggttatttttcttaaattgaatatgaatgtattattttagatcattttagatgtggcatggacttactactgttcctcttaagaagcagaaatattttacagtctttcttaagcttaaattgattttatagaaaaaggaaaaaaaaactaaatatcttttcactttccattctaacagttacttggagtctataaaaaatgagatgacaaatcaaaaaattgaaatcgtctattttttcagctattttaaaagaaaaatgcctagtgggctgggaatacacaagaaatttaaatttgtgattgagaataagaaatgcatttgtggttttaaaaaagaaataccagcatgtcacattaaaaatatggcatctacagtattgtacaaaggaaaatgtattacattaggagggggtatgttgtactttatttagagaactagtgcagggatacgaatgagaagtataacgccatagaaggcatgagcattagtaatccagtcagagaggaagaattttgctgcctcccatgtaacataaaacagatgttccattctattagaaccttactaaaatgagagtttagatcattggtcaataggagaaacatgaacaatggcaatttaataattttgagggtttatcttatttgtgagttaatatccatggtggggagtatgaagggatgcctgccaaatgttattttatttttgatatcttgattgagagagctgaaaggcaacagtaagctatactaatttttaatttattgttttgcaaatttaatctatttttttctcaaaaactgttgtaagaaaaaaagatttcaaaattataagtcctgatttaatgcttgaataggtattgaagcatatctgaaagtataattaattaacctcaaatgaatactgtaaacattaagtagttggcaactgaaagtagacgtatgcagaaagggacaccagggatggtaccacagggtcctgggtatatttttgtttttttaagggaagatttacttttttctagaaaagaaattcttttcaaataaatttatttttcaaaaaatactttttttcaaaagtattttttccattttaaaattaagttataatttatatacaaaaaagtgatctttgtagtgtatgtttctgcaagttatgacacatgcacagtctagcaaccagtatcagaaataagatagagaatagtttcatcacctcaaaactttccctgtgtcccctttgtagtcttcctttcccctacttcagcccttggcaatccctgctctgtttttgttgacagagacagttctcctcacttgtttgtgaagactgtaaggttctgactgccctttttcctgggacatttctcagggttatatatgcagctgataaacttgagacatgagataacatctgttcccagacaaaaagcaagcttatttactgcttgctataaaattggtggattccctgagttcagtgcttctcatttgctgatgcaaactcactacaagcatagcatccatctgagcatccccaaaggacttgggatgaagggaactgatgcaaatgtgctgatgttcttctgttttgtcataagtaatgaagtgttttttctttgactgaggagtcttgtgtcttctgcctgcatccatgaattagttaagaggcttttgtgttagcttttattaaatagggtaaaatcaaatcccagtctccataattttctgtttgtatagttttgccttttccggtgacttgtattgagggttcctgcttctggccaacaacctatgagtgattttttaggtctgatcataaggcatttacagaggttttcctggcaggcttcatagggggagggctggtctccagagcagacttggtgcaaagcttttatagtctctgaggggaattgcagtcaaggacccagccatcctcttatacatatctgcgttcctagcctaggtgccttcattcagaggcctctttatgtggggcttttggggaggctttccttaagtgtctctgtcaagactttattggggaaaagaggggaagacacttaccaactctttctctactatgacttgtacttttctgtttctaacccttccctctctagccttcactcgactcctgggtctgtaaaactgccagaatcttttgttgggggttccctttggcaatgatgcaaccctcacatttgtgctggtctacctgccctgtgaccaatgtgccatgccacaggggaaaatggaatggggggtagctggcactttctccaatttagcctcttatactgtcacagtgattacagacctattctttattttattttattttatttatttatttttttggcttgttgccattggctgtgccaaaacgtggcagcccagctttctccagctctcctgaggtactgatacacacaaatggaatcatgttgtgcatagcctttgaatctgactttcttcagttgacgtaagttcatcttagattcatccatttgctttgtcaatagtttttaaattttaatggctgagtagttttctatcatcgtgatgtactgcaccttgtgtctctatccactctagagggatatttgaattgtttctggtgattatgaataaagctgctaaaaatatttatacgtttttgtgttaacataaattttcattttactagatgtattgccaaactcctttccaaagtggctgtgccatttcacattcccactagtaatatatgagaggtctagtggtttcacatcctttcagcacttgatattgtcagcttttattactacatcaattgtaagggggagaggagcatctcattgtttgtttctacttccctaattatgtgaagcacatttttatatgcttatttgctatctgtatatgttctttgaagaagtatctcttcaaactctttgccttttttttaaaaaaaattgtgtttatttttgttacagagttttgagaattctttatctgttctgcagacaagacttatcagatgtgtgatttgcaaatattttctcctagtgagtggcttgtgttttcattttcctaacaatgtctttcagtgagcagaagttcttacaaatttatgtacttttaaaatggattatgcttttgtgtcatataagaactctttgcctaatccagggtgagaaagatttactcctatattttctactagaaatttcatagttttactttttacatgtagatctgtgatccattttgagttaagttttgtgtatattgggtgaggtctgtaacagagtttttgattattgttttttgctattgttttttgctttggcatatggatatccaattgatccattactcttccctgaagtctatttaaatctctttaattgccattgtacttttttgaaaatcaattatgtggttgtatatctatgttccatattctgtttcattgatctatatgtctcttctttctccaatatcatacttctctgattactgtagcttaatgtgtttgttttttttgctgtctaatcatggaagttgaatttattgcattttacaggtcaatattttttgtagttgtagacgtctgtaattttgcactgttaattttaatgtaatggacatattagaaattaggttttcaatatgcaggggaaatgctgttaatttacaattgaagagagttatgaaataataataaatagaaaaagtaaatagagaaaggaaagtacagtcatcccttagtgcccataagggattggttctaggaccctctgtggataccaaatccatggatactcaagtcccttaaatggcataatatttgcacataacctatgcatatcctcccatatactttaaataatccccagattgcttataatacctaatacactataaatgctaagtaaatacttgttatactgtgttatttagggaataatgacaagaaaaaagtctgtacctgttcagtacagactcaacaactatccatttcccccacttccaagtatttttgatctgctgttggttggttggtctgcagatgcagatcccatggatatggtgggcctatatatatgtcttatttattgtcactaccttttgcttccaagtattttttatttttaatgagagttattttgttgtggtgggtggtttaacatacataagttttcccagcagcagaaccctgaagcaaggattttagaacaaagtctactttggagacgtatgtaacaggcaagaattgatgcaaggaaagcaaggcagctaatgaagacttactaactaaactaacacaataggttgctggagctttatcttgtgggataattctgggaaagtcagtgtcaaatttagtttcgggactaactcacctgaagtgtgagagagtgagtatatttcctgttactggttgtggactgccatacagaagacattgcacctgcctggtgctgtggtgggcagagtagcattcagccattcagaggaaagccctgagggatacagaggaagatactggctattggaagtaatttggaatggtgggaaagggttaggtccaaaggatactgtacagacactgacattatctgactcatgccttgtgaattttaagtgcctttcctgggttatcaaagtgaatagctttaatcaaatcatctctataaagacatttctaagtaaattttctatacttacactcctctactttttattactacagctggcttcattagctttttgtatattaatctgtgttgtcctactattagctagaagagcttactaactgtgagcttgaagatattgtatattccctcttcggatgatttttttttttttttttttgagtcagagtcttgctcttgtagcccaggctggagtgcagtgatgcaatctcggctcaccgcagcctccgcctcccgggttcaagtgattgtcatgcctcagcctcccgagtaactgggattacaggcacctgccaccacgctgggctacaaatgtatttaagaatcttaaatgagctgtgattgcaccactacactccagtctgggtgacagagcgagaccctggcttcaagcagtcctcctgcctcagcttcctaaagtgctgggattacaggcatgagccactacccctggcctaaattccttttctagcctctatacagaatttctaggataacaacaacaacaacaacaacaaaaacttaaatgataaaaatgaatatataaaatagcaagtaagccatgtaaaatattttcaatattcttagccattagagaagtgcaaattaaaactataagatactgctgcatacatatgtggatagcgaaagtaaaaactggtgagaatacagaatgaatggatttctcatctgttgctgataggaaaatgacacagccactctggaaaacagtttggcatttttaataaaattaaagataaatattccatatgactcagcaatcatattcctgagtatttaacatagaaaaatggaaatttatgtatatgtaaaaacttgctacacaaatatttacatcagcttaatttgtaattgcctcaaactggaaagaatccagataactttcaacaggtgaatagataaacaaactgtgatatatctatcgaatggaataccaagctttgtaaaagaataaattactggtacagtcaacagtttccgtagatcttaagttcatcacacgaagtaaaaaaaaagctaaactcaaagtgttacatactgtatgattccaattatatagtattacttaaatgaaaaaaaattagtgttggaaaattaacctgtcattccaggagttagagataatgtgggagaaggggataggtatgactataagggagttgcaggagagggcttctttgtggtgatggaatagttctgtgtcttaattgtgctggtgagtacatgaatctttacagctgataagattttatagaatagtacacacacactaagaacaatgcatgtaatgtctactttggggagctttttttaaaaaaatttcttttaagagacagtgtcttgttccatttcccaggctggagtgcagtggcacaatcatagctcactgtagcctcaaacacctgggctcaagggattctcctgcttccagcctcccaggtagctaggactataggtgcatgccaccatggctcgctaatttttttatttttattttttgtagagatgggggtctcaccatgttgcccaggctggtctcagtctcctggcttcaagcagtccttctgccttggccttctaaagtgctgggattacaggggtgagccactgccctggcctaaattccttttttagcctcttcacagaatttctaggataaccaatataagtaaagtagatgttatttttaaaatgatccactttatacactaaattaaaagacagtcttgatttcttcaaaattctttgctgtgaagtgaaacgtttggtaatcatatatcttgttgacataaacatacagattcctctgcatgtaacattcttttccttcactttaccaatttgtgcccatttcacgtatctcagcctatatccctttttcatgatcatcttacctctgacataactctttcacccaccaaatctgtgtttggtgtcatttctatgatggtcccatacaaagctggactcattttacagatgcaaaaagtgatgaaataatgaacaagttaatggcccaactgaaactgtggtgttggacataaactttagaataaatcctaaatcttaagtgtgcaaataaattattcaaaacatgagattacctaacctattctagtgatatttaacagagatatgtttgtaactggtggaagaagaatcactccctaggtacaagatcaattactgttcattttattcacctgaagataaatcactttcacagattttgcagactacttcttttcctgaaaaaatgatttattaaagtggaggtttctttactatatcaacactggcttactcttttctttataatacttctatactgaaagaagccagaggccaaaagtagtcttgtttgtgctgctctttatttcattgttatttttaaaccagatgatgaaattcccttccattttgaagggccatttttcatgtacataggagggaatttaaactgtttgagttaatattaacatattctattactataaattggttttagtttgattttaaaatagcatattaatttacatttaattttagtattcaactctgatcagaaaaatagtattttggatgtaggggtaaggaaaaggtgtgaaattccagttaaaaatctaaagtactgtgtttattgtttcattgtgtgtctgcatttagtattgtttgtatgagaaaaagtcagttgtttccttatattcccatataatttttgagtagtatgacaatcttcatttatatacctgatgacttttaatttttaaaatgttgtctaaaccaggtttcaggtgatatatcttgcttcctaatttgacaactctgaatattactattgaaacttgtaagcaagtagaaattaaaatgaagccatacatagcatttgctttgattaaaaagaatagaaacctagactgttttggaaaattcagtgtatatttcagtgtatatatattatgtgtttatatattgacagatctgggcatcagaatagagtcaagaaataacataaatagaaattcagtaagaacacatatgaaactggaaaccagtggaggaaaactgaggaattgctgtttgtgagagacttatttttcactcagtatacttttttttactgttttaattgtctatatagcatgctgcatattaccaattttaaatacttaattttgaaagattaaaatggctggcaaatttattgcccatttgcaaagtacatttatatcaggcatagtacaatatgtagaatgttattggaacattggaacattgtgtctgaaatacttttttaaaaacctcataaaatatgaaaatacttcttaatgatttcaatattaactctattcattagacatctatcattatcctttatgtcagaaacttagagtgaaatcttattagcttgattgaagaacacttgttctcatttcattgtgctatagttaacattcaaagttaaagttatttttcttctccttgatagtatactataataagtatattcaaagtgatgctctagatttgtttccttcacatttagacttgcatttttacaatgtttatactaaggtttcttacacttgccatagtatatctgtgcggtggcttactcctgttaatcccagcaattagggaggcccaggcaggtggattatgaggtcaggagtttgagaccagcctggccaacatggtgaaaccctgtctctactaaaaatacaaaaaaaaaaaattagctgggtgtgttggcgggtgcctgtaatcctagctactcgggaggctgaggcaggagaatcacttgaacctgggaaggtggaggttgcagtgagccgagatcctgccactgcactgcagcctggacaacaagagcgagactccgtctcaaaaaaaaaaaaaaaaaaggatttttgcaatcattaacttacttcttgctgtctgtttttattgtctttggctgtccttcttaacttcttcaaagatttctagtatatttacactccttaatcctaaatccagtgtatgttggctctcatggtagttttccatttcatgtacttgcttgtataatataaatccctgttcttggtgttttgtgtatttatttatttggctgccattgtattgaaaattgtcttgacaattcatttatgaacatcattagtacagcaatatgtaattcaaaaccagcatgctcaaatttgtactattctggttagttattgctatgtgtgtattttcaaatttttaaagacttagagaatagtaaaacatatacttagcacaaatgatatcacttcttggtacctttctgtgagtccttcttcccataaggaaattaaattgttctttgttttcatgctaagtagcatgaaaaaaaagctttattgagataaatcaaatttagagcatttttatcacctcaaaaagagcccatatacattagctctcacccactcaattatccctccttggctattttgggtccattgcaattccaagtgaattttagagtcagtttgtcaatttacacaatgagtatagcttggattctgatagggattgtgttgaatctctacatccataatgggtaatattgccaatcttaataaaattttccatgaatgtgggatgtttttccatttatttggatcatctttaatttgttgcaacaatgttttgtagttttcagagtataaattttacactgtaaagaaaacttattcccaaatattattttctttttgatgctattgtaagtggaattcttttcttaattttatgttcagattattcattgcagatggcttagagatacaattgtgtgtggtttttgttgttttgtttttgagacaggctcatgctctgttgcccaggctgaagtgcagtggcacaaacatggctcactgcagccacaatctcctaggcccacctgattctcctccctcagcctcccaagtagctgagaccactagacatgcaccaccatgcctggctaatttttaattttttttgtagagacagagtcttgccatgttgcccaggctggtctcgaactcttgggctcaagcaatcctctggccttagcctcccaaagttttgggattataggcatgagccgctgtgcctagctcagtttgtgtgtgtgtgtgtgtgtgtgtgtgtgtgtgtgtgttttaatattgatcttgtatcctacagcctttctgaacttacttagctctaatattttttagtgggttctttatgattttctataaacaaaaccatgtcatctgtgactatagttgtgtttccttctttctttctaatttggaagcctttaactattttcccccttccttaattgctgtgactagtagttgtaatgtaacagtgaacagaagtggcaagaagagatgtccctagtcttgtttctcatatagggggaaaatatctaatcattcaccattaagtttgatgtttctctgcagttttcttagatgccctttatcagattgaggaagttactttctatttctgtttttttttagcgtttttatcttgaaacagtacagttgacccttgcacaacatggcgattgtgggtgctgacccactgcatagtctaaaatccatgtataacttttgattctcccaaaacttgtcaattaatagcctactgttaaccagaagccttaccagtaacataaagtcaattaccacatattttatatatgtatcatataaagaatatattattaagaaaatcatgagagaaaatgtatgtactatttattaagtggaaatgtttcgtgagaaaagtcatcattgtcttcatgttgggttggctgaggaggcagaggaggaactggttttgctgtcttaagggtggcagaggtggaagaaaatactggtgtaagtggatttgtgaagttcaaaccagtgttgttctggagtcaattgtagtggattttgccaaatgctttttgtttgtttgttttttgagacggagtttcgctcttgttgcccaggttagcgtgcaatggcatgatcttggctcactgcaacttctgcctcccaggttcaagcaattctcctgcctcagcctcctgagtagctgggatttcaggtgcccagcaccacgcctaacttatttttgtatttttagtagagatggggtttcaccatgttggccaggctggtctctaattcctgacctcttgtgatccacccgccttggcctcccaaaatgcgagattacaggcgtgagcaaccatgcctggctgccagatgctttttctatgtgtgttgagatgatcatgtaattttgttttctattctattgatatgatgcattgaattaattgatttttggatcttaaaccaaccttgcattcctgagacaaactccacttggttatgttatatataatttttaaatgttgctggatttgttttgctagtattttgttgaggatttttgcatcattctcatatgagtatcagtctgtagttttattttcttgtgactttgtctgattttagagtatcatagtaatactggcctcataacatgaattgggagatgtcttccctcttctaatttttagaagagtttgtggagaattggtattaatttttttaaaagaagcagcaattgcttatttttctaatcaggtgtctatgctgctgaatcttaaggcctcaacaaatgttgcaccttattatttcattgaacaataagaccttctattctgattattcccggtaaataggaataatcactggtttctccagtggtttccacttgccaaaaactcatgacagatgacttaacaaggtggcacctgctttcaggggattgtatcagatgcatactcatttccagtgcagcagctgttggcaatctaggacttctctatcatggttggccaagtagtcctgctttggctgccagagcttcattctgctgaatattacattcctgaagtctcatggatattctttttgtcatttaaaaatatttccataaagtgttctgaacaggctggtctcttcaggttttacatctgttgtgcagtcttaacacagtccaaaaagcagatttctgcaagtttattgtcagtcccaagaaattccttcaactgtttaatctgatcagattctggtatttgtgcacccatattcttttggtacatttattagtcatcttctctgatgcatgagtttcctttctgttcttgtaaagtagtgttccaacctttgtttgaatgtcttcagtgagacgtgatttcttacctaagcacaggctctcacatctgacgtcagtacaaggctggaggcctacactgccagtcgagtctgaggatggaggatcaggatcagggcaagcattgcagccgctttatctaattcttctttaaacgttcattagaattcaatagtgaagccattcagggctaggcttttctttgtgggtagtttcttgattactaatttaatctcttgttatataggtctgttcaagttacctattttttcttgaaatttttttagtcatttgtgcctttctaagtatttgtccatttcatctaataaataatctaatttgtttaatggctattctttctgacattaatatagccactttgtctttcttgtgggtgttgtttgcatcacgtatcttttttttttttcccagacagggtcttgctttgttgcccaggctggagtgcactggcaagcagaggttgccactcactggaacctctgattcccaggtttaagtgatcctcccacctcagtctcctgagtagctgggattacaggtgcataccatcatgcttggctaatttttaaattttttgcagagacgaggtctcactgtattgtccaggctggtcttgaactcctggctcaaagtgaaacccctgccttggcatctcaaagtgctgggtttacagatgtgagccaccacatccagcctgcatgatatatttttccacccgtactttcaatctgttagtaactttctatctacagtgtgtctcctgttgacccacataactgtcttttatgtatagttattagaactattgataagaaaatgtgaaagtatagtcccattatcttatttgagtggaatcagtagactatttcataaaatgtattctagtttatagtttagaatagtttgtttttcatggcttttgagaaaaacatttgaatgagcttacattttgttgcatttaaaatttctgggtttttgttgttgttgttgttgttgttttgagatgcagtctctctctgttgcccaggctgaagtgcagtggtgtgatcttggctcactgcaacctctacctcccaggttcaaatgattcttgtgcctcagccccctgagtaactgggactgcaggtacatgccacgacctggctaattttgtatttttagtagagatggggtttcgccctgttgggcaagctggtctcaaactcctgacctcaggtgatctacctgactcagcctcccaaagtgctggaagtacaagtatgagccactgcgcctggccaaaatttctgttttttaatgaatccaaagttcatgtttttttttcttcccaatgccatggtacatatcatcaccaaaaaaagtagtgattttgcttcagtgaacactgaattttaatattattgatagaatggctatatcgatcagggttttacacttatagtacagtatacttgcaatgtaggtaggcctcatcctttgtaattaattaattagcttgtaattatgtaagctaatctaaattttcatattttcagttttaacatttgggcttttgagttacatttcttatattttgatttttttctataaattttaaaaccagaaagacaacactagaatcaattaaatgcaagattgaaagggtttcataatgtaaaagagcaatcttgtttttgaaatgttcagtttacagtaaggatcgagtagctctgcagctaccgatttgggaaatacctgaggttttttttccccttgcacttacaggctgttttagccctgaaggtggctagtaaggacacagactttagagtgccacgacagttccataacaggaatgaattgaagaagagaagcagtggagtcaggagcctcacaaattaaagacaactggtgaagagaaaaaccatttattttcgatacttaagatggctgagcctgtaattccagcagtgctttgggaggctgaggcaggtggatcacgaggtcaggagattgagaccatcctggctaacacggtgaaaccctgtctctactaaaaatacaaaaaattagccgggcatggtgggcacctgtagtcccagctactcaggaggctgaggcaggagaatggtgtgaacccgggaggtggagcttgcaatgagcagagatcgcaccactgcactccagcctgggcgacagagcgacactctgtctcaaaaaaaaaaaaaaaaaaaaaaaaaaaaaaaaaaaagatggccgaataggaagagctccagtctgcagctcccagcaagaccaacacagaaggtgggtgatttctgcatttccaactaaggtacccagttcatctcattgggactaattaggcagtggttgcagcccacagagggtgagcagaagcagggtggggtatcacctcacctgggaggtgcaaggagctgggggacctccttcccccagccaagggaagccatgagggactgtgctatctggcccagataccatgattttcctatggtttttgcaatccgcagatcaggagattccgtcgtgtgcctacaccaccagggccttgggtttcaaacacaaaactgggcggctgtttaggcagacacttagctagttgcaggagttttttttcgtaccccagtggcacccggaaccccagcgagacagaactgttaactcccctggaaagggggctgaagccagggagccacgtggtcttgcttagagggtcccactcccacggagcccagtaagctaagaaccactggcttaacattctcactgccagcacaacagtctgaaattgaccttggaccattgggcttggtagggggaggggcatctgcaattactgaggcttgagtaggtggtttttccctgacagtactaaggtggcggggaggtttgaaccaggtggaattcaccacagtgcagcaaagcagctgtggccagactccctgtctagattcctcctcactggacagggtatttgtgaaagaaaggtagcagacctagtcaggggcttatggataaaactcccatctccctgggacagagcacctgagggaaggggcggctgtgggcgcagcttcagaggacataaactttcctgcctggtggctctgaagagaacagctgatactgacaaggaggattctcccagaacagtgcttgagctctgcttagggacagactgcctcctcaagtgagttgaggagactccgtgccttctcactgggagagaactgccaacaggggccaacagacacctcaaacaggagagctctggctggcatcaggctggtgcccctctgggacgaagcttctagaggaaggaccaggcaacaatctttgctgttctgcagcctccattggtgatactcaggcaaacagggtctggagtggacttaaagcaaactgcagcagacctgcagaagaggtgcctgactgttaggagaaaaactagcaaacagaaagcaacaaactcaacatcaacaaaaaggacccccacacaaaaaccccatccaaaggtcatcagcctcaaagatcaaaggtagataaatccatgatgatgaggaaaaaccagcgcaaaaacggtgaaaattccaaaaaccagaatgcctctttgcctccaaataattgcagctcctctccagcaagggcacaaaactggacggagcaaccccaagacacctaatagtcagattctcctctgagctgaaggaccatgttctaacccagtgcaaggaagctaagaaccttgataaaaggttataggaactgctaactagaataaccagtttagagaggaacataaatgacctgatggggctgaaaaacacagcacgagcacttcatgaagcatacacaagtatcaatagccaaatcgatcaagcagaagaaaggctatcacagattgaatatcaacttattgaaataaagtgtgaagacaagattagagaaaaaaaaaataaaatggaatgaacaaaacctccaagacatatgagactatgtgaaaagaccaaacctatgattgattggtgtacctgaaagtgacagggagaatggaaccaagttggaaaacacacttcaggatattatccaggagaacttccccaacctagcaagacaggccaacactcaaatttgggaaatatggagaacactgcaaagatactccttgagaagagcaaccccaagacacctaatcatcagattctccaaggttgaaatgaaggaaaaaatgttaagggcagccatagagaaaggtcaggttacctacaaaaggaagcccatcagaccaatagcagatctctctgcagaaaccctacaagccagaagagagtgggggccattattcaacattcttaaagaaaagaattttcaacccagaatttcatatccagccaaactaagcttcataagctaaggagaaataaaatccttttcagagaaggaaatgctgagggattttgtcaccaccaggcctgccttacaagagctcctgaaggaagcactaaatgtggaaaggaaaaagtggtactagccactgcacaaacacaccaaaatataaagaccaatgacactatgaagaaactgcttcaattagtgtgtaaaataacctgctaacatcatgatgacaggatcaaattcatgtataataatattaaccttagctgtacatggcctaaatgccccaattaaaagacacggactggcaaattggatgaagagtcaagatccatcggtgtgctgtattcaggagacccatctcacttgcaaagacacacataggctcaaaataaagggatggaggaatgtttaccaagcaaatggaaagcaaaaaaaaaagcaggggttgcacttctagtctctgataaaacaggctttaaactaacaaagatcaaaaaagacaaagaagggcattacataatggtaaagggatcaatgcaacaagaagagctatcgtaaatatatatgcacccactacaggagcacccagattcataaaacaagttctcagagacctacaaagatacttagacttccacacaataatagtgggagactttaacaccccactgtcaatatgagatcaatgagacagaaaattaacaaggttattcaggacttgaactaagctctggaccaagcggacctaatagacatggggttgctacagaactgtctaccccaaatcaacagaatatacattcttctcagcagcacatggcacttattctcaaatcaaccacataattcaaagtaaaacactcctcagcaaatgcaaaagaatggaaatcataacaaacagtctctcagaccacagtgcaatcaaattagaactgaggattaagaaactcactcaaaaccacccaactacatggaaattcaacaacctgctcctgaatgaatattgggtaaataatgaaattaaggcagaaataaagaagttatttgaaaccaatgagaacaaagagaaaacgtaccaaaatctaggacacaccaaaagcagtgttaagagggatatttatagcactaagtgcccacttcagacagctggaaagatctgaaatcaacaccccaacatcacaattaaaagaactagagaagcaacagcaaacaaattcaaaagctagcagaagacaagaaataactaagatcacagcagaactgaaggaggtacagacatgaaaaacccttgaaaaaaatcagtgaatccaggaggtggttttttgaaaagattaaccaaatagatagactactagctagactattaaagaagaaaagagagaagaatcaaatggacacaataaaaaattataaagtggatatcaccactattctcagagaaatacaaactaccaacagagaatactataaacacctctatgcaaataaaccagaaaatctagaagaaatggatacattcctggatacattcctggacacatacaccctcccaagactaatccagggagaagttgaatccctgaatagaccaataacaagttctgaaattgaggcagtaattaatagtctaccaaccaaaaaaagcccaggaccatacagattcacatccgaattctaccagaggttcaaagaggagctggtaccattccttctgaaactattccaaacaattgaaaaagagggagtcctccctaactcattttatgaagccagcatcatcctgattccaaaacttgacagagacacaacaaaaaaagaaaatttcaggccaatatccctgatgaacatccatgtgaaaatcctcaataaaatgctggcaaacgaatccagcgacatgtcaaaaagcttatccaccacaatcaagtcggcttgacatgtaaggctggttcaacatacgcaaatcaataaacgtaatctatcacataaacagaaccaatgacaaaaaccatatgattatctcaatagatgcagagaagtcctttgataaaattaaacatccttcatgctaaaaactctcaaaaaactaggtattgatggaacatatctcaaaatataagggctatttatgacaaatccatagccaatatcatactgaacaggcaaaagctggaagcattccctttgaaaaccagcacagacaaggatgccctctctcaccactcctattcaacatagttttggaagttctgactagagcaatctggcaagagaaagaaataaagcgtatttaaataggaatagaggaagtcagattgtctctgtttgcagatgacatgattgtatatttagaaaaccccatcgtctcagcccaaaacctccttaagctgataagcagcttcagcagtctcaggatacaaaatcaatatgcagaaatcacaagcatttctatacatcaataatagacaagcagagagccaaatcatgagtgaactcccattcacaattgctacaagagaataaaatacctaggaatacaacttataagggatgtgaaggacctcttcaaggagaaccagaaaccactgcccaagaaaataagagaggatgcaaacaaatggaaaaaaaattcagtgttcatggataggaagaatcaatattgtgaaaatggccatattgcccaaaataatgtatagatccaatgctattcccatcaagcttccattgactttcttcgcagagttaaaaaaaaaaaagaaacaaaccttaaatttcatatggaaccaaaaaggagcctgtgtagctaagacaatcctaagcaaaaataacaaagctggaggcatcatgctacctgacttcaaactgtactacaaggcaacaataaccaaacagcatggtactggtaccaaaacagatatatagaccaatgaaacagaacagaggcctcagaaataataccacacatctacaaccatctgatctttgacaaatctgacaaaaacaagcaatggggaaaggattccctgtttaataaatggtgttgggaaaactggctagccatatgcagaaaattgaacctggatcactgccttacacattatacaaaaagtaaccaagatggattaaggacttaaatgtaaaaccgaaaaccataaaaaccctagaagaaaacctaggcaataccattcaggacataggcatgggcaaagacttcatgactaaaacacccaatgcaattgcagcaaaagccaaaattgacaaatgggatctaattaaactaaagagcttctacacagcgaaagaaactatcatcagagtgaacaggcagcatacagaatgggagaaaatttttgcaatctatccatctgacaaaggtctaatatccagaatctacaggaacttaaacaaatttgcaagaaaataacaaccctatcaaaaattgggcaaaggatatgaatggacacttctcaaaagaagacgtgcaaccaacaaacatgaaaaattgctcatcatcattggtcattagagaaatgcaaatcaaaaccacaatgagataccatctcatgccagttagaatggcgatcattaaaaagtcaggaaacaacagttgctgttgaggttgtggagcaataggaatgcttttacactgttggtgggagtgtaaattagttcaaccgctgtagaagacagtgtagcaattcctcaaggatctagaaccagacataccatttgaccgagcaatcccattactgggtatgtacccaagggattataaatcattctcctataaagacacatgcacacatgtgtttattgtagcgctatttacaatagcaaaggcttagaaccaacctgatgcccgtcaatgatagatagagaaaatgttgcacagagacaccatggaatactatgcagccataaaaaaggatgagttcatgtcctttgcagggacatgatgaagctggaaaccatcatttttagcaaagtaacacagaaacagaaaaccaaacaccacatgttctcattaataagtgggagttgaacaatgagaacacatggacacagggaatggagcataacatacctgggccagctggtgggtaggggtcaaggggagggagaggattaggacaaatacctattgcatgcagagcttaaaacttagatgatgggttgataggtgcaccaaaccaccatggcacatgtataccaacgtaacaaacctgcacgttctgcacatatatcccagaacttaaagttaaaaaaaaaaaaaaaaagccaggcgcagtggctcacgcctgtaatcccagcactttgggaggctgaggcaggtggatcacaaggtcaggagatcgagaccatcctggctaaaatggtgaaaccctgtttctactaaaaatacaaaaaattagccaggcgtggtggcgggcatctgtagtcccagctacttgggaggctgaggcaggagaatggcatgaacacaggaggtggagcttgcagtgagctgagattgcgccactgcactccagctctggcgacagagcgagactctgtttcaaagaaaaaaaaacttcagtttacttgattttgcttatagagttctttgagaatttaaatcatcctttctgaattacagaaagtcatagattagaagtgtagctttaaaatgctctagatcactctgaattaagaaaaagggtttcctttgtccagaataagcatcaatttaaaacagcatttaaaaacaagtattcaacaaattggtatacgaattataacacaagcaactaaatcactgactttgattagtctctctactgattactactgttgaacagaagttgtgtgtaagaataggagaaggtgaactcattgtcttgagcatgtggaattagttcttgtctgaggccagatagcaatttttatcttattttcagtatagcagatcctatgctgccctgataagaatcacctgcacagcctcattgactctcacggaagtattccagtaactctttgaattttttcctagaaaaattggcatctgttacccctacacaattccttcataaacagtagaaatttcccccatgaaacctttcctttaaccttaacattcttcgataattatttatgaagtccttaaataattattacaacaagtattggttttgaatacgtaccagctttggaatactgcttaaggaaaccatgataaactccaactcctttatgattatttagaggaatatatctatttgttatagtcttaaggaaaaccttgtcaacatattagatgatagaaacagtcataaccagcgaccaccaggtttggtgggaactcatgatgtgaagggtctactccatgttctgccaaccaagtaactaagtcattttgggcaaatgattcagctgacttgatctgttacatgattcctaaggtctgttatagctccaatatttcatggcatcactccactttaatgtattatctatcttaaaaaagttaaacagaaagatcaattagcacttatattaaatttgagttgctgaatattttattttttctcacttccactcactgcttccactatttgggtaatgattgttggagctgtatgcatttataatgcattaagtacagtgtggtatatcagtaaaacttcattacaaatattcattccatacatttgtctgtactggggtcagtttttttccccttcttcttctttttaaagacagggtcttgctctgtctcctcctgtcttggtctcccaatgtgctagaactacgggcatgagacactgcacctgctcttttctagttttatttgtctatctgaagagtttattatttggctaagctcacatggcaaggtaggtatcatgaagtgttaaaacccagcttttctgctaatgttcttgtgagataaaccaactattagtaaagatacttgcttcctaatcaagattacttggaattgttaagagagtatgtatgtatgtataagttaactttttaaaaacttctctgctgcctggaggaataatgaaatgacccaaagggatagaagcaaaatatttcagatagtacataacgtatatacttagccttgtgcaatcaagaattaatgatataatgtgtatggagtaatatttaactttatttcgttataagcccttttgggatagtggttgttccacataacttttatcttctttaatgcttagtatctgctagaaatgtagtctgtgggatcataagagttggggaagatttacagatagcattttcagagactgaacagaaaagcatattgtcatttggaaaaattttaaaagtgtctaacttttattcaggaccatttgcttttattttcctgttgttatttatttctattatcttgtttacagttgaaatttggacaattggtctgtatcttttctaattttcattatatataaagacttaggtttcctctttccttatgtgtttgttggtaaacattaggtgctatttttaagttttcaattctcaggcatagtgctacttatccatgttatttatataagcaaatgagcatatttgccaatcaatccacggtaagaaacacaatttaagttcctaccaaggatacctctgtgtgtgtgtatgtgtgtgtatgtatctgaaatatttcactaaataattcatttttttttttttttttttttttttttgagacggagtctcgctctgtcgcccaggccggactgcggactgcagtggcgcaatctcggctcactgcaagctccccttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaataattcatattgttaatacctcaaccatatcttgatattctgttagctttttaaatgatggttgtgaccaactacagttcacatttttcactagtggatcacactctgcagcattaaaatcaccgtgaaatagattaattagaataaatgaagtgttcttttttcattctgtttgtacagtagatattattggattattttataaaatacccattttataaattggatggtatgttataaatggatagtaggatttttcctttcttcattttgtaccaagagaataaaaaacactcctgttcagtacatctctagcaagcctatttcaacatccaatgtctcaaataattaatttttctatactttagtcacccttacacctaaacgttacagtgcttcagtataacttctatgtaaacattattaatcccatttacagatgggaaccagagtgttgggagacaggtcatggatttctcatgttcctgcacagtctaagtgttctaaggagaggcatttacagtgccaattgtataaggagaaatttcaggacagtaaaactactgacatgtccctccctggagacgtccaaggataataaaaataaaagaccttctcttccccttcccagaggagatttgcttatatttgagtgtaatgagcaatctttctgggcagagcagggtggcaaaccaatagaagatcagagttccttcatttgggggttactctcctgtgatgctctctactgtatgcactagtaacatccatcccttactgcattgcctcatggagattggagctcagggaactggtctaaatatattgttctaggtgctgcttttgctacgagtaataaattgtctttgtttctgatccacagttcttgtgtccttatgtcattgtgtgtgtgtgcatatgtgtatgcaggagaacgaatgcggcagattgaagagcagttgaatatcagacctttgtagtgtggtggtggtgattatggtgttgagacagaattttgctgtgttacccagtctggtgtgcagtggcgcaaggctcatttcagccttcgaactttcaaactccatgggctcaggtgaccctcccagctggtactgaaggcacaccccaccatacccagtgattttttttttttttttttttttaagagacagggttttgtcatgttgccgaggctggtctcaaactcttgggctcaagcaatccacccacctcagcctcccaaagtgctggggttacgggcataagccaccatgcctagccctttgtgatttttttaacttaactctggctcacacaatttaactgtaggtctgtttgtaaacctgaagcgctttctatgctttcttccttacatagaccgataaaataagtagaaaatatggtgctaatgactagtatttggtataagtagataaatgttttgtatcacatttgcatgcttataatctgtgatcaatgagcagtctgaatatttttccctccatcctcataagttaaactaaaaaaaagttatagattgaggctgggatatctggtggcgaaattatatttatttgaacagagtttgtgtatatacatacatatttcagaatatattgaaaaataaaagtgtaatgaccttgataaaaatgaaatattcacttaaaaactccatttaataatgcccacaggaaagaaatgcttctagaattttttaactaatcatttttctcagtacttttgattgtcatgcaaactaaagaaatggacttaatgaacaatttagttacaataataaagtttcaaaaattctaaatttacctcataattgcaacagatgcaaaattatttcatatctttatactcgttatgaaattacctcatatccaaaaatatttatgtcaagtgacaggctttttgcagcatttttgatattattacccttgtaatatataattaactttgtaagttaaccttgtggaacttttaagggaaatgcattaacttagcattaatatagacttctaaaatttactgtgatgtagaacatttgatttaatgttgtctgtgtctaatacaaaataactgtggtccacttacttatttcaaattttattctcaaaggtacctactagattatgtgtgaagaagtttgtgaccaaagtaatataactgattctgttttgaaaatctagaataaagtttatgcaaaagcatatggattatttctttatgaatgcagttttatactaaaaactcctccatacccacgtaagtagatatattctcatagtgatgtagaaaactgacaaaacttttcatcctcagagctaggaattcttgtgtttggccacaagggaaagacaaaggtattagaattttaaataagctatcatcaacaaatactacatctctccagctccattcataaatatagcaacattttggaagtgcagatgaatcgaacatagttaagtgagaaaaatttttagtaacatacataatttgtaaatattgaatcgttttttaaatgatactctgagtcataattatttcaaattgtacataatgctagaagaaactaggataatagcagaataagttacagtgactaaaatcataggtttttttaagagattggggagtctctgtggtgcccagtctggagtgcattggtgcaatcatagctcactgtaaccttgactcctggcttcaagcaatcctcctgtctctgccttccttttgtagtttcaggtcttaacatttaagtctttcatccattttgagttgatttttatacatggtataagatgaggatctagtttgattcttctccatatggatatctttggtctatatatttatttatatgacagtaccatgctgttttggttactgtagcttggtaatataatttgaatttgtgtagtgtgatgccgcagctttctctttttgctcaggattattttagctatttggggtcttctgtggttccatatgaattttaggatttgttttttctatttctgtgaagaatgcctttggtattttcatagagattgcatttaatctgtagctcactttggttagtaaagatattttaacaaggccgagcatggtggctcatgcctgtaatctagctctttgggaggctgaagtgggaggattgcttgaggccagggattcaagaccagcctaggcaacatggcgtgaccgtccctacaaaaaaatatttttttaattagctaggcatggtagcatacacttgtagtcctgtctacttgggaggctgaagcaggaggatcctttgggcccaggtggtcaaggctgcagtgagctataatcatgccactgcactctagcctgagcaacagagagagatcttatctctgtgtaaaagaaaaagaagtgtaattaaaggaaaaaaacattttaacaacagtctttcaattccaaaacatgggatgtctttttttccttttctcttcagtttctttcatcagtgttttataattttccttgtatagatctttcatctgcttggttaaatttatttcctggttattttatttttttgtagctattgtaaatggtttgctttcttgatttctttttcaggttggttgctcttagtgtatagaaattctactgacttttgtatgtcgattttgtatctgacaacttaataaattcacttaccagttctaatataatatggtctaattaatatattagactagaagtataagatctctcctggagaatgttccatgtaccgatgagaagaatgtgtattctgtggcagttggatgaaatgttctgtaaaggtctgttaggtttatttggtctagagtatagtttagcttcactgtttgaagttaaacactgatgttcttacatttcttataagaacattttatgtttcttatgtataagaacactgatgtttttatatttctagtctaataatgtattattaaactaaaaatataagatttgtcctggagaatgttccatgtcctgatgaaaagaatgtgtattctgtagcagttggatgaaatgttctgtaaatgtcttaggtttatttggtctagagtatagttttttacttcagtgtttgttgattttctgttgggatgatctgtccattgccgaaagtaggaaattgaaatcccctactattattgtatttatctcttgctcttgctcttatgtattcacacttgctctctctcatgctctctctctctctctttccctttgtatctaataatatttgctttatatatttgggtacaccaatgttgggtgcatatatatttactattgttatatccttttgctgaattgacccctttatcattatattatgatctcctttgtccctttttacagtttttgacttaaagtctattttgcctaatgtaattataggtattcctgcccttttctggtttttatttgaatagaatatctttctgcatcccttcactttcagcatctatgtgtctttataggtgaaatgagtttcttgtaggcagcatgtatctgggtcttgtttttaaaatccattcacccaccctgtgtctttatttgggttttatttgagatggagcctcactctgtcccccatgctggagtgcagtggtgtgatctcggctcactgcaacctccaactccctggttcaagcgattcttctgcctcagcctcccaagtagctgggactacaggcgtgcaccaccatgcctggctaatttttgtatttttagtagagacggtttcactatgttggccaggctggtctcaaactccggacctcatgatccacccgcctcggcctcccaaagtgttgggattacaggcgtgagccactgcgcccggcctatcctgtgtcttaattggagcatttagttcatttatattcagtattattgatagataaggttttactactcttattttgttacttgttttctagttgtttttaacttttcttctgcttcttttcttactgtctttctttgtggttaggtgattttctcttaagagtacattttaatttattgctttttatccatttttgctctgtggttaccaagaggcttataaataaacatcctgtagttatagcaagtatttaaaactgataatcaacttaactttgattggaaaaaaaacacacaaaagtgaacattaacttccttctcccccttcattttgaatttctgatgtcacagttcacatttttatattgcctatcttgtaacaaattgttgtagttattatttttaatagttttgtcttttagtcgtcttactacagatattagtgttttaaacactgcaaatacaatattaatataacactcattttagtgtttcttccagtttgaagaagtttttaaagcatttcttattggacaagtctgattatggtaaattccctcagcttttgtttgtctaagaaagtctttatttctccttcagttttgaaggataattgtgctgagcacagtaatcttggttgacagtttcttctccaccagcattccaaatatattcttccacattttcctggcttataaggtttctgctgataagtctgctaccaggcatattggatcttccttgcatgttatttacttctttcctttcagtgatttcagaagtttttctttgtgcctttgacctttgtgagtttgattataatgtgtcctagagtagtcttctttgtgtttaatctaattagtgatctttgaccttagtctacctgaatatttatatcttttttcaggtatggaaagttttctgttatcatttccttgtataagttttctacccctttgtctttctcagtccttctttgacttcagtaacctgaatatttgcccttttgatgttgtcccatagattttgtaagcttgcttgcttccttttctttttttttctcttctcaccatatttttaatcatttttctttgaactcactgattcttttatttggttaattctgcttctgttgctctctattgagattttcgcttcattaattttttttttttagttgcaggatttctggttttttaaaaaagttatttgagtctcttatatttctttcataattttctgaattgattcttcatgttttctttaagttctttgagctgtcttcaaacaggtattttgaatttttggagagatcacatatctcggtcactttcaggttagtctgtggtaccttattttgttcttttggtgtgatgtatttccctaaatgttctcaatgctttagaagtgtgatgatgtctgagcattgagggatttgtaatttattttagtcttcccagcctggctttgtttgtgcctgtccttcttcaagaggccttccagggattctaaagctgacttactattgcattctctgagcctctgaccaattacagccatctcagcactagagtatgctttaagcccaggttttctgagtcctgcaagggcaccaaggttgacacagctttctggcccagatggacctcgggaagacccaagggaggtagttgggctgcctgggaatgctgtccagacacctgaagccagaagactctcctagtggtcctgataggtatgcctcccaacaaatctctgcacagatgggataggtccctgactacaaagagagtggctggagttgagactgtgcgtctttggaatctactgtggaaaggaggctgattggctcacctcattggctcagattagcatgcatcacccaacaggtcccagtatctgggcagtttcttgactgcagcaagagggcttggagccaagactgggccccttcagtatctactatggatatgcctgtcacatggatccagttgggcgtgtgtctcccagcaagtccctccatagatggaatgattccctgactacagcaggagaggctggaggtgtgactgtgcccccttgggatttgctgtgggacagaggattgagagcctggtcttggctcagaggggtgtgcatcgccctgaatgttcctgcacatacaggatatttccccaactgcagtgagacgagccaaagctgaaactgcaccaccctgggatctgctgttggatggaggttgatgtgcttgtcatgttggctcagatgggcgtatgtctcccagcaggtctctgcatagacaggagggttccctaacagcaggaggagggtctggatctgagactggaccctctcaggatctgctgtgggatggtggctggagaacctggtctgagcatgcatctcaccagtagaccctgtagacaagatagtttcctggttgcagcaggaaaggctggagctgagactgggctccctcaggatctcctgtgttgcagaatctggagagcctgtcttgtttgcccggacagatacccctcttccagcagatctctgcacagaattattttcagaccacagcaagaagggtcagagctgagaatggaccacctgaggatctgctgtgggatggaggttggcgtgcctgtctcattagctcaaatgggcacccatctcccagcaggttcctgtttctgcacagataggatgcatcccctactgcagcaggaggagctgaggctgagtctggggcctcccttgggatctgtggcatggagtctggagccccttgtctcattgactcagagacacacccacaggagataacttttcaacttctagtaagcaatcatttgaatcattaagtatttttggtgtattatacataaccacacttaattacaattcatacctgtaccttcttattgctacccatatttgaggaataggtctttcccttctttccttctatatttaaaaccttttatctatattttcttctcatgccttgagtctaatctcaaaccttgttctcttcttgatctttgctaactttgttgtaaatgtgctcctatcccactattgaaacaaacaggcaaactctccaacattcgccttatctatcctcatttcagctgaatttcttgacagtgtagttcacacttctttatctctgatgcattcagctgctctcaccacgtttttaaaatccagtgggcacgagtcacccatgaccttttagttgccaaatccagtgaacacttttcagttcttgtctgacttatctctggcatttatcagtgttgaccttaccataactctgaaacttttcctgtcttgcttagcttatgtgataccttttccctcaggtttttcttcttttctggctcctcttcttccttttccacagctggcaattcctactcttacagctcttctaatgttttcctttcctttcctttatctttaggcaaaggctatggtgtgtgtgtgtgtgtgtgtgtgtgtgtgtgtgtgtgtgtgtgtgtgtgtgtgttctagcaacctctttcaaatgaattccaatggattctaacactaagctggagtgtcaggtactacttgtgatttcttctcttttatcttcctgggagttttacagaatctacagtagtgatcactacttcccacagtcttttcctgacactttctttctccctttctccagtttattcacttctcttttagattacaggacaattttcctctgttctccgtacatccagcctggctgtcctccagtctgtgttccatagagctactgaaaaccctactaagaaacaaattttgtaataccatttccttacaatgcttcagtaattaatgttaacatttaggttaaaaacagccttatcattaagaaaacttttaaactgatttaaaatttatataatgtgaaatcattttaaagtatacaattcagtggcatttactgcattcacaatgctgcacaaccacaaccataatttctaaataattctaagttttcatcaccccaaagggaaactccatacccatcaagcagtcatttgtcattctcccctccagctagccccgttcatccattaatcagctttctgtgtccgtgggtttacctattctggaggtttcatatacatgaaatcatcactatatgtgaccttttctgtctggtcttttacttagaataatgtcgtggaggtgcatcccattttgttgcatatattagcacttcatttttttgattgaataatgttccattgtatagctataccacatttgttattcattcatcaattgatggacattcgagttgtttctgccttttgaatgcctgattttgattcatttttgtagagtccttaggttttcctaagtataagatcatttcgtctgggaacaaggctaatttaatttcctctttttcaatttggatgccctttatttctttgtcttacctaaatgctttggctgattcattttgggcaaatacctgggaagagtgtttaattgctgggtcatatggtaattctatatttaactttttaaggaaatgccaaactgtctactacaacatctacaataagataaattttcaccagcaacttatgagggttccagtttgtgtacatcctcactaactcttgttattttattttccagttttaaatactattaatatctaactcagtgggtataaagttatatctcattgtatttatgatttgccttttcctaatgactaatgatattgtaaatgttttcatgtgcctgttgcccatgcatacatctttttgggagaaatgtatattcaacttactttcccgttttttatttgagttttatttttaaccaagaaataccttttaagtgatcagacctggaaccttgccaggtttaatgattatcaaagcagagccatattttgacttttgatgttatctattattatagtcttgttattcataattacttgaatattatcagcatctctagatcctttgtagttaaaacatagtaaagtattttaagtctttatactaaaatagtacgtcttgaaagttttaatatagaacactctgcttagcatttctttataacctaaaatgcaattaataaaagggtgtcatttcctctgccaattaagtagccttcattggttgatattgaacaaattgctgatacttatttctgtgatgtttactttttaaaaaaaatattttttgctttctttttaacacttccaaacaattgctaggttaatttgtcagttgcaaatctgaaataaaattgtttttagcagtctttcaaataaaattttcgttgagactaaagagatcctggattacaatcaacatttgtagatatgtcatacatagagaaccaaaaaaaaattataaatctgatataaatatcagtgtgccatacaggcatggtggctcatgcctgtaatctcagcattttgggaggctgaggcaggtggatcacttgagtctaggagttcgagattagcctgggcaacatggtgaaaccccatctctataaaaaatacaaaaattagccaagcatggtggtacacacctgtagtcccagctgtttgggaggctgaggtgggcggattgtttgagcttggtaggcagaggttacagtgagccaagattgtgcctctgcactccagcctaggtaacagagcgagaccctgtctcagaaagcaaaacaaaaacgcccaaatatcaatgtgctatgaaaccacacattgtatgtgttcattcccacaaattggagcattttaagaagcgctctaaattagtttatgtcttgcttttcttcttatgttctgtagattctttagtactccataagaaaaatttgctatagaaagcataaaaactgcaaatgcattatatcctccatgaaaccagctttaatttagttgctaaaccctgatcattgttgcactatacactcagaaaatgtatagcagtgactattttgtaaatatgaagagttcatattcagcacattcagcaatggtttatatctaaaatgatttttgaagaatgctttaaaaaacttctttgcctagagtctttaaagctggcactttaaaactatgtttcatggattgtcagttggaatggacttcaggaggtccataagtccatgaaattacagttttttaacatgaatttttctgaggatacatgatttttatcatactctcaaaagaatctaaaactcaaaaatggttaagagacacttaaataaaatgttgataaaggccatggtcattgattctcattcttcagaagctttgcatgtgtgagtttacctactcactaaaatgtacttgtaaatccaaaaccagtactcggtgcttttgcagtcatttgtaaacatatttggagaagcaaaaattttgagttaccttatgtgttcattcctctctgaggtcaaagaaggtgatggtttgccttgtttcagctgtcatactgtaaacaagtgtccttttcaatgcgtatttagtgccatattaatcacattttttgttgttgatttttctgtttaaaatggttcccaagcatagtgcagatatgctgtctagtgtttctaagcataagaaggctgtgatacacctgagagaataaaaatctgtaatagacaaacttggttcaggcatgagttacactgctgttgactgtgagtttattgttaataaatcaaatatgaagtatcaatatctgtataaatagttaaatataattatatatagatgtaaatataaattgttaaaatacggaatctttaaacagaaacatacattttagaaattatgtattggcattggttgaccaagatgatgtttggagaggttttcaggaaactaaccctgtctttttcccaggaacaataattctgcaggaggcagaacctgttgtctaggttggagtacagtggcatgaacatggctcactgcagttttgacctcctgtgcttcttctgccccagcttcccaagtagttcaggctacaggcacatgtcaccatgcctggtaatttttgtattttttgtagagacagggtttttcttgcccagactggtcttgaatttctgggctcaaacaatcctcccatcttggccccacaaagtactgagattagagatgtgagcctccatgcccagctatagttaaccttttgcagtgtttttttttttaacttaatgtttctaaatttcttctagggtaaacatttactacgtagaggctgtgtgtcatttacctcttcatggtatcacacatcagatacttctaacataatcatgataaatgttagtggtttcatggtcttatttacactccagctctaccagaattcactaatctacttcaagtttctgtctgaaatattctttttttttttttgatacagagtctcactttgttgcccaggctggagtgccgtggccccatttcagatcactgcaaactctgcctcctgtgttcaagtgattctcctgcctcagcttcccaagtagctgggacttacaggcacacgccaccacacccaactaattatatttttagtaaacatggagtttcaccatgttggccaggctggtctcaaactcctgacctcaagtgatctgcctgccttagcctcccaaagtgctaggattaacagacacgagccaccgcatcctgcctctgtctgaaatattcttattgttcatcatacagtatattgggctacagtactgtatttttctccagggtgttggtaaccatttatgctgagtttagccattttacttaagagtctactaattcactgtagataaagagttactactttggcatggtggagcatgcctgtaatcccagctctttgtgggaggccaaggcaggtggatcgctcgagtctaggagctcaagaccagccaagacaacatggcaaattttatttctacaaaaattacaaatattagccaggtgtggtggtgcatgcctgtagtcccagctactgaggaagctgaggtgggaggattatttgagaccgggaggtagaggctgcaatgagccatgattgtgccgctgtgctccagcctcagagacagagcagtaccacaaaaagagttagaagagttctttatctaacaaatatgagttgtatatttgcatagttgattgcattcatgaagtctaagtatttttttattcattaaatctaaaggaagttggggctctctgctttcgataagatgaagtaacaagtactgtacttatccttcacctaaaataatgattaaagaaaatttgtgtgtttatttcttaagacacagaacaagcatttgataaaatccaacatccattcctcataaaatcactcctgaaactggtgatagagaggaacttcctcaacctgataattagcatctataaggaaccaatggtaatattatatttactggtgaatgtctgaatgctttctcactaagatcaggaataagacaaggatgtctactttcactacttctgttcgatactgtactgcaggttctagccagtgcaattagttaagaaaaagaagtgcttctagattaaaaaacagaagtaaatcaatcattatacttcagtgatatgatcatctatgtatattattctatagaatctacaaaaaggtactagaatgaataattgagtttagcatgcttgcagaatataagatcagtatttaaaactcatgtagttttctgtactaggaacaaaaatttgaaattaaaatttaatagaagaaatattttctatcacataaataataggctatacttggggacaaatctgacaaaagatctggaagacctttactctgaaaactgtaaaaacattactgaatgaaaataagtgtgcagattctttacatatgatactaatagaatgatctgtttaaaattgattaattgtgcatcagctatatacataagccaaaacttaaacaattgtacaccttaaatatgtacagttaattttgttaattcaaatccctatactactgttaaaacaaattagaaaaacaaactaaaggaatttatgttcatatgacagtgaatgagttgtctgaactcacctcaatttttaatcctaagatgaatccatctctaaaaagtactgaacatctctgaaaagttatgaatatggtgtatgttttctcccataacctcatatatagcaattattgttattaggaaatcagaactagcttaaataatcataacattgaccatctgctttccttgttaaatacatttgactactaacttaatgttttcagttagccctctaaaatttgagaaagcaacatcttttttacctttttgccagatttctacaggctttctgatatatagttggccctctagatcattgctggcagtttgaaatatgtgtgattatgatagagtatttaaaatattttattataaatatttgatcaattttttattatataaattttcttcttttaaaaaaatacaatttagagatggggatcatactatgttgcccaggtcttgaactcctgggctcaagtgatccttctgccttggcctccaaaagtgctgggattatagatgtgagccactgcacccaggctagggtaaacttttgataaatatttttgattatgtagaataattttatggtgagttcaaagtagggttttgcaatttttattgtggagatgtatttatactgttagtttcaggatatctgtactgatcatctcctgtgtttttaatcatgatgtttccttttcaaacaacacattatgatgaaagatcaattttcaatgaaatcatttataagtatatactagctattgcaactttggggtttggaaaggaaaaattaaagtgtgttatgtttacatgttggaaacatgttagaaaaatcagtctaggattggaaggagatgggaagatttaggagtaactgctaatgggtacaaggtttcttcttagggtgagaaaatgttctacaatgatttgtggtaatggttacagaagtatgattatacctaaaatcattgaatcatatgctttaactggataaataaaaggcatttatattggaaaggaaatagtaaaactgtatctgtttgtagataacatgatcttatataccaaacaaaaatcttaagcagtcccctacagatctattagaagtaataaatggcttttcacactacccacatagacgtccatacggcgttctttctggattcccatcgtagcttaaagcgaaacttttcaccatgtctggagcccttgatgtcctgcaaatgaaggaggaggatgtccttaagttccttgcagcaggaacctgcttaggtggtaccaatcttgacttccagatggaacagtacatctctataaggaaaagtgatggcatccacatcgtaaatctgaagaggacctgggagaagcttctgctggcagcttgtgccattgttgccattgaaaaccctgctgatgtcagtgttatatcctccaggaatattggccaaagggctgtgctgaagtttgctgctgccactggagccactccaattgttggccacttcactcctggaaccttcactaaccacatccaggcagccttccaagagccacggcttcttgtggttactgaccccagggctgaccaccagcctctcacagaggcatcttacgttaacctatctaccgttgctttgtgtaacacagattctcctctgcactttgtggacattgccattctatgcaacaataagggagctcactcaatgggtttgatgtggtggatgccagcccgggaaggtttgcgcgcgtgtggcaccatttcccatgaacacccatgggaattcatgcctgatctctacagagatcctaaagagactgaaaaagcagagcagcctgctgctgaaaaggctgtgaccaaggaggaatttcagggtgaatggactgctccagctcctgagttaactgctactcagcctgaggttgcagactggtctgaaggtgtgcaggtgccctctgcgcctattcatcagttccctactgaagactggagtgctgagcctgccacggaaggctggtccacagctcccaatgctcaggccattgaatgggtaggagcaaacactgaaaggtcttaagctgttattgcacacgctcttaagcaacatggaaataaggttgacggaaaataaatgtcagtttaaaaaaaaaaaagtaatgcattcagcaaggttgacagataaaatatcaagatagaaaaatatattggatttttgagcaatattaatgggcaaattgaaaatgaagttatgaaacaatttcatttaaatatcttaaaaagaaataatgtacttaagtataaatataacaacagaagtgtggaacttatactctaaaaactacataacattgaaagacattaaaggaaactaaatggaaagacattaaatgttgatattttgaaaagatttaatatttttaggatggcagttctcccccaaattgatctaaaataaatttcctactaaaatcacagctaaattctttgcacaatttgacaagctgctcttaaaattaatatggaaattcaagggacccagtatagccaaaacaatcttgaaaaagaccaaaattgtgtttctcacttcccaattaaaaaacgtatgatgaagccataccaatatgtagttctggcataatgatagacatatctattaatggtatagaattgagaacagaaataagtcttcacatttatggtaacctgtctttctataagtgtgccatggcataaagaatagtcttttcaatgaagggtactagaacacctgcccatccatatgggaaaaaaaaaaagctggacccctatctcatatgcaaaaattaactcaaaatgaattaaagacttaaatgtaagaactaaaactgcaaccgttagaagacatagggatacatgtttatgactgggcatgggatatgagctggcaaatgattcttagataggtcaccaaaagcatgagcaataagagaaaagaataaataaattagatttcatcaagttttgaaagttttgtgctttaaaggacaccatcaagaaagtgaaaagacaacccacagaatgggagaaaattgcactcacatatctattttatcttgaatatataaagaattatttagactcaataatgatgaaaagacaaataactcactttaaaaaatgggcagaatatctgagtaggcagtttcccaaaagaagatatacaaatgactaaggagcacataaaaagatgctcaacataattagctatcaggtatattaaagtcaaaactacaatgagataccatttcactcctgctaggatgatgggtataatcagaaggacagagttttggcaaggatttggagaaccctaaggcattgctggtgggaatgttaaatagtgcagcctttttggaaaagagtcttgcaattccttaaatattttaacatagagttaccatatccagcaattctgctcctaggtatatacacaagacaaatgaaaatgtttgcacaaatgtttatagcagcattatgtataatagcctaaacatggaaacaacccaagtgtgttactgataaatgaataaacaaaatttggaatatccatgcaatagaatattatttgacaaaaaagaaatgaagtactgatacatgctacaacatgggcaaattttgaaaatatcgtgctaaatgaaggaagccagtcataaaagtacacatgttttatgattccatgtctgagaagtggcctgaacatgcatatttttagagacagaaaataaattagtgtttgcctgggacttgtgaagatgaggttttcggaagtgatgactcaagagtgaactggtttttttggggggtgttgaaaaatgttctaaaattgatgtggtgatgcctatacaactccaaatatactaaacaccattgaactgtacacttcaaagggatgaattgcatagtatgtgaattatatcttaaggagctgataaagaatatatatttattggtctgttttaccctttgaatggattttacccatatgtgatgtttttaccatgatacattaatcatttgccagagtttttgttccttaaattatgcatatcttacaaatgtaaaatgtcttatttgtcaatatcactactaaacaagaaaatagtctttaagcattgggaacctcactggtggatatgagttttacacgatcataattttcagagacccagggagaattatctcccattttttgattagttttctgtacactgttgcctaattatctttctgaaatacagattgatcaggtaactctctgatcccagcctgcttgtcattgtcatgcatggttagtccttcataaaatatgctattatggaccccatcttttactaaattcagagaaagcatgcccatgtctctctgtgttttttgtgtgtatgagtttctctatgtataattcactttagtttatttttcttcttttcgcctggtaaaatcttcaaacttcaagaaacagcatatctgttatttactctttgaccttttcattataccccatattccttggtgctttccaagttttttgttcgtacctttattataacactcctcgtatgttgttttcatgcttactcctccagtagagctatgaacttctcatgactttatttgtgcttctattccctcacagagtactttagatataataagagtctcttggattaatgagttcctaattttattgtgggtgctcagtaacatttttattttgatgatgttataattgaggtatgaatcagactccccttacactttctgcatataaatcttttttgtaaaagaattctatacattttaattatcctataaaaacttaattaccaatattgtttgtagatgtctgttgccagatttttaaaaaatgatgcattaccatccccataaatgataattgccttttgctttttttaatataaaaatgacaactttgcctgtcaaattataaaaaatgttttctcattattttcatttgccattctttggttactgtgctagagaatatatatgtctattgtttgttagtgtttatatcattgccctttaaaaaaattgtagttgtgcaagaatggatgtaggcaggctaaaatatggactctccagagatgtggatatgcctgggaaattgtcatttgatttacctgtcttcacaatcagcattttggaccgtgatacagttgttactacctatttacacttggctgataggcaggctcaaagctgtagcctcttattagagtcagtcaaggggggccagaatggcaagagccatttttttttttaaactgctggtcctacctcagcagcaccaggagagtggcaaagggggcttcttcaaagattttatggtatcttcactttatgtcaaagtctaagctatcagtatttttctttgtagtagttggtgtatgtgccaaagttagaaaatctttctctgtcttggttattaaaataagtggctgaattttctaatacctttatgggttctgttttgttttggtttgttttttcatttgtgtggggtttttgttgttgctgctgttgttgtttttacacttttggttaaagtgtgacaggaaaaacttttctttttttccctgaaaatggttctgtttttatgccagcttaatgtactaattccctcatttccgtctaaaaaaaaaatcacctttattttaatactatattgccataggtacttggatccgtgtttgaactctgtatttttctgttgatctgtatattagtaccaaattgtttctaaagcaattaacaaataatacattttaatacctggtagtaaactgctcccttaatcccatcattattactcatctatttcagaaggtactttcttattattcttccacatgaatttaaaaatcatattgatattttcaaaatatcacattggaatttgtaggttctttaggaagaaataacattttagggtacatttttgttttcttatcatatatcaagtttttcattttaattatttatttcatagctttttattatcgaaagtttcaaacatacacagagaaagaatagtaggtataatgagctccacgtttctattctctatctagcttcagtaattatttacatttgccaaacctgatttaagtacctctcctatgaagcaagtcccagatgtcttatcatttcatcctcaaatgctctagattgcctgagaatggtctcaaaaaacccaccatcatattattcacaatggtaatttcttactgctatttaatatccaatttagatttgcatttcataattgtttcaaaaatagccttttacagtaagtttatttgaatcagcatctaaagaattcaaacactatatttgtaccttgtgtcttttattattactgcttttctctctctcgtcttttttttttttttttaatactgtcattgacctttttttaaaagagaaactgtgttatttttccaggagaatatctcactttctgaatttggttagttgcttcatatttagtatttgctgagaatttgagctagagatttggttaaactcaggttttatttctttaggcaagaatcttcttaaagtgatgctccatcatttccattttatctcatctgtgagccatcatatctggtggttccacttttaatgatgctgagattaatcaatatgttcaggtgtaggttttttgtttgtctggttttctttctgctattgtatatagaacattttccttactgtttttctagtaggttattattggtatctgagaagatttttaaagcatgtgttttagtaactggacatctgaccaaactctcattactgtgtcaacttaaaaatcatgagatctgtaaatctggaaaagagaactttatttctgagaagggttacaacctgtaggctgggaagcacagcctctggattagatcaaaagtagccatttcaaagacgatgggtgagagaggagttttacactaaatgggttagctgaacatacatatttaacaggttataggaggagctatgagtattcatgaaaggggttacatgtatgtatgataagcaaacataacatgttacatatgtcccatgttcgctttggaatggagacttaacattaaaaatgtggtaaaatcagactctatacatcaaaggtgaaacttaggactcaaaggtgctttgtgcacattctctgtaaactgaccagtccatggtcaattgtcgtttatcaggaaggattgctttgtaagttggtcagcagtcatgtcaaaaccatgaaaagggaggggaatctggccacaacatcaggcagttggtcagtggaagaattttccattctttcttttccagggctggtgtttgtttaactcttaggaaaaatagtctaatgacaggtagtgaggaagagtgtatactgagacgtgaccaacctcctatctcatcaaggccgggaaacttcgtttttaaagtttttctggggcctccttagcccacagacatctgttcagtaggttggggcacttaggattttactttatctcacaaatatctaataaaatttttgggtgatcctcttcagtgactagtatagaattgtcacacttgagctttggagatgaggtgtctcaaattaaaccctaggatggttatttagtctttctgtgcctcagttttttttttttttaatctatgaaatggagatcatgtgtctacctcataggtttataatgaagattgaatcacttcccataataatcagaaactacatatttgggctgggagcagaggctcacacctgtaatcccagccccttgagcccaggagtttgaggttatagtgagttatgagcatgccaaagcactcagagtgagattctgtttcaaaaaaagaaagcagatgtttgttttttaatttttccatatcttttgcagattgtgatattgtgctttccctttttttcatattttaggcctttaattttaggatgtaattatataggccataacagttaaaaaatagcagtgataacatgcatcctacaataacatgaatagctaatatttattttagtataattttcttcttgtataattatgttgttttagtagtatgttttgaatatcaccagaataaatttttggtatctattaaaataatactataatttctttacattgatcttttaagatacagtttatccaatacttatgatgccaggttccagaatgcattagaagagtgtttgtggcatagggaatgttggaacagaagcaacactttacaatgttaaatagttttattgagaaggtgagatttgggtaaagactttcaagatgagtgaggatccatatgggtttctgggggaaatccagttcagtggaggggttggcatttgctaaaggagggcatgtttggtgtgtttcaaaatccagtagggagccgggtgtggtggtgtgcttctggagtcctagctgctcaggaggctaaggtgggaggattgcttgagcccaggagttcagatctagcctggacaacatagcaagatcccatctctaaaataaaataaaaatttaaaaaattgtttaaaatcctgtagagagttcagagtggttggagcagagtaatggagaatagtagacaatggagttagagaggcaatgagaggtaaagggaagtggcttgaacctgtagggcctcatagactattgtaaagatttttgctttttagtgagtgttgttggaagcattacagggttttgaacaaaggaatgacatactttggcttgcatttaaaaaggacagctctatgtgcgtggagtcaaggatggaagcagagaggttaggaaatcatcgcaacagtctaggcaagcagttatggtaacttggatgggtggtagcgtggagttaatgaaaagtggttgaaatctggaaatagtttgagaacaggcttttcaaatggactggatgtggtgtgtgaataacactcttctcactggtcttgttgcctctccaatccagttatacacagtagcaaaaatgatcttactttacatttgataatttcaccttcttgattaaaatccttcagtgacatactattacactgaataaaatttatccttcttaatataaccaacaaggcccacataatctagaactgcatatttttctaaccgttttcatctccctgagctccagccatacaggtgttaaattgttttaatatgccaaagtttttcctgcctcagatgctttgcattgctcctccctctggaaacttcccctaaccgtaaggtcactctttacccaatcagctcatttgcatgtttcacgtctcagtttaaatgtccttttgtctatttaaaatatattttagctgagtgcctttaatcccagctacttgggaggctgaggcaggaggataacttgaggccaggagatagagaccagcctgggcaacatagagagacctggtctctgaaaaattgaagaattagctgggtttgatggcttgcacatgtagttctagctacacaggaggctgaggcagggaggatcacttgagcccaagagttcaaggttacagtgagctatgattgtaccactgcactccagtctgagtgacagagtgagactccatctctaaaaaaataaataattggttccttctttgcctgcctcccactctttgtctttctcaaacatttttttcttcatagcatttcttacaattatgcattttatttctgtgtaatgtttttgtttgctatgctttgcattttatattgtgtggaatctccatgaaaataaggaccagcctgacttgttcaagtttgtggtcaagtaacaggatggtacctggcccttagaactatctttataaatatcattagattggattgactgactcaattaatgaacaaatgaacaaacaaaataaatcattatatgctgaagtagcagtcctggacattgtatctaatttagattttaatttaaccttgttattttgatactcgcttcccttaatcagtcattgcatgttccttattgtaaggtggttgtttttctttatcatgagaagaatagttcttctccgggcgcagtggctcacatctgtaatcccagcactttggggaggctgagacgggcggatcacaaggtcaggagattgagaccatcctggttaacatggtaaaaccccatctctactaaaaatgcaaaaaattagctgggtgtggtggcatgcacctgtagtcccagctacttgggaggctgaggcaggacaatcgcttgaacctgggaggcagaggttgcagtgaatcgagatcgtgccactgcactccagcctgggcgacagagtgagaccctgtctcaaaaaaaaacacatttttttatttagctattagcttctaggcaaaatcttaaatttcagaaaataattatactcatatagtcatactacctgtcagggaaatgtgtcaaaggaaatatgaaacaatagctttaaagttgtcccgcaccctcaccctgtttttcttttgaaggtattatactaaaggaagaaagggaaaaagagaaatctatggtgtgagttcaagtttactactgtaagtgtttaagaaagggctctgttaccatgacaacaaatgcatgaatttcatgtggaaaattttcagtgtatgggactgataaaattgtaacattctgattttctctggtatagaattgttctttgtcaagttaaaaaaaatctgttaatatatgttaaaattaaatttttaaatgttttatgatattgttttctaattgtttattataacttaaaatcatagccaaaagagtgtactttcgtagatctgtcaagcagaaagttaagtatttgatttgacattaaaaattacttttctaatctgtattagatttttgctaaatggtaaataaaatggtaaatagtttcatgtattgggagttcttgacaatagaaaatgacctgccactttatagattcctttgccttaaatgcttactaactcaggtagaggaaagctgttaagctttaagtgctttgtcatatttgcaggcttttatagtggaagagaacagcagtcagcaatgatgatggaaaactgtggcaggtagacttaaaacaccataaagcacagacgattgtgtgtaatgccttgaattgaatcctttttgaatgaaatgatcagccatatgtgccacccttatggaccctgtaagaagagtagaagaaatgtgccctaatgctaactgtgcatgaaattgcagtgttaggagatattgaccagatgtttcaatctcagcaaatggcttgttatgtgactgagtgaaaatatctttgctgctttgatcacatacaccttgaaggaaggggtaatttaatagaggctgtcatagttcatcattgtcaataaactttgacttgacctttgccttacgtttttgatgttgctgctgttaagtgttgttgggcagatgtttactgccttgagggattttgctttttataaagtgtatactagaaaaagtaaaggagaaggattttctcaattcttttcttattctttggttattagttggcatgcttctctgtggattttgtagaatttctgggcagatgcatttgagtgacattcttatgtctaaagatcactgtggtgtttctctaaaggtttcttcctttcctcaccttcctttttcttttctcgagacatggtctcactctgtcactcaggctggagtgcaagtgatgtaatcttggctcactgcagcctctacctcccaggctcaggcgatcctctcacctcagcctcctgagtagctagaactacaggtgcacaccaccatgcctggctaatttttgtattttttctagagatggggttttaccacattgcctaggctggtctcgaacttctgagctcaagccatctgccggcctcagcctcccaaaatgctgggattgcaggtgtgagccaccgcacctggccctttctcaccgttttgtcctggttttaatttaccacaataaacttccttggtggtttttctttcttattttatatacagcctattcttttgttctgatgaaagtcacattgaattaaaacttgacacctattgtaacaccataccaggtgctgtgttatttttttatccctagttttggagacctttggagataaatccatgctattttgtaatccatttttgttaatcttaagaaattgagtgaaagtttcagtaacacaatttttttaaaattataagatacagtattttaaaattttggtaaatagctttggattaaatgagtttcttgtttaatttgatgaatttgactcagttctgtaacctttttgctctttttcttgaaaagaaaaaggcttcctcactggctatatctgggttctgcctacactcttccctcacttccccttggtgtaggtggcctagaccgtgttagtcacctaatgaaatctgtgaatcctctcttgaaaaacacagcaaagtttccttacaatttcaggatgtttattggattttccccccctcctctcacacataccctgcaatgataggggcccctggacttcaagcagactaacaaagcttagaaaataagattcatactccttcttagtattctagatatataacaatttgacttagaagtaacaataacaatagtattagtgatactgctacaataattacaacagtaataataataataataattaaaatttactttctgccaaccttatgccagattctatgctgaacctttaacctgtattactggttatattgttaatgatacctctagatagagtatatgcagcatacttttattctgtactttaggaaatactatatctttagaatacagatttgagtaagagattataagcattttgattctaagactttttggaatactgaacttttagttttctgattccagtagtcagtctgtctgtctctgtctctgtctctgtctctctctctctctctctttctcggcctctctgccattcatcttcttctgaaaattagctatcccacgtaagcctcatatatcccctaattcctatttgtagttgtgagggaggaaaaatattttccttctaagttctctgctgtaagattcttgtaacaaaagacagattaacaaaagttaagtacactaatttatattctaagttttatgtaacatagagggaaatgaagacttgaagaaacaattaaacctggtgtttttacattaggttttatgaagagtggaagggaaaggcaataggacaaaaaggggtatgaactaagagtagtaaactgaggggaccttagcaagacctgtttgtttagattcatctcatgtccttacatcttctgagataaggatgttctttttttctgcatatagtaaacatcctctcacatggatggtcttatgatttgcttcagaggaaatcagaaagtccttcctgcacctgctgttctcaaattccttcagcttaaaattttcagtatgtcaagtgccatattttgggggtagtgtgtcctgatctccatcatagttaagtgtcagcttggacacagtttctcatatttatcttaggaaatcttctttggccactctgcaaagactaaggtgctacttgcatgttctgcaacaactcctattatatatatatcatctcttaaaataaatagtaacatatcttgtatgtaagctttatgtacccttaaattgtaagttttaagaagatacaatcctggctttcctgttcacttatttgacaattatttaattgcatagaatgtagcaggcactcttctagatttggaaacacaccctacaactcttttaaaaaagccaagaaaacagtcttgaacagcaaattacaattaagtggaattaattctatgataggaatgatacagtttgttgcggcaacataaaatgcaggcatataggctgggcacggttgctcacacctgtaatcccagcactttgggaggccgaggtggatggatcacttgaggtcaggagttcaagaccagcctggccaacatggtggaaccccacctctattaaaaatgcaaatattagctgggcatggtggcgtgcacctgtaatcccagctactcaggaggctggggtaggagaattgctcgaacctggaaggcagaggtttgcggtgagtcaagatcgcaccactgctctccagcctgggtgacagagcaagactccgtctcaaaaaaataaaaaataaataacaatgggtatatagaacagaatttaggacaacattgtctcagtaagtgaaacctgaaacctaagtaggaagctagaaagaacaaacagaaacagaatgaagtattcagtgtactggaacattgcattcaagagtgttaatgcttaggattaacttggagaggaagttaatggttcaatcataaagttgtttatgttgaacttgcttaagatacttgggtaacgattgaaggacattttaggaagagcactcaaaatgcagtggattggagaaaaacagaactaaaggcagggagatgatctaagaagcttttgcaaatggttgcatggttgggaggatggagtgacagagagaatgggaaatgacatccaatgggtagaggtttctttttgagataatgaaaatgtgatggttgcacagctatgtgaataaacaggaaacaactgaattgtatattttaaagtggcaaattgtatggttatatgaatatatctcaataaatttttttaaaagagacttttatagtagtctaattgagagtagatggtggcctgtactaaagtggtgttaatagaggcaggagtaaaagtgtgtcaatttaataggcaaaatagggttgagtaggtatttggatattcagagcagtcatttgaaaacaagtataagctaaaaatgagggggtctcagcatatagatgataattgaaaccatgagagtagattagatcatatccagagaaagtatatacggtaagaattgtaggtaacctgggaatccaggcctgagaaatgctaaggaatggggagaaggaaagaagcctacaaaagagatagagaagacttctttatccattattaattacaataatgtccaacaaataataggtgatcaacaaatattggtggaatgaattgaatgaatatacactaaaaattctgcattttatcacagtctcagggcactgttgtcatcgtcagctgtactctgtaataggcactgccttgaacactttgcttacattatcctattcaatcatcacaataattccacaagaaacatagtctctgaaatagtagcttgtttaccatcacatggctggatgaacttatatatctgagtctaaagtttattttttctactaggcctaatattccccgaatctgttctgagaatgttaacagatatttactaacaaaaataacaatagaactatttcagggaaagaacaggattattagaaattgatttttattaataggatgcttgctggcaggggcaatggagcagttttttaaggaaagaagcataacatactagttattcagttagaatagattcttaatatttatgaaaatcttgtgttttgccctgtctcacttggtggtattgtaatcatctgagaatctatcctataagttatgtgatatatgctattttccttatcaatctatttcagttttgatttcctcatcatcctttgcagtctgcttgttgctgtttctcagttttgacatttaatttcttttagttgtgctttacagtttttctgagatgcctcattgagttttctgtataaaatttcatatctttggcttatcttgcaactcttttagtacctaggtgtcattcttcatcattctattatgaattgaattaaagcatatggcattatttcagaagtgactgcctcttgggcatcattgtcagttatattgtcctaaatattgcatttaggtaataaaaaggaaatcttccttgaaggtaaagttaatattaatagaaatctttccatatgttgttaaagactcttgttatgaagtttaatatgccatttatttaggccttatttaaattcagttgtaaattttttccttctggctccttaccttagtgaactgtcatctcttatcatcatactctttgctcgaaaaccttcatgtgttgctttctaccctcaggatgttgcctaaatttcttgaagtggtatttactgatctggcctacatctacctttcccattagtctcttccttcccacatagttgctttgtcggtatactcctaatagtcttttatttctgtttttcattgtttttgttaatattatattcttgtttcccaatctgtgcactaagtccccttggggtgctgtagcaaacccacagagagtcttcagggtatttcaaaatttcaaggtaaacacagtgacgtctatcagacacagcatgaaccactagctccagatatttcagtttttttttttttgagatggagacttgctgtgtcacccaggctgtagcgcagtggcgggatcttggctcactgcagcctccacctcctgagttcaagcgattctcctgcctcagcctcctgagtagctgggattacaggcatgtgccaccacgcctgggtaattattgcatttttagtagagacggtgtttcaccatgttggtcaggctgttcttgaactcctgacctcgtgatccgcctgcctcagccttccaaagtgctgggattacaggcgtgagccactgcgcctggcctggtatttcagttttaacattagattactacattccttttggtggcattatactgtgcgaaactgaatctttgacggtttctgtgataaaaagcaaatcagtgtgaaacaaatgagggtgatggttaccagtctgattccaagatttgagaattttgcagtgcctaacaggtagaaaatcattaggaaataaacacttttggctgaaacgaattatttaataaatggaatttctttcatcctaggggcaccatgataaaatttctaacataggaaaggaggcatgtgctatatgctgtatgactcttttttctttctagtttgtaaccattttggaagatcatacccatccttcaaagaccaattgatactgctacctgtctttggaggcctttcctgatcccctccactgcagttgatctctctcatgggtattttccagtaatatgctgcttttttactattgctgtttaagttaaactaattgaagtatttatttgaagttaccaatagtggccgtggttttcctattcctccagttaggtataattacttaaagtataacaagagccctttccttctttgtataaaggtgatacaaatataataatagaaaccctatactgtactaaactgcgtaggttgttagtcaatttctttttatttcttttttttcttttttctttttttttgagaggagttccactcttattgcccaggctggaatgcaatggcgcaatctcggcccactgcaacctccacctcctgggttcaagcgattctccttacctcagcctcctgagtagctgggattacaggcatgcgccactatgcctggttaattttttgtatttttagagatggagtttttccatgttggtttggctggtcttgaactcccaacctcaggtgatctgcctgcctcggcttcccaaagtgtcgggattacaggcgtgagccactgcacacggccttgtttgtcaatttctaattcttacaacatccttaaaagatcataggttatgttatccacattttatatttgaagaaattgacgtttagcagtgttagtttttctcacacccacatacctcctgacctttagctattctagttccttttcctttaatattgattatagaatcaactttttgatatcctcaaaaatccattgagagtttggttgggattgcattgaacttatgaatcaatttggggagaattaatgtcttaagaatattgagttttcaaatccatgtacataatatagctcttcgtttatataagttgtttttttttcctcagcagtcttttgtagtgttctacatatatgtcttgcacatatttggttaaatgtgttcctacatgtttcaattttggtggtattgtaaatattgttttcttaattttaattttcaactcttctttgaaaatttatagaaatacattagatttttatatattgatcttaaagtctgagaccttgattgacttacttttaattctagagcatttatgtggattccttatgattttacatatattccttaaacatgcacaggttggtatctagccatagcctcaagggttactctgtagatttcaactcattcttctctgaaaatctttttcacaatttctagtctcctggctctccttgaacacatctctttctcctcattttagtgaaaatgccaggctctatttgccttctttctccctctccatggtgtggaacttgcctcctggcagagtacctgcatgatgtcagggcacaccttgtttctttcctatcagagatcacagtcctaccatgcctgttattcaatgtctgaaaattctgtaggtgtttccttttggttttctggtttacagcacaacagtaattctagagcctgctactcactcatggccagagcagaagttaaagtttttaaggtatactgtacatatgtgaaccaagggaaggtaggcagtttattttagctaaaagaaggagcataatcaaaggttataaacaaggttgaatctccatcctggagaatcaaaatctagtagttgtgactttgtattaggaacatcatcatttttatctttttattccctggcagacatgcattaaatgtttgttgattgagtatcaaaatgataggaaatagattagttggatgttggtgaaacattgtgttttagatgcttacagatgtactaaaattttaacagaaatctttgcaaattacttgttaaattttcctaaactgatttttaaaaatctatttcattctcaattataacatctttactgagattattaagtgctttgaagcagttaacgtggcttttttttttaatggctgtaaaaaaactgaatttttaggcttgttaaactctggttttagaatgacttttgagtggaaatcactgatcaaaagcaaagttctcacattttgtcaatatctgaatgtcagaaatagaatgtcaggcagtttcccatgttgaaatattcgatagtaaaaggatagcaaagttgctgaatatttctactgtttatcaatttttgccttgcaggttcaaataatatttatttgtagtggaaatatttcaattcatttaaatcctgattatggagtagttagtaaatcaggtttaagcctgacagtgagttgatatagctcttatttcagactgtagtttgaacatgtagactctctgattataactaggctaaattatataataatgactttattttcactgaacaaagtttgctattattttgatgacaaattatttaagtaatcatagtaaaagttgctattggctctgggttttatttattttgctatatatagtagacatggttgatcatttaatcatgccttatagataaataaaagtaagttatagaataacacagaaattttctgctaaatttatactttcactaaatttaataacaatagaaattctctgttaaatttatactttcactaattgtagaataaagtattttaagttaggcatttatactgagacattttatgatattaactgcttcatgttatttactcattttgataaatggagtgataatatccaaaatggaataaattaagtttaaattattgttattctttaaaggaatgatttagctacagtatgtttgtcccaccttttaattttgaacattttctaacttacagaatagtaaaatgaacttttctatacctttcacattgatccaccaattgttaacatttcaacacatttgtgttctctctttaaataaatgtatgtgtgtgtattttcctcagaaccattctgaagtatttattccttattcaagaaattaagcattgatactgttttctgatgtgtgatcaagattccagatgtcacagttattctggtagtgtccttgatagctgtttaattttattctcagtccaggatccaataagaatcacacattacatgtattagtactatttctttaatatactttcctcccacctttttggttaaggcattttcttcaagagtccaacccagttgattgtaatatgtgccaccttgtggacttaatctcatgattttaggcaataatagtacgtaagtgacactgtgtatttcccattgcatcacatcgtaaggtttatggctttattgataatgctaattgataatggttaagatagcatccctcagattttttgcttagaaccttcttccctttccccattccatgtttgtgttttccttatcctgttcagcaaacctagttcccaacagcatcaactttatattcatttgctctatcctacaatacgcacaaaatagtttcaccaataacataaccaacaataaacctactaaataaagtttgatttatttgttgtttttgttccttataattattccattaagactgtattgtcataagagcatactgaaaaattatttgcattattttttctatgtgcttatgttacaatttgataccttctttgatttttcattcttgttatactcaacttcataatttgtttttcttctaatggaatttgaaattaaaattaaattttattatttgaaaatgcaaaattttaacatgtttcagaagtcaaatttgtatggaatgctatattcagagaactcttctattcctattcctctactcctttcccactcactctcatagaaaagcatttttcatttctagtttattctttctgtgtttctttttataaaattagcaaacacaaaattatatatacattctaatatatgtatatagtatagtatctatactaaaagaatatatatggttgagtgaggtggcttgcacctatagtcccaactactcagaagactgagctgggaggatctgttgaattcaggagttcgaggcaagaatatacacacacacacacacacacacacacacacacacacacacacacattctcttttatgtaataaaaaccataacattaactctaccatcttaaccatttttaaatgtaccaattagtatacgcatgttgttacatagtcaacctctagaaatttttcatcttgcaacactgaaactctgtacccattaaactcttaattctctgacttccctccctgacgtccttggcaaccaacattctacttatgtttctatgattttgactacttcagatacttcctatgaatggaatcatacaatatgtgtcttttttgtgacagaccttatataacttagcaagttcttgatgttcatctatgttgtagcatgtgacaggatttccttcttttgtttctttatcctttaattgttgatagatgtctgggttgcttgtacttcttggctatcatgaatattgctgcagtgaacatggacatgcaaatatatctttgagatcctgctttgaattcttttgactgtatacccagaagtgaggttgcttgattatatgttaatttaatttttaatatttctttcaggaacttccataccattttagtagtggctgtaccatgttacatttccaccaacactgcacaagggttcattcacttctccacattttgccagcattttttgttttctgtgttttcggtagtaaccatcctgatcagtgtgaagtgatatctcattgtggttttgatttccctgatgattactgatgttgaacatcttttcttgtgcttattggccatttatatatcatttttggagaaatgtctattcaagtcctttgcccattttaagatcatgttatttgtatttttattgttcatttagaagtttgttatatattctggatattaacctttcattggatatatggtttggaaataagttgccttttcactctgttgattgcctcctttgccatgcagaagttaagcttgatataatcacatttatctatttttgcttttgttgcctgtgcttttgttccatatttatgaaatcattgctaaatccaatgtcctgaagctgtcccccatatttgaaaataatatatattattaagttttattttttaaacaaagctttttacctttgagacttgatttttttttgaagttaacaaaatatcctggaaattactttgtatagaaggagtgttccacagagcttttcctttttttgtgttgttttgctgggatttttgaatggctgtgtggtattccattgtgtggatatatcataatttaatcgactgatcttctacaggtggacttctagtttatttccaacattttgccattacaaataacatctcaatacttatatatgtgttgttttatattgtggatgagtctgtagaagtgggattgctggtcattaagctgttactatgtctcattcttacagttctgtctttgttactttttcctctcctcatccttttacctctcaaatatgcatgtatttcttttctattccaaatatttgagaacagattttatcaaaatctattttgatatcttttgactttgtatgtagattatttgtaggttattttgctacctgtaagtctttgaaactaaacaggtgttacctatagaatcactatagaatattagaaccctcagggatttgagctaattataaaaggtaaaaagttcaaatctgtgaaacatatgcatcttacaagaaatccattaaagcttataataattacttcaatgaaaaaatgagatatttgtaactagaactgtaacactatttctgaatttttaaaagaatttttttagatatgagcatgttttagcttaatttatatatgaattactacaataagtatgacaatcatagtaacagccacagctaatatatgttgttgactatgtgctgggtaccatgctcagcaatgcaagtacattaatttacatcatttcaattagtcctcaacgaccttatgagatgtatttgtaattatatctccactttaaacatgagtgaaatgagaaatgttaagagatatgctctaacatgctctaactcatgcagctagtaagtggcagaagcaagatttgaacccagagagtcttcaatcaagatggattctgctctttttatgacaatgctagacttcttatattgggacccactattattttcctatatcaggccagcatttgtcttaaggtctgtatgattttagctgctgagtccttaacaactttatgtactttatttctctccccaaagcagtataagatattacatggttgttatattaagtttttttaatcgtaagtgatagcacagaattgaaatcccattcataacagctacagtttctcacaaagcattcttgtcacatcactatctgtggcagaatattaaactatgtgtaccatttttttgccccattaaattatttatgttcctgttttacagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtcagtgtaattccaagggaaccactatactaattggctattttaacactggtaaaatatgaattccaatgtgaatttggaattttgactttataattccttttaatgtttgataaatgcttattccttatatcagttttcctgtattgtttttaaatttacttttgttaaacatgcagttgaattcatgaggcataatggaataaaagtttgaggttatttagtccagtctctactttttataattagaatcagaaaaggctgatagcttgctcaatgccttgtagcttgctcaacaccttgtagctaatttgttgcaaaacttgaattagaaacaatgttcttttcaccatatcctgaggttggaatacgagagagagagacagagagacagagagagagtgtgtgtgtgtattttatgtatataaaatacaacattacattcaggctcgtaagacttagtcatctaaatggtcatctaaaccatttctggcaaatagtaattcattcatattgaataaactcagtcgtgggtagtataccactaacaaaacaaccaagtatatttctatacacccttacttattagaaaagtattcttaatatgaacttgaaatatctctctcaggcccctccatatattggttggttgttcttttgtacccacatggagatactccttcagtgtattcatgcactgctaacgttattaccatatcagcacaggcttttttcccctttgcaagggaaaaacaaaataactgccctagctattatattgttgggataatcaaagatgacctctttttaaatagtgattcactagaaattttgcattacttatagttggaaatatgtagtctgtcctcctccattccctatctcctttcttttcccatcttctcttcctttctttttttcccttttcatcctcctttattttcttccccctctccaccacgaccttgctccatttcttctatttacccactttattgctcactacttgaccttcagcagaggtatattaaggaatggactattctagagactggggatcaataagcacagtatttactaaataaccaaaatacaatattcaaaaattattagggtatgaaaggcattttcagatctttcctttaattttgttttttatatacaggagaactttatggttttaagattacagtaaacattgaaatatgggattcagggattttaaaaaaaaacaactaaaaatgttgaaatatgtttgtttagacctttgcccttagttttcccaagaccagccttaatctgtaggtgcaaagttttcccattagtgagaagtaggtcagattttcttctgatatcacttaggctacagtaaaattactaaattgttttagtatgctaaattgctgtcctaaagaacagttatggttgggtgcagtggctcacgcctgtaatcccagcactttgggaggccgagtcaggtggatcacctgaggtcaggagttcgagaccagcctggccaacatggtgaaactccgtctctactaaaaatgtaaaaattagccaggtgtgcacctgtaatcccagctactcgggagacgaaagtaggagaattgcttgaacctaggaggtggaggttgcagtgagccgagattgtgctattgcgctccagcctgggcaacagagcaagattctgtctcaaaaccaaagagagagagagaacagttatgataatattagatcttctggatgtcaaaaacttaacttttatactaattttatggttatagtgatattgttgagatgatatgggactcaaaaattggggagaaatcttcagtatctaaatcattatctaaattctggaagctaatacagttggatcaattgttttggataggtccagtaacctttgctgccactatcaaaaactcagaaattggccgggtgtggtggtcacaccttgtaatcctaacactttaggagaccgaagtaggctgatcactcgagctcaggagtttaaggccagcctggccaacatggcgaaactccatctctacaaaaaatacaaaaattagctggggatggtggcatgtacctgtggtccccgctgcttgggaggctgaggtggaaggattgcttgagcccaggaggttgaggctgcagtggactggggtcgtgctgcccactgcacttcagtctgggcaaaagagtgagcccctgtctaaaaaacaaaaaacaaaacaaaaaatttcagaaattgaagtgtttgggtaatgcagtatctttcttgatccaggttcttcctcttcaaagtcagaatcaaatacgttgggataataagaatactcatatttttctggtcgggcatggcagctcatgcctgtaatcccagcactttgggaggccgaggcgggtggatcatttgaggccaggagtttgagaccagcctggccaacatggtgaaactccacctctactaaaaatacaaaaaaattagccgagcatcatggcgggcacttgtaatcccagctacttgggagactgaggcaaggaaattgcttgaacccggaggcggaggttgcagtgagccaagacggagccattgctcttctctagcctgggcaacaagaacgaaacttcatctggaaaaaaaaaaaaaagaatacttttatttttcttttggagaaactgtagtttcccatcaaaaagtagttttattatcagaatagagtttagtatctggtaccagaaatgtttgcttttatttggtagccattttgtcaaaattttcctaaagtcataattactaaaatatttttataaattaggtctaaattttcttaagtttgtaatatagttattttgtatatgaatatgttgatgcatattactctttctttccttcatttacttgaacataaacagatgtatcctttagtagtaaattggcagatggatgagtggaaatacgttttggaagagaattgaggtttttttttttaacagtgtaatcgaacatattaccaaagtctgaaatgataagattttttttgtaagctataactgttacaatttaattagaaaaagagaaaaattggcaagtaattttttaaattctggagcagtatgaggaaggaaagtatttttatttataatgtaaataattattgtatttatttttaattaaacaagccaagtgacacttgtagcaggattttatttatttatttatttattttttagagatgtggttttgccttgttgcctaggctggagtgcagtggcatgatcatagctcattgcagcctcaaactcctgggctcaagcaatcctcccacctcagcttcctgagtccctaggactataagtgtgcaccactacccccagctaatttttaaaattattttgtagagatgggatctggctgtgttgcccaggctgacctcaaactcctggcatcaagcaatcctcccaccttggcctctgaaagagctgggatttcagctttgagctactgcacccaacctgcagcaagattttaaatgcagtatcctgcttagatattccatttctaaaattggaccagtcaggggacttttcaactatagaaaacaattctaattgatttcagcccttagaatgtaatggtttacaaattaattcctcttagcgaatatggtctacatttataagtgtcttttacgaaattaattccatatttggcttttaaaggcttcgattaaatagacaattatagtatgttgatatttatttttataaagatatttttctacttaaaaaatgtttttagttgcatagatttctttttatataatgagttagccttatttcttaactgcattttgaactattaaggtgtaaaaagtaggtcctattttactatcaaaaggcaacttaaatgccaatttctttctcaaaataccaggtgttgtttagaacaaaaattatcatagatgcctcagaaagttctcaaaacaaaattattatttatatttatttaaaaatcaataacattagttttgaagaattaattaaaatgtaaattttaaactttgcaaaaaatattggtaattatctattgaaacatatgctaagtttgactataatattacttgcttattctttggttgttttaggtccctcatagctaatcttgctgctgccaattgttataaaaaggaaaaacatcttgatctggagaaaaactggatgttggtagaaaaagcaagagtttgttatatagcagtaagtacttacctaattcaaatctctagtacatatttacatgatggattatagttgttgtctgatatatattttaaaataattatcttttatttaccctgcaaattatttatctctctcaaagcatatgttagattcactattgtgaaaatagaacagaaatcattatctttctatgggtaacataatttgtattatttatcttcaggtctacctatttttggatacattatgcataggtgcttgccaaccaagcgcagaattctatattaaatcagtttccaaatatattttaaaataattctacaaacttacatcttacatttgtaggcaacttgcattgtgcagaaaaatattagtagtataaatattcactgcaaatagtttgagctgaattgcttaaaaaacttaattgctatttattccatagtaattaccatgacacctcttaatttaatatttcagaaacattgatcgtgacaaatctcttaaatctgggaacaagggcagggtgtaatttgaattattaagtcttctgacacaaaaataattggttaagaatttatttctaaaataggatggtactaaaaattctgaattaatcaccccatgattaccttgtttttatttaatatgtgttaaatgtggctttacacaaataagtagatacctatgaaaaaagcatctcgtatgcatgtaatatatggttttggtataacagctgctgccatttcattacctgagctctgtgaaatagctggtaagatgtgtaaaaaattgattaccctactaggaggaacatgtttattgaaaatataattatttctttcagtctaatgttaatgtctcctacagcatgtttgtgtgcactgttctaggctttacaacattgttattgattcctctgtataccaaatcctatccctttataactgtcaaataaatgcttacattgagaagattatataatggaaagttatgctatcttttctgccagtatgtgagaaaaacatttcaagaattaaatattttacccctttattatttccatttcattttatttctcaaattggtctcatgttctttccatttttcaaatcttgatactgtatttcttgtagtgtgattctttagaggggatttatgtactatttcaaaccatcttacacttgaaagtctgattttcaaaaagcaccatgtttagaatttggcataatttatatatacttgttgactatgaaataagacagtgtattctgatgaaaaagtatatttaacttgacaattacagtcttctatgtttcaatatatagttgttcaatcctgaattgtgagccaacttgcaaacaactcatagttgtaatgattatacagtataacatgtctagccaactttgggtgaatggaacttttatgaaagtgtagattcaacttgcagacaactcatagttttagcatttatgcactatattgtatctagccatatttgggtgaatggagttttacagtagtattaaatatttatacttacgtgcaattttgtacagcataaagtgatcagcttttggtgaaattaataaggcaaatgatattatttttgagatttgggtggtgtattcagccagaagaaataacaaaatggatttcagttgttatctgtgatacaagtgttagcttgtagcttctgtttcagcagtttcataaaaagaatgatctcttacattgccaggtaaatctgtactcttctcctagcttggcttattccaaaatagttctgaaaatagtagactcatattggatacctgggacgctgtatattcttagtgaacattcaacaaatatttacttggtgaataactaagagcataattcgtatttattgaaatctgtaaacttccttttgaaatacaatgttatttccacaaagacactgcaggttttgcaaatctgtaattccctttgatttcagagcattccgaaatgatgtgtagtctagtctagttttttcttagcatatggtcaaaccataaattaagtgggctgccccatactttctggttctatgaggtcaacagtctcattacattatcatcataaactaatgaggtttaagaaattaaagttctgggggctctttaattctaaaatgtttttgatctaaggaagcaacgcagtttatctattcaacaaatatccgtaactaaaacatctgtctgcatcacataagctaaaccagatctacatactcagctctgcttcttcacactattctccaaactagcagtgtttcatgaatattaagaaaattccaaaccttcttcttcattttcttcaccatataatttactgagtaagttcacactggaaaccttcctgactgaaaagctaaaattgaatatggatacaccagcatcctcttttggtttaaatacagtgccaagatcttttaaaatttattttttacctttcataataaatgtctcattttatgccacgtaaactcagtttttccatgtttaaaccagcttctcagattctttgttagcaggtaattagggactactggctatggtgactaggtaattatgtttttgaaaacataagtctcaggttctcttcaccttagaatcagattgggatatatctgttttttctcacttaagaaataatatttcctggcatagtggtttatgcctgtagtcccagtgctttgggaggccaaagccagtggattgcttttggtcaggagatcgagtccagcttgggcaacaagtaggtctctaaggacttgctttatgaatctgggtgctcctgtattgggtgctttatgaatctgggtgctcctgtattgggtgcatatatatttaggatagttagctcttcttgttgcattgatccctttaccattatgtaatggccttctttatctcttttgatctttgttggtttaaagtctgttttatcagagactaggattgcaacccctgctttttttttttgttttccatttgcttggtagatcttcctccatccctttattttgagcctatgtgtgtctctgcatgtgagatgggtctcctgaatacagtacactgatggatcttgactctatccaatttgccagtctgtgtcttttaattggggcgtttagcccatttacatttaaggttaatattgttatgtgtgaagttgatcctgtcattatgatgttagctggttattttgctcgttagttgatgcagtttcttcctagccttgatggtctttacaatgtagcatgtttttgcagtggctggtacccgttgttctttccatgtttagtgcttccttcaggagctcttgtaaggcaggcctggtggtgacaaaatctctcagcatttgcttgtctgtaaaggattttatttctccttcacttatgaagcttagtttggctcgatatgaatttctgggttgaaaattctattctttaagaatgttgaatattggcccccactctcttttggcttgtagagtgtctgcagagagatctgctgttattctgatgggcttccctttgtgagtaacccaacctttctctctggctgcccttaacattttttccttcatttcaactttggtgaatctgacaattatgtgtcttggtgttgctcttctcgaggagtatctttgtggtgttctctgtatttcccaaatttgaatgttggcctgccttgctaggttggggacattctcctgaataatatcctgcagagtgttttccaacttggttccattctccctgtcactttcagatataccaatcagatgtagatttggtcttttcacatagtcccatatttcttggaggctttgtgcgtttctttttactctttttttttctctaaactactcttcttgcttcatttcattcatttgatcttcaatcactgataccctttcttccacttgatcgaatcagctactgaagcttgtgcatgtgtcacgtagttctcgtgccatggttttcagctccatcaggtcatttaaggtcttatccatgctgtttattctagttagcctgtcgtctaatcttttttgaaggtttttagcttcttttagatgggttcgaacatcctcctttagctcggagaagtttgttattacctatcttttgaagccttcttctctcaactcgtcaaagtcattctccatccagctgtgttctattgctggcgaggagctgtgttcctttggaggagaagagacgctctgatttttagaattgtcagcttttctcctctggtttctccccatctttgtggttttatctactttggtctttgatgatggtgacctacagatagggttttggtgtggatgtcctttctgtttgttacttttccttctaatagtcaggatcctcagctgcaggtctgttggagtttgctggaggtccactccagaccctgtttgcctggctatcaccagcagaggctgccaaatattgcagaacagcaaatgttgctgcctgatccgtcctctggaagctttgtctcagaggggcgcccagttgtatgaggtgtctgttggcccctactgggaggtatctcccagttaggttactcagggatcagggacccacttgaggaggcagtctgtccattctcagatctcaaactttgtgctgggagaaccactactctctccaaagctgtcagacagggacatttaaatctatagaagtttctattgccttttattcagctatgccctgcccccagagatggagtctacagaggcaggcaggcctccttgagctgctgtgggctctacctagttcgagcttcctggccgctttgtttacctactcaagcctcagcaatggcgggcacccctcccccagcctcactgcttccctgcagttgatctgatagcggactgctgtgctagcagtgagcaaggttccatgggcatgggaccctccgagccatgcgtgggatataatctcctggtgtgccgtttgctaaggccattggaaaagcgcagtattagggtgagagtgtcctgattttccaggtaccgtctgtcatggcttcccttggctaggaaatggaattccccaaccccttgcgcttcccaggtgaagcgatgccccgccctgctttggctcacactctgtgggctgcatccactgtccgacaagccccagtgagatgaacctggtacctcagttggaaatgcagaaatcacccgtcttctgcatcactcacgctgggagctgtagaatggagctgttcctattcctttttttgttttgttttgttttgttttgagatggagtcttgctgtgtcatccaggctggagtgcagtggcacaatctctgcccactgcaacctccgcctcctgggttcacaccattctccttgccttagcctcccaagtagctgggactgcacgtgcctgccaccatgcccggctaattttttgtatttttagtagagacggggtttcaccatgttagccaggatggtctcgatctcctgacctcatgatccacacgctttggcctcccaaagttctgggattacaggcatgagccaccacacccagcctaattgttttttttttttttaatcagctttgttaatatatgtctcacaacttacaatacatacattttacttctacatatatattataaacatcgtaaccttgctgctatttttgtttaaattgtcaaatatatattttaaaagacttaataagaaaaaattcatatttttactcaggtatttatcatttctagttctctttattccttttggttagaattagatttccatctggtatcattttccttctgcctagagggcattctttaacatctcttgtatttggatctgtcagtaataaattctttcagcttttgtatgtttgaaaacatctttatttcaccttcatttttgaaagacatttgtgccagatatatagttctagtttgacagtttttcagtacatgaaaaatgttaccccattgccatcttacttgcatagttcttgataagaaatctgacattcttttgttcttcaatgtttcacaacccccattccccaaattttgctgcttttaagatttttcatatgagaccaggtgcggtggctcacacctgtaatcccagtgctttgggaggtcaagatgggaggatggcttttgaggcatggagatcaagattagcctaggcaacatagtgagaccccatccttacaaaaaatacacacagagaaaattactcattttgatcagtttagttatgatgggccttagtgtattcttcttcatgtttcttgtgcttgggttttgtttaacttcttagagctatcggtttttagtttttattatgtttggaatatttgcagccattatacatcttcaaattggttttctgacccttttatgccacttgaagttgtctcatagctcactgacactctttttttattttgtttctttctctatgttttattttggatacctcctttgctgtgccttccatttcactaatattttcttctgtaatacctgaactgttattaatctcatcaaataaataaagctaaatatttcttactactgggggaagacttttcttagtactccatggcacagagcactaaggggtccctaatctctggtactgcaactatatcagttcctgttaggaaccaggccacacagcaggaggtgagtagcaggccaccaagcattaccacctgagctccacctcctgtcacatcagcggaggattctttttttttttttttcaaatgtgaaaaatctaattttattcagtttagattaatgtatagctatacactctggactcttaatgaaacctttcccattctttttttttagattttattattatactttaagttttagggtacacgtgcacaacatgcaggtttgttacatatgtatacatgtgccatgttggtgtgctgcacccagcagaggattcttataggggtgcaaatcctattttgaactgcacaagcgagggatctaggttgtatacgtcttatgagaatctaactaatgcctgatgatctgaggtgcaacagtttcatcctgaaaccacgcctcctacccgtccgtggaaaaattgtcttccacaaaactagtccctggtgccaaaaacgttggagactttgatgaaaaaaatgatgagtttttctgctctaggtctttgaaacagccactatttccaaatgtgtatgtgcctcaggtactgttccttctatttttttttcctcttaatacttttggatgtttctttcccaggtactgaccttaagaaaagaccctctacagaattccaggtttctctgtaaatctttctgttctctgatattgtggtctttcaactcttaactgctctgaaattcccagactctcagttgtatttcctcaactcactggcatctactacagttctccttataccatattctggaaactcttgcaataaactgctgtagtcatatggctgacctccattgtttcccatctctcagagatacgtattttttattcttgatgtccagtgtattaaaaaccattgtttctagttttgctattgttgtttcatgatagggagtaaatctagtttctgttcctctactgtcttctgctttgcattgtttttgaaaggaagcctgctgccattcctatcattgttccctcttacctaatatgtcttttaacctcctttatctgcttttaagatgtttatcactgattttaaacaattttattatgatgtaccttggcatagttttatattttgtgtggttggggttttttatagtttcattcactttggaaattatttaacaataagttttctctttccacctccatctacctttgggactccgattaaaataataataataataataataagaagaagaagaagaagaagaagaagaagaagaagaagaagccacttgtagttgacccatgtctcagtgattctgttttcaatatttttgtttttctatctgttcttcattttgaataattactctctcccctattttgtcttttcttttttatttttatttttattttttgagatggagtcttgctctgtcacccaggctggagtgcagtggtgcaatcttggctcactgcaacccccgcctcctgggttcaagtgattctcctgcctcagcctcctgagtagctgggactacaggcacgcctcaccacacccggctaatttttgtatttttagtagaggtgggttttcaccatattgtttcggctggtcctgaactcctgacctcatgatctgcttgcctcggcctcccaaagtgctgggattacaggcgtgggccactgtgcctggcctctttcttttttttttttttttcagacaagttctcgttccgtcgcccaagctggagtgcagtggcacaatattgggtcaatgcaacccccacctcagcctcccaagtaactggaactgcaggagtgcaccaccatgcctggctagtttttgtattttctctagagacaggttttgctgtgttgctcaggctggtctcaaactcctgaactcaacttatctgcctgtctcgacctcccaaattgctgggattgcaggcatgagccgccatgtccagcattgaataatttctattactctgaagtttactaattatttcatctacaatgtttaatctgccattaatctcatccagttgacattttatctctgacattatagttttcatctcttgaactttgatttggacctcttttactcatgccatatctctacatagtatgcttatgttgtcatgtgctttcggaatgttgttataacaattgttttaatattcatgtctactaattctgtcacttttttttaatctgattaccttggtattggtttttcctgattacctgggtattcattgtttcctcatacatgtgtactgaagactccaaaggaatcccttgcatatctcgagttctcactttccacctctttcttctccaagcagctctgtcctctccagtactctgccccagcatgtggtagccagcttggcctccctgaatggaaactacttgactctatttaggttcttccttcccgctctgcagcctgggaactctattcaaggtgtaagtttgagtaattgtagcgcttaccttattctgccccttctttgattattatccaatgcctgaaaattgtgttttcatgtattttgttcattgttagttgtttaagatgggaatataaatctgctccctggtccttcatagtggctggaagtgcaaatctctaggttgattttggtttttccctttttcaggtaactcgctttttttttcaagaatgcctaatttttttatttgaatttgagtctcagtctgttgcccaggctggagtgcagtgacacaatctcggctcactgcaacctccatctcctgggtttgaacgattctcctgcgtcagtctacccagtagctgggattataggcacctaccaccatgcctggctgagttttgtattttttttttttttttttagttgagatgaggtttcaccattttggctaggctggtcttgaactcctgacctcaagtgatccacccgccttggactcccaatgtgctggtattacaggcatgagccactgcccccagcctgaatttgaatttgataataactatgatttatctctatgcgaattctgtattgagttttcctcgaacaatgtattcattttaaactgtagatttcattcccagttaactttcttgtccccaaatattgtttctcctttacttgacctattggagtgtcagaaaatgatcataaccatcactgataaatgtgttatggggaatattagagtaaaagcagaaattccaagttgtggtgagaaagtacagtagaaccttgaacaatgtgagggttctgggcactgaccccttcgaaaatccacatacaatgtttacctcctcaaaaacttaactactaatagtagttaattggaagccttactgataacgtaaatagttgattaacacgtattttgtatatgtattatattctgtattcttacaataaattaagctaaagaaaaaatgctataatatcatatggaatgaaaatatattattattcattaagtggaaatggatcatcataaaggtctttatcttagtcatcttcatgttgagtgggctgaggaggggaagaagaggaggagtggttggccttcatgtctcagaggttggcagaggcagaagaaaatctatgtataggttgacctgcacagttcaaattcatattgttatagtatcagttgtaatcttaaattcatcttcaggttgatttagtgtcaaaattccctcaaatattattctagattctataaaatgttctagataccattttatcgcttaaaaataaatgtgaaagctctcagctaagatatagttgttcatctatgtgtaattactagttttgtaattttttgtaatttcttagtcacctctgcatagtgtttggattacattgtgagtacagtaggattttgtttagaaatctatgcgttatttcaaataacatctctttatgataggaaaaaaggttccaagtttgaaataacactgtgaagaactaatcaccatgcaagtttaggcttattatggggaaatttttaaactttaggtattaaaaagatttttaagaaatagattttaacaaactttcagtaccttgtgacttaccctgcgtaaacaaggtcagccaaatttgtaccctgtttcatggattagaaattaaacactataagtgaaagaataataagtcatatcttgtcaataattttgtgagagtatgagacttgtggtgagttttcctttagcactcatgcctattttcttttttaaattattttttcagttcctatgtcttattacaggtcttctcttttcctctcttcatttatttataactctgtcttgaccacttatatctgttttcggtctagaattttactactttggagaatgtggtttttgtgagggtagagttttcaaatgtcactaatgtttgcttctggaataagggaagtatgattataggtcagtagaagaaacatggtatgaagaaatgtacagccttggtggtaagcaatagaattcatacttacaaagaaacagaagtatatgtatattaaaggcaagtaagaatcactaccaaatgtttacattttacatctcctgctttgtttgccctataggtttttcatacctatgccatgagtaacaatttttcttagtaaaactttcatttatactcagttacaattaaatatctttatcagtaatctaaaagcaataaagcccttaaaatgaggtagtgtgataaattataagaaatctcatctaagaaatcatatgtttgaaattttacgtgtcagtaatgtggtttgtgtccattgaattaacaagttagaatgaatttataattaaataaataatttctatttttttaggatttggttatcttttggcagtatttaccaaaagacatggttacactaaaacgtgactagaaatttaaaaagattgctcaaaatttcatgctcagaatttagaacgtgccatctagtattctttgctctgtcatgaaaagatttgagaaagtttcagtgaaagtgaattaagttgttttgtaatggtaacctaatggaaattgaagtaatttttttttaaaaaaggtaagtattatttaggccaggcacagtggctcaagcctgaaattccagcccttcgggaggctgaagtgggtggatcacctaagatcaagagtttgagaccagcctggccaaaatttttggtagagaccagaccatctctactaaaaatacaaaaattagccaatcatggtggtgcattccttagtcccagctgctggggaggctgaggtaggagaatcgctcaaacccaggaggcagaggttgcggtgagccaagatcgcgccactacactccagcctggctgacagagtgagactctgtctgaaaacaaacaaacaaacaaacaaaaacttacttaaagtgatagctttaaaccttattcgaccatggaacaagcctttgtaacataatctatactgttacaataagtacactttggcagagtaagtgaactaatgatttttttttataatttaagctagtctgtgaatgacagttgattaaataatgtcacagctctttatatatagcattaaatagagttcaaagtatttttggaatttattaatttataatattcttctgtgattattaaagaggtgggatagctaaactttttctcaccttttatcattgttccaagtgcagttttgaactcgtatgtgttagaactcccattatattggtcaaatcgatgatcaccatatgactttattcctgcatttttgcctcaaatttttaactatcctattctggactgcttcattaacttcattagggattaactatgaatgtttaagcctttattttacaatgtccttgcaggtgtccttaactgtttcatttataaacacagagaataaaatgaaaaaaaaatctgtagagttgtttgttctatttggagcttttcatgttggtgtaaaattcctgacacttaacacatatgaatctttttcattcatgtttaataattttatttgagagtcacttcaagtaaagcccaaactgtgttaacatttgagttaagcaaagacatctttgcttaacaataaagcaaatatcacaataaagcaagtcacatgaatattttggtttctgaattcatataaaagttatgtttacactatatggtactctcaagtgtgtggtagcattacatctttaaaaataaacatactttaattaaaaatactttgttgctaaaaaatgctagtgatcatctgagcctttagcgagtaataatctttttgctgttggagggtcttgcaccagtgttgatggctgctgactgctcagagtggtggcttctgaaggttggggtagctgtgacgatttcttaaaataagacagcaatgaagtttgccacatcaattgactcttctttcataaaagatttctctgtagcatacaatgttgtttgatagcatttacctacagtagaacttctttgaaattggagtcagccctctctaactctgttgttgctttaacagttatgtttatgcagtattctgaatttttcgttgtcatttcaacagcattcatagcgtgttcaccaggagtagattccatgtcaagaaaccactctctgtgttcatctataagaagcaatttctcatccattcaagttttatcatgtgattgcagcaattcagtcctatcttcaggcttcacttctaatactagttctcttgctatttccatcacatgtgcattgacttcttccactgaagtcttgaagccctcaaagtcatccatgagggttggaatccacttattccaaactcctattaatgttaatattttgaccacctcacatgaatcgtgaatgttcttttttttttaaacagggttttactcctgtcactcaggcagggaagtgcagtaacaatcactgcacattgcagtctcaatctcccaggcaagctcaagcaatcctcccacctcatcatttattttatttttgtagagacgaggtctcaccatattggccaggctggtctcgaactgctgggcttaagtgatcctcccactgcggcctcccaaagcgctgggattgcaggtgtgagccaccatgcccagcccatgaatgttcttaatgacaactggaatgatgaattattttcaggaggttttcaatttactctgcccaaacccatcagatgagtcactatggcagctatagccttatgaaatatattacttaaataagatttgaaagtcaaaattactcattgatccatgggctgcagaatgaatgttgttttagcagccgtgaaaacaacattcatcttcttatacgtctccatcagagcccttgggttaccagatgcattgttaatgagcagtaatattttaaagggaatctttttttctgagcagtagatctcaacagtgggcttaaaatattcagtataccagctgggcacagtggcttatgcctgtaatcccagcactttaggaggccaaggcgggaggatcacctgaggtcaggaattcgagaccagcctggtcgacatggtgaaaccacatctctactaataatacaaaaatgagctgggcatggtggtgcacacctgtaatcccagctactcaggaggctgaagcaggagaattgcttgaaccctggaggcggaggttgcggtgagccaagattgcgccattgcactccagcctgggtgacaagagtgaaactgtccccaaaaaaaaaaaaattcagcataccatactcaaacaggtatgtgttcatccaggctttgttatttcatttatagaacacaggcagagcagatttaacataactcttaagggctctaggatttttagaatggtaaatgagcattgacttcaactgaaagtcaccagctgcattagcccctaaaaaaaaaagagtcgtcctatcctttgaagcttcgaagccaagcatttacttctttttagctgtaaaagtcttcaatagcatcttctgccagtagaagactcttttgtctatgttgaaaacctgttgttcagtgcagccaccttcatcaatgatgttggcaagatctgggtaactcttcagcacctgctattttaccttgcacttttatgatatggagattgcttctttctttcaacctcacaaattagcctctcttagcttcagacttttcttgcacagcatcctcacctctcagctttaacagaattgaaaagagttaaggttgtgctcgggattaagctttgacctaagagaatgctatgctggtttgatgttctatacagaccagtaaaactttctccatgtcagcaataagcttatttcactctcttattcatgcgttcactggagtagcacttttaattttcttcaagaactttttctttgcattgagaacttgcctgtttgttgtgagaggtcaaactttcagcctgtctcacctttcgatatgccttcctcactaaactcaatcatttctagcttttgacttaaagtgagagacatgcaactcctcctttcacttgaacacttagagaccactgtaggattattaattggcctaatgtcactattgttgtgtctcaagaaatagggaggccttaggagaggtagagagatggggtaatggccagctggtagagcagtgaaaacacagcatttatcagttaagttcaccatcttctatgggtgtggtttgtggcatcccaaaacaattacaataataatatcatagatcagtgatcactataaaagatataaaagtttgaaatattgaaagaattaccaaaatatgacagagatccaagcgagcacattctgttggaaaataatgacaccatactcaaggcaggcttgccataaaccttcgatttgtaaaaaaaaataataaaaaggtatctgtgaagtgcaataaaataaggtatgcttataccaaaacagacttaattatgctatttcttaccattagtgttagagttcagtttctaatgtttttcattttccatatgttattgatgttcagtgagttacacaaattatttactgttgttacttccaccttagtagggagaatctttgatttttgctggataaattttcaaacaagagtgtgattataggctggacgtggtggctcacgcctgtaatcccagcattttgggaggccgaggtgggcagatcacttgaggtcaggagttggagaccagcctggccaacatggtgaaaccccctctctactaaaaatacaaaaattagccgggcgtggtggcgcatgcctgtaatcccagcacttgagaagctgaggcaggagaatggcttgaacctgggaggcagaggttgcactcctgcctaggtgacagagtgagactccatctcaaaaaaaaagaaaagaaagaaaagtgtgattacagagatcctatttgtgtttatttttaatttctctagaatttgttttcttcaataaataaaattctaataccagttttttttgagtaacactgtgatttttatacagaaagactttctccaaattggagaatgtactcttttattcctgtaatttttcttaactcttatttttggcagctaccaaaagtaaaactctctaccaagacagagaagaaatctttgggaatattaagtaatgttatttttcattacacggactaacctttttactaagaagaattgggatagtattggttatgggagcttaggagccctaaagataaagattggaagattttgtgttgtggacttgtggcactgtaacaaagtctgggaattttatgtgagattggaaaccacactatgtgctaattgcctcagaatggtaagaaaataagcatatgtatagcatttagttgttaagacagtaggcacttatgcagagccccaaatgaattaacaaatcatctactgaaatattttcacttctgtttactttatgtattttagaccaatcagcagttgcttgagaaaatgaaatgtttactaaatctctttaataaacatgtttaagagaggaaaaacttataaacattcagatggcagtgtacatttttaagtgctagttgtcatatctttgaaattgtatgtaaactggacataaacaatcaagtgtctacagaatggtatctgtcttccaatatatttactgaagatattatagaatctttatagtttaatatgatttaccccacatgttctgttgttgctatcttttcagataaagttgaatttaatctttcttatcagcttttattgaggtatttatgaaccattgagttcacccacttaaaaaatatcattcagtggctgttagtgtatttacagagttctgctaccatcactgtaatctaatgttagaacattcacatcaccacagaaggaaatgttatacccatcagtagtaatgctccataccccctggatttaatcttatatccacatctctcataatagtttcagtggtatctagttattatgactacaaatgatgcaattgttcctgattacacaaataatgtatttatgtctttattgttggcatgtaatggaagacataataagtctgctttgatctcttgctcttacctatttctctattgcaagtgttataaagagtcttttaagcttttgctcatatatataaatatatatatacatacatttatatatacacacacatacatatatacacacacacacacacacacacacacacacacatatatgtaatgctaccgtgtttgagggtcatgagggtcagttttttgaaataccagtttttttctgatttaggtggatgacatggtacgtgaagcttaaaaaaaaatttggtaaattggtatgaaaaaatgagaggacaacgtttttcctttctggtacttagcaggaaggcaagttcttgtatgaacccatatttcctgttacccattttcagaccaatattggtttctcatctatataatagggatcttttgactctaacctcttaaatctatcatgtgttttctttcttcaccttggaaatagcttcttgaagccccagacttctagagcacattcatattaactaacattgtcctggtttactagttagggatattagtaaatcctaaatagttgaagacgttctgaaagatatattgctgctttttaaaaatttatttatcttgttctctatacggatttctggcacaaggttggtttttgtttttgtttttgtttctgttttttttttgtcaattgtggtaagtccatggatgcttttctctataactttcccattttcccttatcacaccgtcactgcaaacatctaatttctgtccagtctctcaactcttttcagctctgctgtcctaactaatcattttttgtattcatctttcaaagtatttgtttctgtcttcattctataagtaacaagattatttaaggttattttgtattacagaaatagtaaaaatcaaataaaatatcaaatgtagaatagtccaccaaaaatattttatttcatcttttccagagaggtacacatataataaagtaaatgagcattatatattttattattaatcctcaataatatatttttcacaggtatgttgcttcttgtaagtttaccttttttaatgtgaaaactacaataaactaaattaaattttaaaaatattttacttactaaagtcaactgatgttttcctggtagattgataggcttcttgtggtagcttttaatcatttgcaagttttgagcccatttctaaaacttttctcattgtaaatatgtatttcctttcttatattaactgagaatttgtttttataaaaataaagtggggaatcagactcaaggtgaaatgttgtagacttagtgccagcaataagcagaattatttaaaatcattcaaatatctttaattcccttgttgtctttttcaaaaactgtacattttaactacattaatataacggaagactttttaaggcttagttttcctttatagatattccctaatttcatttttatttcagtctgtcagggttgtgaatgtgatgttttaaggtacactgtagtgttttcacatcctcagatgaactgaattgggacaatactttgtaggaagttttttaatatagtatgtagacacattggtaaaaatcagtatgtccactggcttattagtttcacagatgcttccataattcttagtgtactcttgggtattttaaattatcatttcctgacagcaatcctgaaacatgccagtcttttaaagccttatttctgagaactaaagcaaggcatcagcgaaccatatctgacatgccatgttaatttccataactatcatttctgggaggtggtaggatttctaaggcatggagaatctcagtaaatctactttaaaaaaaaaaaaagcaaaatatctgttttattactgggtttccattcacgagccctgactgcttcattcccacttaaataatttcaaaaatagtgataagcatattttttctcttatagattattaaatatttactcacgtgcacaatatatcaaaacatattttgaattctatattcttagtgttgggtgttcatgttgtgaatgaaaacctcattctgttatctcatagcatatttatatatacaaataatttttgccttaagtaggaaagaaacagctaaaagatacataggttattttgctttttaaaattttagcaaactattctgtgaatcttttgtgtgtttggggctgtttgtagaggaaaatttcatcaagcaacattttgggaacattggccttttgtactctttcctaaataaacagaaacttgtactccccaaaataaaatgtttctttgtatattgttacctgcaagttattgataatggaaggaacaccttttcaatccttagtcccctttcccccaacacagcttttagattgtcgataaacttcccagctcagtaattaactgagctcagtcattgcaccctgtatcatgtgatttttttttccagtggaatacattattagagcacttacacagccagtctagctgcagcagcccaggcggcaacagcagtgccatttttcacaaagaaaatgttgaacaggagccaaatgtttggtggcagtctgttgctaggaaatcaaggtcctgaggcgattaatgacaaagcaagcaataacaagaaggcagaattacagatttaaaagagaaaaaagtggttggtgttataattacccaaagaaatccgcactcattaaattggctgtttttatgattgactttaattggaggttagctcagatatttagctcctttcccacccctttaaacacacacaggcacataatctgtagaactgcagacttgtttttctaagcattgagaggagcttgccctgtaatttgatccccactgacagatgcattttctatgctgccattttgaattaacctattgtagaacaattttcttcagccctgttgaataaaacatccagtctgattacctccgatggatttgatagagtaaaagaatgtacttctcattgaagtagattgtttgcatggactctactgattgtgaactctgccagtaagcacaatcatttgtaataaattttcaaagaaatttgtgaggaaaaggtaatgagagtcacccttttatagtttaatgtttggcacctccatcaaaataatataattcttataagacagtgttatttttccagtaagcttttcacgtggttttagaaaaaatttctgaatcttcatttggactattcatatatttaggaatagagtcttgtatttacactctaaaatgaccattcttcctccccaacaacagtattttagtgcaagactcaatatgcaaagcactctattgcaaaaatatttttggtatgtacaatatttaaagtgattttaagattggcctatttcagtctttgaagtatttcccccccccaaaaatcccttatttaaattttttagggtgtgataaagcatattactagaaaagcatcaatcggtctttcaggtacaataccagaggaaccatcacagtttatttacctttcagaagctttaaaaataaagttacatgatgcctctgctctccagatttctaatcaaaccctggaacaaaagagccaagcacattctatctgacaatgcacacactgctaatcagatgccaatgccaagctgtctgctttgttaaatacttagcttcctagaggcaggaagacagctgctataagtatgatgaaattttgtagttcaatctatttttgctacccttgggctaccaagatactgttaatttagaccaccccaattggtacattttagggagttttttaaagagtttgtaattaaaatgataaaacatcgttattacattgaagaccttctgtaagttttacatttggcagatacctactgagataaccccagcatgtaatttacaatgatgtaatggttgtaattgcattttagaaaaaaagaactataggaggcaagtgcttccattagaagagtttttaaatctgcttctgtttcatttaaatctacttctatccccaaattacttacttataattgactagagcagctataaaccttaagatgctatctgaatatttttaaaaagttatcaccccagacactgccaccagggggaggaagctaaaatcttaaagttcttaactgatgatgatactgccagtaggtagattatattgcttagccctacatagttaactacttcctccagataataccgccttttgggacatgattctcacaacctgtaatatgtgatacctgtagacttagcacactattaattgtaaataaaatggaaactttcgtactctggtggttggggtcaggaaggggaaagaggaagtacaaataagcaacctggacatttttattgtttttctcttatctgttagtctacttgaagagctatccttgaaagtgagtgctttagatctatgaaactgggcagctatcatagcacatctattaagatctaataatcacataattaatgtagcaaaatgaatagactgtaaggtagttttctattttttgttactacactgtggttttgtttttaataaatagttttggctttattttaaacaattaaaaattcaaaatatttttatgaccaaagcttgtaggttctatccctggaaaatattttataaatgcagaaaatagttgcttaggattggaatccaactctgtttaccatgaacaacttaaaagttgatctcataatcttgcatgttgtggaataataccacgaaaaagttaattaaagaatttagatgtttgttctcctgtctagaactcaataacttttaagtagtaactctccctacagtttaactgttaaacagtaactcttctgacagttttaggttttattctgtgaagactcatgatttttaatttttgcatcttaatttttcagttatttcaggtattgaaattacaaacgacgggaaagaaaagtggttgactaaaaaggggatacaaaaggcaatttttagggcgatgtactgttctgtatggtactgtggtggtggatacatgatactatgcatttgttaaagcccaaagaactgtacatcacaaagggttaattttaatgtatgcaggttttttaaatgttagggatttcaggatagaatgcaagctgtaacaaatgaatctaattgtattacaaatgtatggcataacttcactgaatgggtgggggaaaaggagctgacctaagtaactttggaaaatggtgttttgattggacaatgtaaagctaaagactaaggaacactatagaaacactctattctagttggtaaatttgtttctcataacggtatgggtgaacagttctgaacctctttacatgtatcctggggttgaacaaataagtaaatggatgatgaatggtggaagctaggtttctcactgtcaggaagggatgttacagataaataaacaagaggggagagccagaatgaaacctgtggtactggattagagttggagatataagtatttactcatgtttagcttaatatatgcagatggatagatgcagaaataattatagatgcatgtgtatatgtggattagtatacatgcatatgtttcctagctgtgtttactgagaaggcctagaagcagtgatatcccagtagccacaaacacatctaacgctcacatcctggtttgtaaatcctattctccaataaaaggatccaggactccttttaaatatgactgattctggggctggtgatgggaaaatacaacataagcatggaatatcttgtagtgccagaaggcaagagatttcttaaaaataataaagattaagcatgccaaaagggacacatgagccaatgtgaaagaactccgagtggccgtagctggaataattagagcaacaaaataaaacatgtagcattggattaaggataaattattgagtaaatatacatgagttcacagtgttatgtataaattgtataaataagtaaatggaggagaagagataaatctccctgacagaagaattccaaataacatattgccccctccagaagggggatcctacttcccttctccttgagagtatgagctggattgagtgagtcatatccaaaaattgagtttggaagacagcgaaatactgacttgactatttccattggagaaagctggtaaacaactatgttaactaagtgatcaaggttaacatcacaaatgggaagtcatgctgatgtgaagaggtggaaacttcatctctctgatattctttccctaaacctgtagcctcaatctaatcattaggaaaacatcagacaaatcccaactgatggacattctaccacataagttgagcattcctgaaaactgtcaaggttgtgaacaatgaagaaagactatgaacatctcactgacaagaagagactacagagtcatgacaactaaatgttacatagtttcctggatcaggtccagaatagaaataggatattagtgtaaaaactggtgaaatctaaataaagtcttgactttagtcaataatccaccaacattggtttcttggtttggccaaatgtaccacagtaatgtaagatgctaagatagtgacattagaacaaattggatgaggggtacataggaagtctgtatattaaacttgcaatttttctgtatatctaagttcccaaatataaaataaatttatttgaggttgatcaatgggctgactatattgacaagatactgataggttacatgttgaagaaaacatacaatataaaatagagaaaaagtcagttccatcccttcccactccccctttacctacctgctccccagtactcatcattgtgatttagtcagaacagggtttagtgccagaggtcagggtgactgagggtggaggagttgtgagcaatgggttcatggctgtcacaataatgctgtggcaattctatggtttcccagctgggagttaggagtggggagggggctgcagcctgatgacagccagctgaaggaagagctacctctcccttccctagctgctcatcacctgaacccaagaccacgccaaacaagatatggatgtagatgctcttgctgagtctgttccgcaagagggaaagaaagggtagctgctccaaacacgccgtcctcatatacaagggtgaggggaacagaagcatgtggctgctaccagcaaaggaaaagtaggagagcaatagaaaggggaggaaatgggaagagcagaaaatcaatattatttaaaaagtgacctaagacttaaaattgaattagtatttgtacagaaagatgcaggtggaataactcactctggcctgtgatcaaaattatatggagaaatcatggtgggccccttcctctgtccccagtggtggcaccagttgctgagtgtgattagttagaatggattccagtctagtcgttcaggcagaggaagtagttgcagtgggcaggcaagaggggctcagttgctgcagcactggctcttgctggctgggtggttcttctggaggtccgtacctcagttttggcctggagcaccaggtgcactctggggcttattaggaatcttcttagctctcgccgtgtaaacttcattcacgttcattgcagtctttactgatgtctccatagtcaactgtcgtcgtctgcatagtcctgtgcttcgtggaattctggggctttcttgctggccaggtctgccttgttacccacaagtacagtgacaatgttggggctggcctgcctctctagctccttcacccatttcttggctggtgcaaatgtatcttttttggtgatttcatagtacatgggggctgggctatgataccgctcctgtccagcgctgccccagatctcaaacttgactattgtgtcgtctaagcagacagtctgtgtaaggaaggctgctctgattatgctctcctggtactcttgaaattgtcccttgacaaagtggaggacaaggctggatttggccaccatagactcattgttcccagtggctggtccaccaggtcgtgtgctgtgccttgccgacccgccactacccgtccagctgttgtgataccagagagcatggggacgggagccattgctatgcaaagaggcacttagttgggaagggggtctccaaaatgacgcaagggcagtagtattacttggggctggggctcacacaggctccgcttctctccccccacccctggtggtatctccatataaaaattttacttaaacgcagagaccatatatgtacttaaacacttgtctaaagaaataaaatatggccgggcatggtggctcatgcctgtaatcccagcacagaggccgaggcaggaggatcacctgaggtcaggagttcatgaccagcctgaccaacatggagaaaccctgcctctactaaaaatacaaaattagccgggcatggcagcacatgcctgtaatcccagctactcaggaggctgaggcaggagaattgcttgaacctgggaggtggaggttgcggtgagccaagatccccgccactgcactccagcctgggcaacaagagcaaaactccgtctcaaaaaaaaaaaaaaaaaaaaaaaaaaaaaaaaattcccctgcctctctccaccccagagggtaaccattatcctaaattttattattattattcacatgcttttctttataggatagccatacatgtatcactaactgttctaccatatctcataacctcttatatagtttcccttttttgtcatatttgctgtgttctggataatttcttcagatctatcttccgatattggtaattgtatcttcagcagtgtctcatattctgttttacctgacattgaattttatgtaataatcattacttccattttcatttcttcccctgaaatcagtttactttatcattttgataaactcatttcattctcatatatacaatcctcttgtttatttaaatatattaaacttattttctattttgtgcctagcctaatatttaaagcttatgcagttctgattttgctgtctgttgtttctgctggctgttactcaaactgccttattttcctgtgtgttagcttgtattcattatttgtggtgatttctgagactgagatgaagatacgtttccaaagagagtatttacatttgaatctgccaaaagcctggggatactgtcaacctgggaacacattcaaataaatgttgggcttaaagttttgtgggctgcataggtaacatgagttccagatccataaaccttcatgagggtgggcttgtggttaaattttcagggaagatgtatttacctgcacccagcatcaagtttgaaagaggttaatttccttgtttattccttctgtagggtagacatcattctattcaactcttacactaaacatgtatgtagctctttaggatcccaactttatgtggagagtctaattagacttcgtatcgttaatgtaccctagaatttatcccctaaaccttgggttcagtagtgtcctggtaaatattttaaagctggctgtccagggcaaaaaaaaaaaaatcctaatttctcacatttttctatttcacactatggctgatttcacgataccagcctgaagtcattgaacgtggagttgggaaaagatatgtacagttagctttctcaactccagtgtatcactgccagttctgtacatggctgtgaaaactgaagctcaatgcacagggcttggcatatccctcagaatgaaagaatctgagtgtttgcctacccctctggatttccatttttactttgttttaaccttttgagtattctgtgtcaactcagcaatatacttcaaaaaaagattcttttgttttctttttattttaacccagcatttgttgttgtttttagcaaaagtcctgtgttagggtacctatttagtcagaaatagaagtctctgtgcttgtttgtaagtataatgtattatttttctttttggggaaatatagaaagaaatagaagtctctgttcttgtttgtaaatttaatgtatttttcttttttgagaaatagagaaaagtacagagaatattaaaacacccataatcctatcatatatgttcattttatgtgcatgtatgtctctatacatttttatataatttgcattatatctactatttcagtatatgatttttgttaatatataatgaatgtttgctcatgccgttaactattcctttaaaacagcccccattatatatgagactaaacataaaatgctgcacacataggagttagtataattcagaaatttagtctgtattgcatttggaaataattttgtgaaggttattcatgcagcattattaataattgcaaaatattggaaaccatataaatgaccagttctagaagattggttgaatatactctggaacatacaatagactactatgtttataaaagctatctgtttttataaatatatggagtaatttccaggaaatattacatgaaacaaaaagcagaaacaaatacccatagtgctacttgtcatacaagaaaaagggagaattaaagaatgtgtatgttcaggaaggataaagcagaaaacagtaaaattagttacaagaggtagaagggagagtgaggtggaagggatgtgggagggagtgagacttggatattggggtatactttcttggcatagtttcaacttttgaaagcatgttaatgtccaacatattcaaacagttaaataaaaatgatatcactgggacagggacctaaaattgtaaacaaacaagtgaacttaattcatttttttttcttatttttttattattatactttaagttctgggatacatgtgcagaatgtacaggtttgttacataggtatacatgtgccatggtggtttgctgcacccatcaactatcacctacattaggtatttcacctaatgctatccctcccctaaccccccaagcctcaacaggcccctgtgtgttatgttcccttccgtgtgtccatgtgttctcattgataaagttaattttaaagtaaaatgaatactatatccataccgaaaggggataaagaagaaagaaatgaaggaagaagggaggacagatttatgaacaccagattcaactatatgtccttagcttggggtgggtgggagagaaatgaagaattgcaaacaaatcctgaactcacttttgtaggtttattttattttattttatttttttgaggtggagtctggctctgtcgcccaggttggagtgcagtggcgtgatctccgctcactgcaagctcgacctcctgggttcacgccattctcctgcctcagcttcccgagtagctgggactataggtgcccaccaccacgcctggctaattttttgtatttttagtagagacggggtttcaccgtgttagccaggatggtctcgatctcttgaccttgtgatccacctgccttggcttcccaaagtgctgggattacaggtgtgagccaccgtgcccggcctataggtttattttaatggtatgggcaaactaaatcagagactattttgagcaaatgagtgagcctggtttctcactatggaagaagggacaaacatatagacaggaggaagacaggtaagaattctgtgtagaggaattggattggaggtgtctgtgtacatatggacatttctgtgtgtgtatgtatctgttgatgtgtgtgcatgtatttttgtatatgtatatgtatgtgtgtgtgtgtgtgtgtgtgtgtgtgtgaagagacattcatatatttcttagctctattgctgaaagagcaaaggagcgaagtcacaatagtagtgacacacctagcgttatttcccactgttagtttcctaaggctgctgtaataaattaccgtaaacttaacagaaatttattctttcatagttcaggcggccagagctccaaaccgaaggtgtttgtggggttggttccttcttggggaggcagagggagaacctatccatacctctctcctagcttctggtggttgtgcataatccttggagcttgatggtttgtgacattataacttcaattcctgccttcattgtcatatgacattcaccctatgtttacctgtccaaattttactctttttatcagagtaatccactcattagggccgactctaattcactgtgactttatcttaacttccaaagaccccgtttctaaataagctcacattcacagggttagtacctgattatgactttttgaggagcacagttcagtccctaatgcctactaaaactaaagctcttcactcaaatgactggcttcagtctggggcagggtaggtacaagatgaacctagaacatgttgtaatgccaaaaagtaaggaaatgctaaaaagtaagataagttgtttgttaagtatacagaatctagcttgaagagttccccactggtcaaatctagggcaatttgagcatcaaataattaaatacagtaatgaattataagctgttggaaataaagaactttataagaccattccaatcactaatgggtggatggatagaaaatgaagatattttacttacagtggcatgctgaaagttgaccagcaaatgtggaggttgtgctagagttgggaaaaaacaaaacaaggaaacctcattttgcagtcatcatgttaaagattagatcaggcaaaaatcatcaatggttgtaacatctaagaggacagacatgttgatgaagaacagaatatttacatggtcttgaaatgttgtatgggagaagagaaaaacagcaacaatgcagtggagaaatcagacaacacattgacagggtgatcacaagtatcacctccagtgagagtcaaatgaacattgtttgcctccttatgtgtttatctgtccctgagaagtacacaacatcatctatgcagtttctggcccagaatgcatctcaactcaatcacaagagaatattatgcatacatacagaaaaagaaagaatacaactgaacatagatgataaagaaaatgaggtaaaaatgtgacaacagatgaaaatggataaaggtattttctgtgtttttatttttggaactttttgtacattgaaatgattgccaatggaaaagtttagataaattgtcctaaagttacagagaacttgcagggaaaaacatcttaaagtagactaatagtggagagtcataaaagacacttggcaaatcttcttagttgaatattattcaaactattcagtcagggaactgattttgtgctaattatgaaatgcattattgcattgactttatgtctcttacaacattaaattatgttacctaggatcaatttgagattcaacacatgatagtagtttaatacagtgaagtcataacttgcaacaaactatcccaattttaagaattaattctgagcaatttttatatgcatgaaaaagatggttagaattatttgcagacacttgcatattctttagtcaagtggtcttattaccataattcatatctgttgtgggagtagggaagaaagagatttaaaaaatatctatcagttctttcaatcaagttaggtataatattaatagactttgagctaagaaagttttcatgaccagaagaggagcaggaactgtctaacatagaaaatgtttatggtataccataatcagttatacaaatataaaaggaaaaaatgtttgactagtgatactctcaaacttggatatccagaagagtgattctgtcagtacactaaaagcaaattcatctatcaggagctttcatgttttcattcaacaaatatttatccagtgcctattatgtaccagatagtgttatactgtgaatcgggagcatatgttaaaatagacaatatagtagacattattctctaaaattattaacaatagtagctaatactcatatgatacttactctgggccacataccattctaagatctttacatatagtaattcctttacctcaaacaaccttattagattggtactattattacctctattttattgatgaagaaacagaggcacggaggtgttaactttctccaggtttcacagctaaaagtagcagacccaggattttgaatccatcagactggcttgtgtccaagctttttttaattaattttttttattttgacataatttgtagattcacatgcagttgtaatataatacagagagatctcatgtactttttactcagtttctcgaggtaacttcttacaaaactatagaaccatatcataaccatcatattgacactgatatagtcaaggctccaaatatatctgtcaccacaatgatccttcatgttgcccacccacttccctctgttcacctattgaaagacatcttggttgtttccagtttggagctattacagataaagctgctgtgaatatttgcacataagtttttgtatgaacaccaatttttggctgggcgtaatggctcacacctgtaatcccagcattttaggaggccgagatgagagaattgcttgaggccagaagttcatgaccagcctggtcaacgtagcaagaccccatctcattttataaaaataaaaaattattttttaaaaggaacatcaattttcattactttagactgcctctaagcttttaattcttacattctaccacctctcaatatatagtagggaataaatagtagagaatgacttgatggttaagttgacattcagaagaggcctgaaggaagtgaagaaaaaagccatacagctgtttggggaaagcacatttcaagcagagggaacaagcacagaggccttgagaaggaaatatgcctagagtgtttgagacagagcaaggcggctggaaggagatgagttctacaaggcagctatgagccaggtctataagatgtggctgctatatagaaaatagatggtggttgggcaagtgttgaagcatggggaactattaagaggctgcccatcggagcttgcagtgagccgagatcccgccactgcactccagcctgggcgacagagcgagactccgtctcaaaaaaaaaaaaaaaaaaaaaaaaagaggctgcccatgtgagagatgatggtagcttagacttatggtggaagtgttaaagatggttcagattctagatatgttttgaagaagagctcacaaaaatttttctgatgggctgacagttggatatgagaaaaggaaaggaggcaagaatgattccatttaccaggttccaagagaatgattacagaaaccaatagattgccttatttatttatagtaggaaatgtagttatcacatcggcccaaatgtttgtgtctgcttaatccgcatatctgtttctttaggcaaacttgcattggaatgtaatggcgactgcagaatcaggataaggggacttgaataaatcagtctttaaatgcatctgaggccgggcatggtggctcatgcctgtaatcccaacactttgggaggccgaggtgggcagatcacttgaggtcaggagtttgagaccagcatgcccaacatggtgaaatcttatctccactaaaactacgaaaattagccaggtgtggtagctggcacctgtaatctcagttgctcgggaggctgaggcacgataattgcttgaacctgggaggcggaggttgcagtgagcctagattgtgccactgtgctccagcctgggcaacagagcaagactctgtctccaatcaatcaatcaatcaatcagtaagatacatttcactccagcctggacaacagagcaagactctatctcagtcaatcaataagatacatttatctctttagtagggacctgaaaaaattaaattccatagacaaaaggctttctgagctcttctttaataagtagtgttggcagatgcagtggctcatgcttataattccagcactttaggaggccaaggcgggaggatccctgaggccaagaatttaagacgagcctggtcaacataacaagtccctgtctctaccaaaataataataataatatttagacatggtggcttgtgcctgaggtcccagctactcgagacgctgaggtgggaggatcccttgagcccaggaggtcaagcctgcagtgatccatggttgcaccactgcactccagcctgagcaacagaatttttatttttatttaaaataaaagtagcacaaacatttgcttttgtttctctttcataatgcaccaacactaccctaacccccaacataatccttttgtagatttgttaatatattcagacaggccatattccatatctgatcctacttagtggtttgatggttggctaaaaggcagtattaatatctgttatttccatgctattgagggatatctcacattgatcatccttgtattggcaatagaaataaatggtgatagtatttttttcatttagataaatttagcactgctcttagtattattgaaacttagtttaggaatgtatcatttatctataatcatttattgctgaagtgaacccttctttaaattttcctcttccaaatattgatgtagttctttctttcttcatcagttccatgcatacaattcaattttcttcatgacacgggatcatcatctataacgtctgttacttataggactattctatgagtctcttcaagtgtatacatgtatttgcttttattttaagttactcaaattgttatatattttgagtacttatatatacattttaataattttactagccctggagctggtggtgtgtcatcttcaacttcctttttaaattccttctaatttcttagggtgggaaaaatctaattcagtagattgaatttttagaaaagagtagataaactgatgtctaaatatttaggtatttgtctattctggaacctttttgcttcatgatttttcttttttactttgcattcctgagatttcctttcatgaactggaaggctttactttactaagtgactcagcagtagctctatgtatcttttagttggaaatgcctttggctctatgcatgcacacactgcccattaattagcaaaccaacatagaatcatctgttgatgacaaaattaccaaaatggatcatccataagtgtttatactgcaaacagtgtatcagaaatgtcataatctcattcattaagaaatttacatacacaccagattttagagtgctcattcatgatgaatgtctacttccacactgtttgtttggaaacattcaatagccagtcttgaatttaaaaaatttaattgaatgcttaaagaattacaagtgttcctttccttggctctaatgctaaccaaagtgcttttctaaactgctaagaatggactgaagattctgctgagggctgtagatacttatctgcctaattgagccatcatttgttgacatgaagaaaaccacgtgacctactttaatgcatttctcagtagcagcaggaggctagaatgtagttcatccaacagtaaaactagcagcagtattattagacatgtgaaaatagcattggttatgggattagttttgtaaagtaaggatagtaatataaaggtatatagtcataatataaacagtatagagtgatttttttattttcaaaattatttgaatccaataatcatttaagtcagtcattcagtaactatttaccaatgtttacagttgccagctatattaaaggaattgttgacttgtcaaagttgattcatatgagagtaacagtgttaaaatctgaaactggtatggattgctaaaacgaaatactttgagtacacagggaattactatgatcaaaactatgctggatacattaatttgaccatgtgtctttaaattggaggtgaggaagattagttacagatacattaattagaaaggtgttatattagtctaggttgaggctgatataagtaagaaagtaggaaaggatgcaaaagcccttggaaatgaatatttgtgtgtggtgaagtaaaatgaggtagaggttacccttttacatgacttgagagaatcatggctcatttagtaaatccagagggagaaatgattttctatatatataatgagtttggaatacaggaagaatgccaaaaataacatcttaaggaattcttcctaaatagtgaagaaagaaattagtatcaacagaagagacagaaaaggatggttatgaaagataggaggtcatcgctgtctaaaatgactgatggattttgattacaccactggtgatagaaaaaaaattattagagaaaagtgtagtctgagaactatttgatcttagtctgtaatgaatgaaatataaaatttgagactatttggaaactgtttaacaagtttacacccccttccagcaaatacaaaattacaacaaatttaaagatgttaattggtttttatttgcaattctaaaatcggacaacaacctcattctattaaatagaatgaatattccagtaagctgagcagaggaagttgactttatagacagaaaagggctgaggaaagcaaaaacagaaaacaaaatgtggattggtatttccaaaattacttttcttataaaggttaaagcagaggggacttccttataccagctaaaactggtctgtttggggatctggctattatctgtttctcctgatttcttggaaagtaagataaacaactatgttttagcttagtgatgtggaacttcagcttgagtgactccattttggtttggtctggtgggcctagtgcaggagcttagtccaaactaatgggatcctatacattttgtttaacactgccaacatcctggtgcacgatcatcagatttctcattgaacagggaatggatgactttgaatgttggagagcacctgtggtgagttgtttatatataatctgtaaactagttatgcacagtagcactatatatgggtctatgttggactagaggataaaaaataacttggccttcacctcagagagtttaagaatcactatgccaccagaaagatggtagtagtaggcacattacatcgagtgaagactgttgggtgagagggaaggtttgcttaaagatataagagatttgagtttgtatattgtctaaggaagatatgatagaacagaagactgataatgcagtgtggaagagtgataactgctagatggaattgagatcaaaggtttatagatgaagactttatccttggaaaaatacatttacatttatttaatgtttagtttttaaattagatattatgtaacttgagcctcacagtaatccaatgaattaggtgacatatggttggtataattcatccgcctttacatttaagaaaattgagacacaaaaaatgttgtgtgttatccacagtcatgtggttagtaaatggggagatattttcatgcccagttctatgctataactactattatgtctgaaaataaaggcagaaaaaaatacttgaagaaaaaatggcaaaaaaccgcccaaatttattgaaaaacatttgtttatacatctaggaagctctttgaacaccaagtacaataaatgcaaagagatgcacacctggcctcataatagcaaaatcttgactatttgacaaggacaaaaggaaaatcttaaactcagcaaatcacaacaggggaacacaaaattaacagcttacttctcaccggtaccaatgaagccagaaggtaatgagataacatatttaaagtgctgaaagaaaaaaatcatcagcaaataaccttatgtccagcaaaaatatgtcaaaaataaaatgaaatattttcctagataagcaagtctaagagtgttcattgctggaacatctgccttaccaagaaatactaaagaaaattctttaagctgaaattaaatgacaacagatagcaatttaaatctatacacaaaaaacaaagagcatcaataaaggtaattatgtaagtaattacaaaagacagtataatgacatatttcttcactattctctcaactcatttaaaagcaaatgcatacagcaatttgtgtataattgtatttaggccctatgacttattagaatgtaatgtatatgatgataacagcagaaaggaggtgcatggcaacaaagctctattggagtgagtaagaaaaggacaccagatggtaaactaaattcacaagatgaaatgaagaaaaccagaatggtaaataagaagattaatataataaactctttaaatgcttgtagtcctagctacttgggaggctgaggcaggagaatcgcttgaacctgggaggcggaggttgcagtgagccaagatcatgccactacgctccagcctggaaatcataaggaatagaaaatatatttactattcattaagtggaattgaatcatcataaaggtcttcatcctcttagtcttcatttactgtctccaaaaaaaaaaaaaagtttccatgactcttcagtagattatcataaattaagatgtatattgtaacccttagggcaactgatgagaaaataacaaaaaattctagttaaaaattattaaaatgcccctataatatgcttaactgatttttgacaaaggtataaagccaactaattggtgaaaagatagccttttcaaaatgttgctgtggcaacatgacgtcaaaagtgaaaagtggccaaaagaccaaaaagtgaaccttgacctgatacaaaaatcgagtaaatggatcacagccttaaatgtaaaacgatgaaacttttatgaaaaacataggagacaatctcagaatctaggggtaatcaaatttctactgaaaattttagtagccacagcaaataagcaataaatagaaagaaatgtcattaaggttggaaagaagtgaaactactcttatttgtagatgacattttgcatatagaaaatcttaaggaatccactaagaaaaataaaggaggacaggtagtgataaatgcaaaaacagaaagtaatgaaatagaaaacaagaaaatagaattaaatctaaagcctttttaaataaaattaacaaaataatcaaagtggtcataacactaagcaagtgaaaaaagaaaagatagaagcaatattataagtgaaaaacaatgtttaatcataaacaattctaagaaatttggaccaataaaagtttgacaaaaatctgaagttctctaatttgtttatatatttttggtatttatgtatttattgtcataggtttcttagttagattcatggccaaaagtaccatccaaaaaactatttccaaatgtatatttttagcacatacctcttttctgatctccaaacttaatgaccaactggttatttagattattatatgcaaatagacttcttaatatacagtgtcaatcctgtttctcttatgtttaatacatctctgtatatggtaccactgcagggtttgactcatgtgccctagccaaaccctaggagtcatccttgattttttcttttccttcaataagtccctatctttatatctggaacccatttactcttcttttatcagcaattaccattctattacagaccattagtatttttctcctgccctactgctatagtctcctgactgatctccttctactttttaaccctttcaaaccattctccacagaatagctggagtggccttttaaaaatgcaaaccagcataaaacattttgatgtttaaatccctctcatggctgccaatgattgctcatagaataaactccaaactttctgccatggtgtataaagccctacatgtcttacatggctttcctcctacctgtctaatatcatcttattctagttctttctcattgattattcctttaacaaccaagcccttttccttcaaaagtccttcactcttactcctccttcctggaatgctcttcactgttttctaagggctgactcatgtataaccttcaacattcaactcaaatgccatcctcttagagagtcattttctggttagctatctaaagtagctttccctgttcctccatgagctgttgtcataatatccctccaacccccaacccccaccttatataaccatgcttgtctcctttgttgcagttatctccatttgtaattaacttgtttaaatcctcctagaatgccagctaataagaaggtaaggtccttgcctctctctctctttttttttttttgagacagtctcccctgtcacccaggctggagtgcaatgacgccatctcggctcactgcaacctccacctcccgagttcaagcaattctcctgcctcagcctcccaagtagctgggattacaggtgcctgtcaccacatccggctaattttttttttttttatctttagtagagatggggttttaccgtgttagccagagtggtctcgaactcctgacctcgtgatccctccgcctcagcctcccaaagtactgggattacaggcatgagccactgcccccggccttgcctctcttaataaccatattacctctggcaaccagcatagtgcctggtatttattgtgctcagtatgcatctgttgaatattattattttgtatactctatagtgatgagcatgttgtaagcaacccgatatgtataaattcattgatggtgttctctctctaaattttctttattgttttcatggtgggttcatttcctcctttaccccctctttttaggttgtataatcattagttttattttcatctctgattttatatggacatgtttcaatgcatacagacagttaatattcttttcctcctaattatctattatatatatcatcttcagtatcatcaccattcaaaaaactcttttatatgttctagataatgtggcctattttttacgttagactacctgataaggtgtcaactgaattggctgcctttatctacattctgaaccaaaatttaattctagagtttgtagtcagcgtttttccaaatgtgtaaaactgtaatccttcataaaatgtcatatgtaaaagagtaagcaattctgtgtgtactaaaaggtgagaaagttattactttagctttcactgggaagacttaaagtttatcaaaaaggattatagaaagaacagatttatagcaactgtctgatatatgaccagaacccttatgttccactgaaagagacttgccctaggctttctagagcataatgcccttagcaagtagctttcaacatctttttcaggaagcaatattttccttcagtaaaagggtcactgtactgtttttctttttccttccctgtcttatcttttgagttcaggaagtactttaaatttacaggcagctttgaagacatgaagcaagttcagccccagaagtatttcctgttatggcattaatctaattccatgaaagtagaactgatttttcatctgtaaagtagataaagtgcctagagcagccgaccattattctgggttatcatgataaagaggcttagttttgacacaaaagagtttatcagcctacccagtggaagatttcatcctttttgttgaaagatatattaatggattataatctgtcttggcttccaaaagaaagttcacctttatattgaaaatgattagttaaatcagcaaatattttcctgaatatacattttataatatacgataaatcaagcaaacattctagggatatcacatataattaaatatctaatgttaaatcattttatgttattttaatgtttaaattattgtctcaatttgaaataatcacagattttccttataaaccaacttggtttaattttaacatatagactaacataatttctagtaggcatatatgcttcattttagaagcccctgttattaggttatataatttctccttacaacttataatgtagaaatagttttcttataataaggtatttctcttaatagttaataattaaacttagttgattattttaagtatatagtacatacaaataatatataattcaaaagctataatatatttttcctatccctatttcctggttcctctctaagctaaggcatttagactaatcctagtggcttagtattgtttaaataattttttatttgaaaattgattccatattggacatatttacaatatttccttgaataataatagcttaccacatagtaatacattacatatttagttctctcagtagccttctgagttaaattctgttatccatttgaaaaatgcaggaactcaaggttagagaggttaaataattggctaaaattcacctggctgataagtgacagatttgggctggaactcaggtcctctaataccagagcctatattcatagcccatactgtaggattatagaaataaggttattcccagttgtgccttttatacttgaaaagaacaaaagattccactgaatgcttattttacaattaataaattaagttaggctttatcataccctaatgagatatcttattatttgtttaaaataaatgatctaccattatgttcataaataaaaataaagatattgttttattatagatgttaatgttttaaaacttagatcatctaaacatgaaaaatctctggcctagtcaaaggcacactgagaactaaacttgggattggaaaatttggagttttcaaatggccctaccaattcagcgcataattgtatatgcttatcatttttccaaagagggttgaatagtattcttccattgtatatcttagggaggcattataaaggtaatatgacatcagatgttaaacttacttatttaaccagcattcattgaggctgcctactatacgtatcctgtgaagcaatgtgaccaatacaaagatgaagaaaacatgggtgctgtctttagtgaactacccatcttctaggaagaataagatctattgtaatataaacaagagtgatgagtccttagtatatgtgaaggtctcctcagctaagttccaaaaagtaacaagctaactgtaatttcaccaccttagtattttatgaacaccaccttagtttttatgaactcaggaccttacctccactttatgaaaacacatatacacaaagcaaggagttttaataagcacttgaaaagatgctaatcttagccatcagacagtggcataaccatgtgagctttatcttaacacccactaggatgtctataatcaagaagacataataccaagtgttgacaaggatgtggagaacttggaaccctcatgcaccactggtggaaatattggcagttcctcaaaaggctaaacacagagttaccatatgacccagcaattccacttttagatatataccaaagaaaaatgaaaacctgtgtttacacaaaaatgtgtatatgaatgtttatggcagcattaattataatagtcaaaaggtagaaatgactgaaatgttcatcaactgctgaatggataaataaaattagattgttattttacatgagacacaaaaatgaactcaaaacagattaaagatttaaacataaaacctgagaccttaaaactcagaagaaaacatattagaaaagctccgtgacactggtcttgcaatgactttttatgtatgacactaaaagcacaggcagcaaaagcaaaattaaacaaaattgtatctatatcaaaccaaaaagtttctgcacagcaaaggagacaacaaaagaaaaggcaactcacagaatgggagaaaatatttgtaaaccccatatatgataaaaggttaattatccaaaatatgtaaggaactcatacaactcaatagcagaaaacccgattaaaaaatgagcccaggacctgaatagacattttccatagaagacatacaaatgacccaggtatatgaaaacatgtgcagtgtccctaatcatcaaagaaatacaaatcaaaagaccacagtgaagctgggttcagtggtggtggtgcgtacctatagtgccagctacttaggagactgagataggaggatcagttgagcccaggggttcaaggccagcctaggcaacataggaagaccctatctctttaaaaaaagaaaaaaaaaattactcccccacccccactttcctctccctcacaatgagatactaccttaaatttgtgactgttatcaaaaagtcaaaatcatgtggaaaaaagggatcccttgttagcgggaatgtaaattggcacagagattatgaaaaacaatacgaaagttcctttaaaaacagaactactatataatccaacaatctcatttttggatataaatctaaaggagatcggccgggcatggtggctcatgcccgtaatcccagcactgtggaaggccgaagtgggcggatcacttgaggacaggagttggagactggcctggccaacatgatgaaaccccatctgtactaaaaatataaaaattagctgggcgtggtagcacatgcctgtaatcccagctacttgggaagctgcggcaggagaatcgctcaaacccaggaggtggaggttgcagcgagctgagaacatgccactgcactccagcctgggcgacagagtgagactctatctctaaagaaataaataaataattaaataaacggaaatgaaatcagtatgttgaagagatatttgtactcccgtgttcagctgcattattcacaatagtcaaaatagggaaataccctaggagtctgtcaacagatgaatggataaagaaagtatatgtatatataaacagtggagtactgttcaaccttaaaaaagaaggaaatcctgccatttgcaacaacataggtgaacctgcaggacattatgctaagtgaaataggccagacacaaaaatatagatactgtgtgatctcatttatatatgaaatcttaaaaagtcaacctcatagaaacagggtagaaagtgtggttgggggagggaagaagggtagtggaatgatggggagattttggtcgtggggtgtaaacttttagttataggatgaatacgttctggagacctaatgtaaaacatggtaactatagtttataattatgtattgtatacttgaaatttgttaagaaagtagctcttaagtcttctaccacacacaaaaaaagataaatttgtaagttcatggatatgttaattggcttgatagtggtgtcatttcacaacatacacatatatcaaaacatcatattttatactgtgaataaatgtaatttttgtcagttataactcaagaaaattgaaagaaaaatgtattatatccacacagtgaaatattatttagtaataagcaggatgaagtactttcatccatgctgcaacatagataaacctttaaaacattgtgctaagtgaaagaagccatttataaaaggctgtctattgtatgatctcattcatgaaaagtcttaaataggtaaatcaataaagacagaaggtatattggtggttgtcttaggctgaaagtgttgtgggacaatgctacactcctaatagatacaggatttctttgggagttagacaactaatctaaaattgactgtggtgatggttacacatctccgtcaatatactaaaaatcacgaattgtatgctttaaatgcaatttatatgtgaattagatctcaataaagcttttattttaaaaaatagatggtattaacaaaacttttagactactgtgaccacttggcacacctaacaacaaagcatccaaggagattaatatttaaacgtacattataatatgaaaggcatgaatttagatgggggcatgtaacctcttgaagaaatatataatgtaaaagtgttattattgctattttatttcttattttaatcaaacactgtgatagtattattcattccactgtaacccctattggataaatacattatagtatttagaataaaactcatgtgttagtaagccagtgagaaagaatcataccagagctttatagatcaccagttctatctcctgtccctccatttcaggtatatgcaactggcctacctgttcagagtattaactctatggtgcttcatcagtcagaccatccactatgcccaaatgagtaatatgtccaaactgtatttgcaaaatgcatttcttcacagaaattaatatcctgtgcaaatgctggctaattgattattactctttcataaaggcttaattaggtaggaaacccagtacctgcagcgagagaggaagaaaagtctttcctagggctagatcctgacccaaggttttggattttaatggggcagagttgtctgttttctattaaacacatacttgggagtaagtagacttgcccatctcctgttttatactgatcttttcacgaatgtgaacctttttcttgaaagagtaaatatctttaaatttttctgtagccttccctgttacaagttaaatgttcctacttctctagagtatttcgaagtgtttatttaaataagtaaacatggatagacactattttgtagcaaggggttgggggagtatactctaaggcagcttctctctgacagcttatctttcttataagtatagtgtaaacatataatttataatgtgggaaaagagggtttgatcttttaataaagccatttctttttatttcagagttaaggagtttaaattctttttctttagcatctagcagtgagttcaggggtgatggtcattaatatcttgatccattacttttcctaaaagataagattttttttcccataatggttcatttgtctgactgctttatttcccaccagaaatcacaaaatccatttttcctgtgacagtataataattttcacaacatctgattttagtggcacatacatgcagaagattaaaggtgtaggttagaaaagaagcagtaagaaggcattgagaataaaaacatggtagaatttatttctttaatgtcataataactaatttagaaaaacaaatataaacaatgggttgtaaatagtttattcaatattttaataaagaattaattcattacatgcacacttatttttacatacttgcccagatttcttaccaaaaaaaattttctcgccctattctcaaacaaaatttatagacattatatacagcctctgttgaaaagaccttctgttaaaatcagctgcccttagcttgacatatcttgagttcttagtgattaacatgttaataacaagtgtgaatgtcattaatgttcctataattaatttcagtattaacaccttatgtttcttattattcattcctcaaatgaaggatttttccatttataactaagtggcaattattatatcatttttatataatggagcaataaattgtatctgatgttattaatagtaattcctacattccttataacatacttttatactcattcctttatatattcctttactgttatataatactttttaagtgcctttaagtgaagagaagtggttgaaatgtaaaagaagctacttggaatgtctgtaataacaaatgtgttagtatatttacacctgcttgaaggaaagagtaaagtatttcctgaaaaccccacaattatataggtagttcaacctctgatctgcactgaggcatttaacctctcttaaccttggcttccttatttaaaggaagtggctgttgagccttacctaaatcataaagtgagtgcaagtaattgtttactgagaaatctaagaaaggctaatggaaaacatcaagtatgaatgaaacagttataactgttttcccctttgaaaagaattgctgttccacattgaatttctgtcatgaatctaactctttttaaatgagctatttaaatttaaatacataaatggatgttatattttgattttaattacttcagtagtaattcagaattaattgaagctacagcttaaacatattttattacatttaaatagttgggaaaaaataaacagttggttagctaaaacccaataaataaattgggaatagattctgctagttgaatgctgaaatgaatagtatatactttaaagggctttaattttttctttcatactgatttaagactgataatttatctctttacttattctaattatttgaccctttttgttggaggagagggggcaatcttgtcactaattgtgtaacccttgtttaatttactctttcaggaacccttccaaccttccccctctccaccttaatacactgatgttcattttggatttccaagagggagatatgatatgcaactttaaaaaacctattttccagtcaagccatttttcaaagagagcttattaacctctcctatggatcaaattgtgaaatactaaactaggttgcctgtggaagtatagtgagagacgacgataggaaagaagataggatggggtcagaagaaccttacattccatgcttaggagtataaactgtatacgataagcagctgggaaccataaaatccttttaagaagtattgtgatataagactaatttgaaagaatagtgagaaggtggataattgtacatttgattttattcctttatgctaataattcccatgtacatacagtgaatgaaatataggagacaaacatcttcaactattctcatttcttattggttttagagcttggaaatatgttaaaaagacatgtaaactagttccatcaattgtatttcctcctatttagatagtacagtgattttgagcaaactgttaacattgattttaaaatccaaaatatattattagtctataaatcactgcatggttctcattcattgattttcacttaggaggctttggggggttgttttgtttttataatgctttacccaaagcattttaaatcttctactctccagtaatagtttttgtcaaatatattttgatatctgctgtactatttgctatatttacttaaacatctctccactacgtagagcaggtactataggaggaaaaacttttcctctaccctcttatgttcagtagttggtgcttgcaaattaaactgacaaaaaattaggaggataaaaggattattttgtatgcacgtgagaagcctcacagaaaagaattgaaaaccccaaaaaaccaatgagaccaaggggcttacatatcattttaagaaagagtgataaagtatggagaagagactagacaaaatgggggtttagacttctggtggggtgagggtgggcattaatgataggtgactaaggaatgagtggtaaataagggttgtttagtaaggtttattaggcagagtcaagtgagaagagtctgcttcttctcttcctggtactggagaggaggacgccattacaaatatgaatttcctttacaaaagggaaatttatgccctatttttaggaagtaaaggggagggcagagagctcctcctatgtttgctgttttaattgcctgtagttcaaaataatccttatgctgaagtggcatatttgagggtgtcatactctgatccccttcactatagactactctctaataccagggtactgagttaagataattctgaaggcttcgctaataatctactactctttgtcaatttcctatcttagttttctcatctgtaaaatggagatcatgatagcacttacctcaaaaaatgataagaagtcaattaaaaaagcaccaaaaaatgcttaataaagtggtctgacacatagtaaattctcaatgaataatgtatatactgttaaggagtcatttccctctaagagtacaaagtacaaaagaaaaagttggagcttaagatttaggtttggctgggtgtggtgtatcacgcctgtaatcccagcattttgggaggctgaggggggtggatcacctgaggtcaggagttcgagaccagtctggccaatgtggtgaaaccgcatctctactaaaaatacaaaaaatggcagacgtggtgatgcatgcctgtaatctcagctatttggaaggttgaggcaggagaattgcttgaaccctggaggcagaggctgcagtgagtcgagatcacgccactgcactccagcctaggcaacagagtgagactctgtctcaaaaaaataaataagagttaggtttaatcccagctacttgggagggtgaagtgggagggtctcttgagcccaggagttcaagtccagccggggcaacctagtgaacacttccctccactccatctcttaaaaaggatgggagtgttcccagtgctgattatgccacctattagccgtatgaccttggacaactgtaagcctcaactttcccatctatgcaataagaatcatttttacctcattagattgttatgaggattaaatgaagcagcatgtatatatgtgtatatatatacgcatatatacatatagtatcttgtatataataagtatttattacatgcaatttcatcttttatgtagactttctagactctaaccttgccccaggaagataagtgacttttacattaagccatgttctctttttcctttatgacactcctcaatgcttaatgaagaactctggctacacaaaaaactaaagtaaaatgttgacagactgcttttttctacatctgggcttctttaattgaaagctgacatttaggccaagaattgttaggaattcctatttaggtttataccagttctcgcttatatacaagatgtatacttgtgtatacatgttatttacacacatacaataatatatactggctttctttttttccctctcatcccataacagatagtatactgccttttttaaaaaaaaaaatgcccacttttcaaattaaaaagcagaggcacacattctttccaaatgtattagtataatttgaaataatgagattgtattaataggattcagccacagaaacagacccattagggaagatagagtgagaataagatttatttgttggttgatcgattttgaggaattggcctatgtcattgtggagactggctaagtagtccaaaaccatagggcaggcaaccaggaaggggagaaagccttgaacttcttaggcatgggcagaagctgtcattcataggtggaatttattctctctgtcaaggaaacttaagccatgcttttctttttaaattttattattattatactttaagttttagggtacatgtgcacaacgtgcaggcttttactttcaactgattgaatcaggcccctccagattatccaggatactccagtaatagaagtcaactgactgggagttttaattacatctgaaaaatacctgtatagcaacacctagattggaatttgattgaataactagagtctgtagcctagtcaagttgtcacctcaaaaaaaccatcttgggataaagttttttgaaaaaagaaatagaaagttcagggcattttggtcattatttttgtgtattgtgcctattatatctttttattttaaatttttgagaatctgtttagtgcctagtattttgccaagattataaaggaaacaaaggtatcttaatgtttttttcaaatcttaacatcttaaagttgtttcaagcattttccctgaattcattgattaagtattgttagaagaagtggaacatggatgatgcatatgctttagattgaggcaggagtatgtgtggtgactaagagagtaagaaatgatgatctcgagaatactagactgtgagctttctaaaagctggtatcgtgtgttatttatccttgtattgccatggcctggcacagtaattgaaaaagttcaacaatggtttgttgtttaggttgattaaggaatgagcaaaaacgtaacttaaaagctatctgtattgaagtgtgatctgttatatgtattcagatctgattatacttggagtcgaaatcactgtatctaaattaatattaagactcagggccaggcacattgtctcacatctgtaatcccagcacttcaggaggctgaggtgggaggtcagttgaggccaggagtttgagaccagcctgggcaacatagcgaaaaactctgtctccacaaaaaattaaaaaaataaaaattagccggacatggtggcatgtgcctgtagtcctagctacttgggaagctcaggtggaggatcacttgaatctagaggtggaagctgcagtgatctgtgatcgtatctctgcacttcagcctgtgtgacagagtgagactttttctcaaataaaagaatcaatacagcaatacagccccaatttctaaattggagaaagtcattttctatttcgtctctctctgttcctccactagattgtaaactctttgagagtaagaattatgcagttttgtctgctcttcaatgttttattgccttgcattaaaaagataataaatactgcttgatgaattaattaaaaacagcatacagaagagatccaaatttaattttgtaataaatcacctctgagaataataagaaaaccagaatatttgaaatacatcatttaattgaataaggaacagtaaactgatttttaatgttcctgtttttatgtatttgaagttaatgtttagttattttgttttaaaatctttataaaaattctctgctttatcttccagtgaacaagacatattaatagcttttctgtagagcaaggcatattaatagcttttctgttgaatatgaaagaaagcagctgtagttttatcctactgagtacaaatatttgttggggaattaaagatttattagataaatggcttaaagattaattaattaactatactatctttttactttcctatcttatctgtaggccattggtctgttaatatatataaattgctctgtttcctgctatctttccatttcttaattaaatattagaaaaatgcccaaggaaaaacaatacaactgagcttcctttctggttttcatgcttttaaaatttataaaaattgtggctctgctgcctttttttttttttttttttttttttgtagttagatgaatttggcctgagattctatgaaaaaaataaaacaatagtttttatttcatgatttttttttcaagttgttctgattttataatatctagtcaagtgatgacatgcagagattttgctgtgaggagagggagagagcaaaaagtattctgccctgattgctttttagtgattttattactagaaagataaacattgccttgttattttagccagtaaaattgtctgcaaagtaggtaacaaaatgcaaagcagtgtatttacttttccactttttcccaaaggtatgataaaagcagggttccagtggaacaatttgctgagttctttcctagggagcactggtagcccgtattaaatgattatattttggaaaatgctaatgatgaaagatgagaataatttatattctttgaaatgtgactaaaaagttggaaatgaaacctatctttctgaagtgacatccacatttgtggttcattttcatcacacctgattcacttctgccagcaattcagaaagaaaggtggaggtgggaaagcatatatgtagctaagctactaaagtgactatttgagtatttcattccatctgtcaaaagattcagtgggataaagaatttggcataaatggatgtaattcattctctttttacaaagaagtaaatgatagaacaaaatcatcctaaaatgaaggaacaaaataccagaaagtgaaagaaaacaaaatttgtattttttgatagaatagtagcagaactcaatgtaaaaataatgattacattaataattatttgctcactttttcctgtatttggtattttgggaaagtgggcttgaaaaacagtggatacattgatgaaacatttcaattttcacttgcctgttgtgtttgctcatgttagacaaactataacttctcggtgtatagatatgatgtacacaaaattacacagaaattaagccatgtataataatgcatgactagaagaaagatatatctcccttgaacaaataacagttattttagtaaatttgtaacagagaaaataggcttgattaacaaaaatatgaaagatcttttaaataaatgaattttgaattttcagagtagcccagaattttatctaaactcggattatttcattagctagaacatgaaaataggcatttattctactcacctacagcttctgtagtactaaatttatggaatgaggctttgtggtgctgccttcagagctcaatgatttgctttttctgaattttggaagtctgtctctaattgattgacacatatgaatgtagtgggaagaaatgagattaagcatacaagctttctttttcatttaaacatcattgaagccatgaatttgtaaattgatataaaaacacaatcctttggatctgtattaggaaatttataaatgggagctttattttgctccagaaatgtgataattagaaatatattcaggtgattttttccctttggtttttgttgttttttaatttatttttctttcttatttttaccaaaggttcaagtcatctgtaatattcaggtgtttttaagaatttctcatggcaagttaattgtgggtgaacatttccctattggactaccagatgtactttgtggttataacttgcatagctccaggatttttcgtgaacaagtaataaaacacatttctggtttgctttctgccatagagtattaagagtttaacactttttaaatgttactttaatctctgaaattttcaacaatgattagtggcagtatactcaaaaaaggaaatgtgtaggctttactataataaaaataagaacaacttatataagctccacactttatagatttgtatggatatacaatcaaatgtactaatttttaaattatcctcattttgcagtaattttacattttgctcatttgtgcaaaccgtggtgatagtaaaatatttaacagaaattcaagcacattcttttaactctttctgaaaaatctcacaaatgagatttttttaaaacagttaagaatttactaaatttaaaatgtatatatacctgatgccatccagatgttttattgaatttctaaaataaaagtccacctaatgaatggctaatttactcaacacgtaagacaaagatgtatttctgtgttactaagaacatgcatcctatctccttgacaatggctctaattacctcagcttggactgatcaatatttgatctttttcccaccatgcaaacatgttactttgactttgtctcttcctcttcttttcagataatttgcagccatgtgagaatggttcattttgtttgttctccctggcttgaggccaggggtctcttattagtataatgcagttcattgatgtgaatttgttgatctcctgggtaggttttcacaaatttaaggcaattaaaagcttttatatggcatttcacttgaagttattagtggcctttcagtgattttgcttttaaaaattacttcatcattttatgattatttcctttccttctcttttctctactctccccatgctataaaattctatagtaaaggattgaaacaactatttcattgatttcattaaaagtaataatttataaacttataattcaatagcttaatattttaattaccacaatttttaaaggactaatgaaatttttggttttgtgttttcaaaagctgctttgttttaagcatataaatattcatgatagaagccataatttggagaataataagaattgaatctaaaaattattagtaattgctaaaaaattcaaaaagcacatagtgtaaactttgtgtatatgagacagaactttttctaaattgcagtttcattaacatcttaaagttttctcgtagctaacagatgtccatgatatttttgcttccttaacttttacagtcaatggaccattctccagcaggtcataagtaagaatgttaaataacggccactaaatcttaaggaatgtgacaacattgattagattaaaatcctttgacttcattgacatatcttttttctttccccatttaaaaaattgtttcagttgttttcctactgtttgttggtggcatactttgttacagtacttgatccagtttgtttcattggtgtgcttggtaaatttgaagaaatgatcactggagaggatttgaaataactagcaaaagttttgaagtattgcagtgagtatatggaatgtgttactcatttatgcaaaaaatattggtgtttttatactttttattttaaaaaatatataacaataatagcaaatatttagtaagaatgtaactttatgccatactaaggcaagaatagtatattgaataagaggatataccctgaaggcagggtataaatccaagttgcgctgcttactagttcacttcttaagcagttaacttctgaatctctctttatgtgcaaaatggtataggagaggaaaaaaaatatctttccctcctgatatgtacatgactggggcctctataacaaaaacagattaacaagagaaaagtatactataatttaagtgtaagttttacatgacatgggagccttcataaggaaatgaagacccaaagaaacagctaaatctgagtgttttttatattaggttcaatggtgaaatgatagggtatgaagtaaatgtagtaaactgggtgaaacttggcaaggcctttttgtttggattcccctctgtctctttgtctttggagaaaagatgctcctttatagagagggtaccattcacataagggtcttgtgacctacttaagggaaaggtcaaaaaacagttaccaggttttatgatctgtttctagagaaaagggcaggggacagtcagagagaccttcctgcttctgccattttctcacattccttcaccttaaaattttcaatatatcaaggtgctatattttggggtagtatatcctgaaccgtgcctataggaatgatgataataatatctactttataaggataaaatgagacaatatgtataaattgtatggaacagtgcatgaaccacaataaacactcacaaaatgtttgctataaagatattttcgaccttccatggtggttcatgcctataatcccaacactttacgaggctgaggtgggaggatcacttggagccaggagttcaagaccagcttgggcaacatagcaagaccccatctcttaaaaaaaataaaaaataaaaattacccatgcctatagtcctaattacttgggaggccaaggcaggaggatcacaattgatcctcaggaagatcatgcttgtctgtaaaggattttatatccccttgacttatgaagcttagtttggctggatatgaaattctgggttgaaaattcttttctttttttttgagacagagtctcactccgtcaccaggctgaagtgcagtggcatgatctcggctcagtgcaacctctgcttccctggttcaagcaattctcctgcctcagctgccctagtagctgggactacaggtgtgcgccaccacgcccagctaatttttgtatttttattagagacagggtttcaccatgttggccaggatggtcttgatctcttgacctcgtgatcctcccgccctcggcctcccaaagtgctaggattacaggcgtgaaaattcttttctttaagaatattgaatattggctcccactctcttctggcttatagggtttctgcagagagatctgctgttagtcccatgggcttcactttgtgggtaacccaacctttctctttggctgcgcttaacattttttccttcatttcaacctttgtgaatctgacgattacattgtgtctgggggttgttcttctcgatatgtatgcacccaatacaggagcacccagattcataaagcaagttcttagagacctacaaagagtcttagcctcccacacaataatagtgggagactttaacaccccactgttaatattagacagatcaacgagacagaaaattaacaaggatattcaggacttgaactcagctctggaccaagcagatctaatagacatctacagaactctccaccccaaatcaacagaatatacattcttctccgcaccacatcgcccttactctaaaattgaccacataattggaagtaaaacactcctcagcacaagcaaaataatagaaatcataaaaaacactttctcagaccacagtgcgatcaaattagaactcaggattaagaaagtcactcaaggctgggcgcggtggttcacgcctgtaatcccagcactttgagaggccgaggcgggcggatcacaaggtcaggagatcgagaccatcctggctaacatggtgaaactctactaaaaatagaaaaattagccgggcgtgatggcgggtgcctgtagtcccagctactcgggaggctgaggcaggagaatggcgtgaacccgggaggcggagcttgcagtgagccgagatcgcgccactgcactccagcttgggcgacagagcgagactccatctcaaaaaaaaaaaaaaaaaaaaaaaacctcactgaaaaccacccaaccactgctcctgaatgaatattaggtaaataatgaaattaagacagaaataaagcagttctttggaaccattgagaacaaagacacaatataccagaatctcttggacacagctaaagcagtgtttagaaggaaatttatagcactaaatgccctcaggagaaaactggaaagatctaaaatggacacactaacatcacgatgaaaagatctagagaagcaagagcaaacaaattcaaaagctagcagaagacaagaaataactaagatcagagcagaagtgaaggagatagagacacgaaaaacccttccaaaaatcagtgaatccaggagctggttttttgaaaagattaacaaaatagatagactgctagacagactacttaagaagaaaagagaaaagaatcaaatagacacaataaaaaatgataaaggggatatcactactgatcccacagaagtacaaactaccatcagagaatactatagacacctctacgcaaataaactagaaaatctagaagaaatggatacattgctggtcagataccccctcccaagactaaaccaggaggaagtgaatccctgaatagaccaataacaagttctgaaattgaggcagtaattaatagcctaccaaccaaaaaaagcccaggaccagatggattcacaactgaattctatcagaggtacaaagaggagctgttggtgggagtgtaaattagttcaatcattgtggaagacagtgtggcgattcctcaaggaactagaaccagaaataccatttggcccagcaatcccattactgggtatatacccaaaggattataaatcatggtgctatgaagacacatgcacacatgtttattacagcactgttcacaatagcaaagacttggaaccaacccaaatgcccatcagtgatagacgggataaagaaaatgtggcacataaccaccatggaatactatgcagccataaaaaaggatgagttcatgtcctttgcagggacatggataaatctggaaaccatcattctcagtaaactaacacaagaacagaaaaccaaacactgcatgttctcactcataagtgggggttgaacaatgagaacacatgaacacagggaggggagcatcacatactggggcctgtcagggggtaggggactaggtgagagatagcattaggagaaatacctaatgtagatgacgggttgatgggtacagcaaaccaccatggcatgtgtatacctatgtaacaaacctgcgtgttctgcacatgtatcccagaacttaaagtacaattaaaaaataataataaaattttaaaaagaaaaagattgggtatttcacatcttcttgaatgtaaaactgggggaaaataatcttttttaatgtgcattaaaactttttttttttttttttttttttttttggggggagaaggtctcactctgttgccctggctggagtgcagcggtatgatcaccgctcactgtggcctcagcctcacaggcccaagtgatcctctcacttcaggctccaagtatctggactcaaaggcgtgcaccaccactcccaggttttgtttttttttttttttttttgcagagacagggggttttctatgttactcaggctgttttctaactcccagcctcaagcaatcctcttgcctcaggttgccaacgtgttgggattacaggcatgagccactgtgcctgacccagtgaaacattttagtgcagaatagttgtgaatttttgaaatagataaccaagaaaatttaacttcagatatcacctagttgtaagttatctctccgttttgtcattcaggaatgggttttctgagactttctaaagaaatatatattatcgttcagtttggctttggaaattttattattgccctatatttctagtaaagtaatgtagatctagtttgatacaaaccattctatacactacaccggtactatcagctttcacttttcacagctcccaaaacaaataaataaaagaaaatagctttcttttctatgccgtttctttctgaaatagtactaatctgccttacctttaatactatcccatagacccacctagtagctcttcccttacgagagagttcttttgatcagataaggtttaatatggaaaataaaaagaaataatcatttaaaacttgaccaaaatattttaaaaacatacacatatatactctaccttaacatatggtgaaaagcaatttttcctaaaatatattctatgaaaaaaaaattttggccaggcacggtgacttatgcctataatcccagcactttggaggctgaggcgggtggatcacctgatgtcaggagcttgagaccagcctggccaacatggcaaaaccccgtctctactaaaaatacaaaaaattagctgggcacggtggtgggtgcctgtaatcctagctacttgggaggctgaggcagggagaatcgcttgaacccaggaggcagaggttgcagtgagctgagatcacaccattgcactccagcctgggcaacagaacgagacctcatctcaaaaaaaaaaaaaatttatttccaatcagttggaaaatgtaagaatatgcaaaaatttaacagatttctttaatgtgggtttttcctagaacacctttttacatttcagaggacattagagttcagcaggacacagtttggtaaatattagtataaaaagttaggctcagccgggtgcggtggctcatgtctgtaatcccagcactttgggaggctgaggtgggcagatcacgaggtcaagagatcgagaccatcctggccaacatggtgaaacctcgtctctactaaaaatacaaaaattacctgggcgtggtagcacacgcctgtagtcccacctgctcgggaggctgaggcaggaaaatcgcttgaaccagggaggcagagattgcagtaagcctagatggtgccactgcactccagcctggcaatagagcaagactccatctcaaaaaaaaaaaaaaagaaaaaaaagaaaggagaaaaaagaaaaaaatcaggctctctgtagtcaaaagtcaaacatttttactgctaaaataaggcattattttttttccttgcttaattgccatgccaacttttattggttctttcctgtctcccaatgagttaaaaaagaaaaaagtatccaaatgtgttcccaccccaacccaagcctgtgatcacttctttgtttttttgcttccctgtaagggtatttctccctataattatactcacactttaagaagtaggagccattatactttattttcaaatttcaaattagaaagtgatttgggtttggaagcttgtttctgtctctggctatccaactgtttctcggctccaagatgtgaaactgtttcttcaccctaacggcaaaagggcacctgctattgagcgtgctttgagcgttattctcccaatagtaccctagataggtaagacatttttgaaatcaaaaataaacaaaaacttcttgttgtgatttctctgtataccaaaacatcctcttgacataaactgtgttatcctaatgacacagacaaacacaaattatcttcatttgggttgcagagttgggggtcatttcttgtgcttatgagcctgctattctgcaactgtgagatttcagacatgttcaatttgtggattttattttttattacacacacatgtgtagtattattgcttgtaataccttgtatgaatataaaaagattgtcatttttcaggtgtatattaacttcattaattttttacaattcaaatgatggagagattcctattgaaggatacttagctttttctaataattcagttatgattttatattcaatgtaaatgattttgtctctctggggccagattatcctatttaccttgaccccctaccatgacaatttaaatactgcatttaactgtagtatatgtaagattgtccttaacaaatatgagacttgaaaggttgtttttgtttgtgtcctctcctctgaagttttccttttaggatgacagcatacgatagatgtgttctagtaaagtgcttcttttattcatgaattacaaatagcttaagaaaatgtttaaagtaaagctataatgattagtcctggtagtctccattttattcagaatgtctctgtcagaaattatgtcatcactatggactgttagccaggaagttctgtctagcagatgaatgaatagggagtactgagttttctaataaaagacactgttgtaatattgaaatactgctaatggaggttgccagttttctgttcttaaatttacaggacatcttctgtgattaaagtaaggaatacttagagcaagtccttagagtaaaccaactataaacttaagaaaccggaaatagaattttttttttttaaacaatgccatttaagtccctaacttgtcttggttcagctgctagacatttgttcctttgtctcaaaaacgttagcagaaagcaataaatatagttcttgctttactcagctaacatctgattttatctgcacattgcttccatcttaaaactttcttaccttactagtctgaatggcttgtgtagcctaatactgttataattgtcagaacaaagggtttgattattttggcaaggaaaaaagcctggtaatagtatttgcatttcaattaattgtttcattctgatttgaaatgtgacttatgttagatacatctctgatccttccctatctcagtactaatactaatatgttgtatttccactacaatagcattacatcttacaaacatttatttcctttataactgacgtagagctttccacatagtagatatttaatataattgatggtttggaattcatacattttgtaggctaagtataactctcctactgtttcacctacttcctaagctagatttatctttacaggtactagactttatagaactaatggtaaattcagtatgcatatcttctgtagtaaacatagaaaaacatttttgtaatagtgctccccaaattttagtttcttgactagtaatgaaatatcttatctgtactagagttttgttatacaataatgacagcattttcatgtgctatgttatggccagttaactaaaaataagtggatatttaaaatggaaaatgaaattatcctgttgcctgaaatatcttgactcaggttctattacaggttgcatatggtatctgttagagctttgaatctatgttggttgttgagttattatgtgcattaactattgcattcaaaagttctttaaaagcatatgtctgttttaaatcttatacaaattccttgcaggttttgagagcagtctttttgtatgtctttcttgtttgttgttttgtttttataccagagcaccatgtcctaagcagcagtaaatttaaaacattgcttaggatagttttataatatcattaatagatttttatattagatagtttctctgaattattgacctattatagggaacatggaaaaatttagaaaaattagaagttatacggagtattaagaaaaaaactttatattttggtactcccaggaaaactaaaacctctttctaagagtatattttaggaaattttctaaaattttgtaaatcaacctacagagaaaaaaagtatagaaagtattttgaaatatttgtgtgtatatgtgtgtgtgtgtacacaagccacattttctcctagaactcactactgaaatttctgaaagtgattcaataagatatatatttcatatctggtttttaaaatccatagaatttttgtgttttgaccatcaggtagagtcttacagtttagtcacagtggaatcatcagcttcaaaatgaaagaacaagatagtctcttggcattcaaaaatttagcatactttaactcatatttgctgtgatgttaggtagtgaattattcttgttaactatctagcgtccaatgtgacatgtgtttgttgttacctacaacttatcaaataaacagttaccctctggaatgataagaacttgggctttttatgaaaaataccctctaaatgaggacagaaatctatattaaggataggctattgattaaatttagagatacacataaagatgactctcatataaaatttagaataaacatgaaagttttagcatgtccagactttagggatttaggctttatgaaggtctcaagcctgtctcctggaattccaacattgtgatgactcaaattttatcagtaaatatggaaaaataagctaaagttcttgagaaattgctatctaataagtgattattttattttttttctagttttaaaataaaaaatctttactatttattagattcaccagtgttttatactgggggtccccaacctttttggcaccaaggactgtttcgtggaagatcattttccacagggcagggtgggggaggggtggtttcaggattattcaagtgcattgcatttgtcgtgcactttatttctgttattattacagtataatatataatgaaataattatacaactcaccataatgtagaatcagtgggagctctgaacttgttttcctgcaactagacagtcccatctgggggtgatgggagtcagtgacagatcatcaggcactagattctcataaggagcacataagctagatccctcacatgcacaattcacaatagggttcgcactctaatgagaatctaatgccgccagttatctgacaggaggtggaggtcagacagtaatttgagcaatgaggagtggctgtaaatacagatgaagcttcacttgcacatctggcactcacctcctgctgtgtggcccagttcctaacaggccatggatttgtatccgtccatgtctgaggggttggggacccttgttttatacaattctaattgtgtcattgaatttcttttttcttttttctcattgttaggaggctaaaaacaaacttgtcttgtgcagattcgtcgtctttaccaccaaatttttgtcatggtatcttgtcttttttttacgtctttctaaactgccttaatccttgtaagggaataggtaaggtgtaaatataattaataaggtgcaaggaaatgttattagaaagaaattagattgttatttgaaaacatacagagcctaaatgtaagagaaatgtcctaagcaaaacttattaacaggaaatttactgaattggaaagtactcttgattttatgactaatatgaattgaggtattcttatagacactcagagattcctgtacacatgttacttgtgtttttccaaaactatatacgtatagtctttttacaaataaacagtggccaccaagaaaaattacagcagtacacataagacataccgtatacatgatactcaactttgtctatatcctttgtgttcaagtttctagaaattttcatctttgtaaggatatcatgtgagtgtgctcaaggtttgttctaagaatctagctgagcacagtggctcatgcctgtaatcacaataccttgagagtctgaggcaaaaggaacatttgagcccaggagttcaagaccagcctgggcaacatagggagacccccatctctattaatttaaaaaaaaaaattacctggacatggtggcatgcatctttggtcccagctacttgggaggctgaagcaagaggatcaagaggatcacttgagcctggaaggtcgaggttgcagggagccacagtcatgactctgcactccagccttggtgatacagcgagaccatgtctttaaaaaaataaaataagaatctatacacaattcatggaatgatgttgttttatagttttactgtatatttgtttctgtcataacttccaatatcccaaaaactttttaattatttttattcaagacatacatacagaagcaggccaggcacagtggctgatgcctgtaatcccaacatttttggaagccacgatgggtgggttacttgagctcaacagtttgatgctacagtgagctatgatcatgccactgcactgcagcctgggcaactatttaagaaaaaaagagagagagagagaagcagaaattcaaaggacactttttgaaatgcacttaatgtaaaggctgctttgcatggttaatttattcctattaaaggaatactacattcctgccacttttctaggtggtgaatttatagcagcgaccaggtaaatattgctgtcctcagggtgcttacctttcagtgggtaatgctttaaacaaaatatctagtatattagatggtaataagaaccttggagaaaaataaaacagaaaagagtgttcaggtctagcatgaaaggttacactttcaaatctgatcattagggaaagtctcacccaagacagtgatgtttaaaaatatttcaagaagcaagttgtgcacatattagggagaaaaacaatcagtgaataaatagcaagtataaagtctctatgccaggagcatagcatgtttaaggaatagccaggagattaatatggctagagtaaaatgagcaatgggaaaagtaagtaggagatataattacactgggaaagagtctaggggcatattaaataagactttataggtcattataaagactttgttgtttttgttttgttttgactctgaatgagatcaaaagcctttagagggttttgtgcagacgagaaacataacatgacttatattttagtagggttattctcactgttatatggacaaaactgaatggggcaaagatagaaatagggagatcactttggaggtcattgcaataatccagtgggagatatgatgacttggactagagaattagcaatggaggtgttaagatacaatcaggctctggatatagtgtgtaggtagatttaatagaaattgctgttgaattgaagaatagtttacgagagaaatgagtcaagggtggaagcttcattaactaagagagggtaaatggggataatttggtctagttttgtataaattatggggaaagtcttggtctcatagtttagcattccatagtacgttctccatagtgtataagtgataggttttactaatttaataatttttttgtctcaaacttgtgacttagactttgataaacttctgtttatgatagatggatttttaattgattttattgtttgtattttataatggattttaaggcatattagtgaaaacacaacttaaaatttattttcttaccttactaacattccaaaaaaggaacatatactgtataatgtttttttgtctcactaatatattcgtatccctcttcccccttcttggcaaacttgtctgaaagtatactgttgcatgttatgtcatggatgtaccggagcatgtgtgtaaaatacatgtcataaatggaagcagctggtttcctatgcagttaagagaagaaatgcatacagctgagctcttcaaacttcagaactcattggattcagtttctatcctgtgtaagcatgctatgatttcaaatagtacaaatgtataacaagttaccttaatagcttaaaaaattattttgtttcgatagttgaactactaaatctgttttattctctttccctctgccttcagtccctacttacctatcctacctcttgaaaagaacattacacctatagtcttagttttaaattcgaatctgaaaaggccttggcaagagttgggaaaaagttatcatctcaaagggaaaagctgaattcatacacaggaactgcaggattactctggcgttttactagtcccttgcagcactcgcaagtcccataaatacctaatggaaaaacagcagaaaatgagatctgcagcagccttttgagatcaaatttatgttgctgaacatttttttgaggttgagtgtaaaggtcaaaagaaagtgggtagattaaagttgctgatttttgcaaacttaaggccatttttaaaggtttctctttctgtagcaagaaaatttcaagataaatggctttgcttcattagctgaaatgtcatgtcttcctttaatatctgttacctgagacatttagtgatttagtggtatttatatacaacaaataaaaatctcaatccactttaacaaatctagataaatttatgaaattgcagatctttccaagaacagcatgatgataaattaatgtatatatacatgtttgtattgccatgtatatatgtatcttaaatgacatattttagatgtttttgtatgatacagaaggaaaagataataatcaaagttttgtatttttaaagtataggttattgatccagcagtgtaattataaccatctttttttaaaattatttcttatattaaactattacaatgaagataaatgacctcaaagaaaagatcgtgcatgtaatagcattaaaacaaaattcatggatgcttttaatggtctcttaccttttgaacaacattttaacacgttgttactggtgcaagcctatatctaagaaactgtgagttactagggtactgcagacttgatgcaatgaagaacaataaactgccatttctggacatctctatcctgagttgatagtacagaaagccaccacatatgttaacgtgaagttatagattatttatatctccagggcttgcttcgtgtctttgatttcgtagttcagattgcccagttattagtacttagaattcaaaagaataagataaaaaatttttacttaatacattcatttctgcatcacaataaagagttttcatggaaattatccagataatttcatagtagaataatatatgaaatgaaatcttttcttttttatggtagttgataattaatagtaaatctattcagtttatctctaagaagtcagattatgggagacttgtctctatttttctctatttaattttcccaaaaaaattcataaggaaaatattaattttcatttaaatctctatattaaacattaagtgatctttttatgccttggaatcacaatgaatataaatgttatttttattgtagttgattttgcagtttcaattcatttctattaaatattttaataaacatttttatgaaactaggtagaggtcacaaatctcattagtcactgacagccaattctcaaacccaggtcttttcctgtataccacatttcctcattagttctcactacactgtatggctatttccgcctcttaactttttatattttattacactcttaaagtacaactgtacttctcttctcaagtgcccttttctattcagtaagggtcccaggtgagcaatgattctgactggggaagagggagaagatggtgttgtagcaagtagtattaaaaggcccttaggaaggtagatagatgtataattttgtctctttcttctcactgttttcgtaaagacaaaggctatgccttaacttttttgccattcttatttttgagactacccattagggattgtttttgatgttgttgagatgaagtatttggtgaagccaaaacctccttgacttttatagttttaataagtttgtgctctccaaaccttcataaagtaatgtctagtgatcctttcagatatggcatgctgtcatgtcagctttaaataattgttaatggcatgatttttaacattttacctagttagaatcagtaaaatttattatatatactctttgctgatcagtagagcctcttatgaaggagtcagtatgatgtgctggatagagcattagatggcaaattgggcctcagatattattaggcatagttttgccactaatttgtataatgtgcaagtttaataacctttctgggcctacagttctcctcttctgaaatggaaagatgaataggttatctctaaagtctatccagatctaaagatctattttattatagaaaacttttaatcatacacacaaagatagaataaaaataaatggcattatgaatccctgtgtattcattacctgtcctcatatgttatcaatagtaaccccttagtatcttctaatacctagttcatattaaaatttcaattaaagtatctagtccatattaaaatatcatctcagtaataatagtttctagttgctttgttttgttcaaattataatctagacaaggggtgtgtgtgtatgtgcatgtgtgggtgtgtgtgtgtgagagagagagatctagttgtgtttttaagacttatggtcaaaaatacatatcataaaatttcccactttaggctgtacatggtggctcacacctgtaatcccagcactctgggagaccaaggcaggaggattgcttgagcccaggaatttgagaacagcctgagcaatgttgcaaaaccccatccctacaaaaaattatgaaaattagccgggcatgatagtgcgcacttgtagtctgagctactcgggaggctaaggtgagaaaatcacctgagcccaggagtttgatgctgcggtgaactgtgattgcaccactgcactccagcctgggtgatagagtgagcccttgtctcaaaagaaaaatattttttaaccttttaatttattttttagagatagggtctcactgtgtcacccagaactggagtgtagtagtgcatagcatagctcactgtaaccttgaactcctggggctcgagtgatcctcctacttcagcctccagagtagctaggactacaggcacacaccacctcacccagctcattttaaaaattttttgtagagctggggttttgccatgttgcccaggctgttctcaaactcctggcctcaagtgatcctcctatcttggcctcccaaaatgctgggattataggcataagccaccgtgcccagtctatcttaaccatttttaagtgtaaagtacagtaatgttaattgtatgcacattgtgtgcaatagatttcttgtacaaacaccttgcaaaacggaaactctgtagccattgaacagtaattcccctttgcccccttcatacagccccaggcaaccaccattccactctgattccgtgaatttgactattttagatatttcatgtaagtaggatcatggtttatggctggctttttatggctggcttatttcacttcccttaccatgatgtcctcaaggttcatccatcttgtagcatatgacaggatttccttctctcttttttttaggccaagtaatattccattttgtatatataccaccttttttttttttttttttgagatggagtcttgctgtgtcacccaggctggaatgcaatggcgcaatctgagctcactgcaacctctgcctcctggatttgagcaattctcctgcctcagcctccggagtagctgggactacaggtgcgcgcaaccacacctgactaatttttatatctttagtggagacagggtttcaccacattggccaggctggtctcgaactcctgacctcaggtgatccgccttccttggcctcccaaagttctaggattacaggtgtgagccaccgcgcccagccacattttctttatacattcatctgctgatggacatttagattgcttccacttctttgctattttgaataattctgcgatgaatatgggtgtgcaaatatctcatcaacatcttgttttcagatcttttggatatatttccagaagtgagattgctggcatttttaattttttgaggatacttcatagtgttttcatagtggctttgtcatctaacattgtcagcaatagtgcacaagcgtttcaatttctccacattctgtatcttctttgaaaaatatctattcaagccctttgacaatttttcatttggattctttcgggggtgaggtgttgtggagttccttatatattctgaatattgatcccttattggatatatggtttgtaactattttctctcacttcataagttgcctttttactctgttgtttcctttgctgtgcaatagtttgtaagtttggtagtcccatttgtcttatttttccttttgttgcccatgcttttggtgtcttatctaagaaattattaccaaattcattgctgtgaaacttttttctccagtgttttcttcttggagttgtgtagttttaggttttaaatttaattgtttaattcattttgagtttatttttatatacacaataaggtaagggtctaactttattcttttgcatgtggatatcctgtttttcccaccaccatttctcaaagaaactatcctgtatgcattatcagtactatactttttctttttttttttttttttgagatagattctcactctgttgcccaggctggagtgcagtggtatgatctctgctcactgcaagctccgcctcccaggttcacgccattctcctgcctcagcctcccaagtagctgggactacaagcacctgccaccacgcctggctaattttttcagtttttagtagagactgggtttcaccatgttagccaggatggtctcgatctcctgacctcgtgatccacctgcctcagcctcccaaagttctgggattacaggcttgagccaccatgcctggcctatcagtactatactgttttgattgctgttgctttgtgtaatatgttttgaaatcaggaactctgaggcctctatctttgtttttctttcttgagattgttatggtatttgggggcctttgcagttttatatgaattttagaatttttttctatatctgcaaaaaaatgtcattgggatttgtataggaattgcatgtgcaaaggaatctgtacattcctttcagtagtatggatattttaacagtattaagttccaatccatgaacacaggacgtcttttcatttattggtgtcttctttaatttctttcatcaatgttttgtggttttcaatgtaaaaatcttgtgcctccttggttactcataagtattttattcatttttaatgctattattaatatatttgttttcttaattttctttttgggttgttcattgttagtattttcaaacacaattaattgttttatgtttattttgtgtcctgcaactttgctgaatttatttattcctcctaataggtttttttgtatgtgcagtctctaggctttttatacatacaagattgtgttatctaaagaaataattctacttctctgtttccaacttgtatgcctcctatttcctctttcctttctttctttctttagctgactgctctggatacaacttccagcactactgtgttgggcctggtggtatgctcctgtagtcctacatacttggaaggctaaggcaggagaatcacgagttcaggagttcaaggttacagtgagctgtggtcataccactgcactccagtctgggtgatagagcaagatcccgtcggtaaaaaaaagtggcaaggggggcatccttgctttattcattgtctttgagggaaagctttctgttttttaccatcgagtattatattacccatcggcttttcatatacagtctttattgggttgaggtgatttcctctgtgccttttttttatttaattataaaaagatgttgaattttgccaaatagtttttctgcatcaatagagatgtcatctagttgtgatgtctgataagattcttctttctgtaagtcattttcctcccctccactccattttttagctttcctttggtttgtcagagaagccaggtcttacatttgtctcatataatgttctacaaggttcagtgcttccttttgtagtgttgttcctctatcacctaatttcctaataagacctagaaatgcattgtcgtctggtagctactagctacatgtggctctttacctgtacatttttaaaaattaaagtttaaaattttcagccattgtagccacttatcaagtgctcatatagccaaataggggtagtggctaccatattggatagtgaaaaggaacatttccatcatcgcagaaagtggtctcatataaagaactgatatgacagtgttttttccatactctattttgtctttttccacatgccagctatctcaacaccatttggggctatttttagatgtcataattttagccaatactaatgggtatttattgatatctcattgtggctattttttcatcaatagttttttgtttgttttggggggcagattttgtttgtttgttttcatttttttgagatagggtctcactctgccacccaggctggaagacagtgatgtgatcatggctcaccgcaaccttgaactactgggctcaggtgattctcccacttcaacctcctgagtagctgggactgcaggtgtgcaccaccatgcctaatataaatatatatatatacacacacatacatatacacacagacacacacacacacacacacacacatatagagagagagccactgtgcctggcctaaatagttttattttgaaataattttagatttatagaaatgttctaagatagtaaaaataagttccatgtactcttcacctagcttctcctaatattaacaccttaaataactgtaggatcttcatcaaagctaaattaacattggtacaataccattaactaaactacaggtttattttcccagtttcttaagtaatgtcctttttctgttccaggatctgttggaggatactacttgacatttcattgtcatgttgctctgtcttgccttctcttttgtggccttgacacttatgaagagtagaggtcagatagtttgtaggatatctttcaatttgagtttatctgttgtttccttgtaattagactgaaattatggggttttgagaataccaccactgaggtgattttgctttcccaatgtatcacatcaaggtgtacgtagtatcaatctgttactgttagtgtgaaccttgaacatcaagttaaggtggtgtccattgggtttctccattgtctatttgttcctttccatatacagttcattagaaatgaatcactaaatccaccccacacttgggggtgggggggtaaatacaaaatgaatagtgtttagaaacctcatagaggaaggatatagccaccacagtaattaataaatattagtggagagatattatgaaattatgcaaatattctagttttttaaagttttacccactgatttatagcatttattagtggatattgcctataccaattacaactatggtgttctaatggtgattttctatttccctcatttattctatatttaataattcaaattctttaaggaagatttgtctctttgcttccatttttaatattctttaatttttttttcgagatgggttctcactctatatctcaggttggagtgcagtggtgtgatcgtgactcactgctgcctcaaccttctgggctcaagtgatctacctgagtagctaggactataggcatgtgccaccacgcccaattaactaattctttttttaagaggcagggcctcactgtgttaccgagcctagtctcaaatgcctgaactcaagtgatcttccctcctcagcctcccaaagtgctgagatcacatgtgtgacccaccacacctactctgtattcgttttttacaaattcagtagtcttttcttttctttctttcttttcttttcctttattttctttctttctttttctctccccctttcctctcctttccttcccttcccttccctttctttcctttctttcctttctctcctttctccctcccctcccctcattctctctgtgtcatccaggctggagtgcagtggcgagatcatggctcgctgaaacctcagcatcctgggcttaattgatctcccaccttaggctcccatgtgtgtgggggtgtgtgtgtgtgtttgcatgtgtatgtagatggaatttcactgtgttgcccaggctggtcttgaaccttctaggctcaagcaatcctcacaactcgcccttccaaagtgctggaattacaggcctgagccactacacctggtttgtttccatttttcataaattctgcctggtgcggaggctcacgcctgtaatcccagcactttgggaggctgaggtaggcagatcatgaggtcaggagatcgagaccattctgaccaacatggtgaaaccccgtctctactaaaaatacaaaattaactgggcgtggtggcacgcacctgtaatcccagctacttgggaggctgaagcaggagaatcgcttgaacccgggaggcagaggtttcagtgagccgagttcacgccactgcactccagcttgacaacagagcaagactccatctcaaaaaaacaaaaaacaaagcaaacaaaaaaaaacaaaacaaaaaacccttaattgtcatttatatcaatagggctcatggatatttatttagttctttgggttataatctaaaactgtgtcacttttactactcaaattcgagatttaactattgagagctttgtcacattggcttctgtatcattgtgacagacctgtcatctttttattactttcttactttctggcactacaagatcatctagactttctgtaccccagcttgtttctccaaggatcactggttcactttatcaaagagaaggaccaggcatggtgactcaattctctaatcctaacactttgggatgctgagacagaaggatcacatgaggccaggagtttgagaccagcctggacaatgtagtaagacccccatctcttaaaaaaaaaaattagccaggcatagtgacatgtgcctgagacctagctacttgggaggtttaggcaggagaattgcatgagcccaggaggttgagcctgtgtgagccatgatcatgacactgcactccagcctaggtgacagagcaaggccctgtctctaaacagagaaagagagagaaagagagagcgaagagagaaagagagaaataaaagaagaaaagagagagagggagaaagagaaagaaaagaaagaagagaagagagaaaaaggagggagagggagggagggagggaaggtaggtgggaaggtgtttcaaaaccagcatctgagcactgttttctcgtaagctactggcagtaattgcttctaggttctctcagcagatagaattaggaaatatgcttatgtctgctaactcatgtatacatagacacacattgtatttaatcctgttacctatgtgtgtttataatatatataaaatcgtgagtttataatggtatctcttactctaattcagtaccacagagttcatgctagcatttccctttgacttattttaacttccttctctgatagtgagaaagctggctctgattatttgacatgtatttacttatttatgcaaacctagtatacatataaagtcgtttaaaaattgctggctgggtacagtggctcatgcctgtaatctcagcactttgggaggctgaggcgggcagatcacctgaagtcgggagttcgagagcagccttaccaacatggagaaactgcgtctctaacaaaaatacaaaattagccgggcgtagtgacacatgctgtaatcccagctactcgggaggctgaggcaagagaattgcttgaacctgggaggcagaggttgcagtgagtcaagatcgtgccactgcactccagcctgcgtaacaagagcaaaactccatctcaaaaaaaaaaaaaattgctgaatcatacctctgtgataaaccaatttaccagaatacaatgcttatatatagttctttttgtctttagcactatagtatgtaaaggaaatactgttggctacagttatttagggtcttttcattcccaccactttcagtaagtttatttcatacatatttaatacatttagactaatttatcacagtttgcattccatcttgggttcccttaacatcctaattgatatttttaaattagtatttgctgaaagaaacctaaaatattgctcctttacggtagttggtcccttccacctgccaaccatgggaaaagttaatctgtttttcatctctgtagtttggcattttctagaatgtcacatacatgaaattataaaatatgtagactagtggttctggcttttttttacttagcaaaattcatttaagattcattcttattgtgtgaatcaagtttgtgtttagtatgtaaaatatatagtttaaaccagatattttggggctgatttctgttattgtatggtatgctttctgtactatgaggattttttaatttgtttctatcttttgccatatcctcccactttggtttgtgtgtatgtttcttccaataatttgtgagacttgtatttttattcaagtgaccacatttagatctgtaacttcatgtaacatgattaagatttttttatttaaaaaaaggtcttttgagacatggtctcactttgttgcctaggctggagtacagtggcatgatctcagcttactgcagctgcaacttcccaggcacaagcgatcctcccacctcagcctcccgagtagctgggtttacgggtgcatgccaccaggactggctgttgttttacaatatgtttttagagatagggtttttccatgttgcccaggctggtctcaaactcctaggctcacgtgatctacctgccttagcctcccaaagtactgagattacagtagtgcaccactgcacctagccaagattttttaaaagataataagtattctttttcggggaattcttcattctcttttcctagaagatttttctttcccttagtgtttttaagaatacttagacctcaattacatgatttatcagcttttcaggatctccttgacccctggctataaaagatgaggaaatctttcttaccctcatagtctcacaccttccctctcccaattactctattttgtatatttgttcccgagatttataacatttatattgttctgtaaccaaacatattctcctccctcctgcaaatttttgatcttattcataacagttaaaaggcaataaacagaatcaatgtttatagctaagcctttcataatagtcattttatctcttggtttgctgaggtttgttctggtggtttcttcagaaagtcacatagaaactatatttcccaaattattttatgttctaaattttgtctcttcatttatacttacatggtagtttgaccagatacaaaattaactaggctatctttccttgaggaggtaatagacattgctcttttattatagggttttttggtttgtttgctttaatgagatagggtctcactttgttgtctatgctgatctccaactcctggcttcaaccaattctactgcctcagcctcccaaagcactgggattataggcattagccactatacccagcctatcttagaactgtatttatttatttctagagacagtgtttcattatcactcccaggctagagtgcagtggagccatcacagctcattgcagcctcaacctcctaggattaaatgatcctcctgcctcagcctcctgagtgtcagggactccaggcatgtgccaccacacctagctaatttttaaaaaaaattttcatagagatgagtgtcagtctgttgcccaggcttgtcttgaagtcctggccccaagcagtcctcccaccttggcctcccataatgctgggattaaagacatgagtgaccacacccagcaattctttaaatgatactttgaagaacctgagcacgcacatatatttcttccctctttgttagtaactctcagttccttatctagctttatttttctgtcacctggtgtatatattccttggattatttgtttgctgtcatctccatctatagaatgcaactatcaatagtaaagggatttggtctgatttgttctctgttgaattccaaatagcttgttagtgtttaatacttagcatatagctaatacacatttattgaattaataaggtcagaattcatgattctgccccattctccatccttataagtactttgatgggtttgattgcttacaaaaggattcgtttcacattttgaattcccgtgcctttactcagatatgtcttggtcttcactactgtgtgtcagtgttgtgctctttccaactatatttttctgtgctatttctagaaagttcttccacatgtatctttttttaaaaaatatttttttgagacagggtcttactctgtctcccaggctggagtgcagtggcatgatctctgcccactgcgacctctgcctcctggtctcaagtgatcctcccacctcaacttcccaagtagctggaaccacaggcacgtaccaccacacctatctagtttttgtattttttgtaaagacgtggtttcaccagttgcccaggctggtctcaacacccgggactaagcagagctcacctcggcctccaaaagtgctaggattacaggcatgacccatcgtgcccagcctcacatatctttatattaggattgcagcttctgttttctactattcccactggcctggtttatcattctctatctcttttagccactttgttttttgttggtttttttttttttttcattttttttctccctacccctctcttttagccactttgaattggtttgttttagtgtctctttgccatacagcagagaattttcttttgcttcctgaggcaatctgaatatactttcatgtcaataagctgctgatatatttggcctcaaacctgtcatgttattctataattactaaatatatatgtatactgtttttctgtgtgatttattatctctgctgtttttaaattttttattctggcattttggaaaggtttatatttcttttctagccattagcttttcttttaagtgtgctttttatggtggccttaatccccatttttcttataacattctactctccaatcagttttaaatgatatcctttgattctcacctattatctatacaacagtgattttattctgcatttttctctcacttctttgttttaaaattgtattacttctactttgtcagaatatgcagtgcttacaaactatgttctttccatcctttttaatttataattataattatcttattaaatgtaatgaggtttaccaacaacagtcctgtgtttgagttttcccccaatcatgcttggatgaagcttatcttctaatacatttctcaggaaaggcgtatgtgtacagtatcctctgtgttcttttttttctattactttatactttttcctacacaaagacagcttggctgcatataaaatccttgactttatttcttggaaataatgttctagttttgtcttgctttgtgttttgctcttgaagtctaaggcagcctaattttctttctttctttctttctttttttttttttttaaagagacagagtctcactctgtcacccaggctggagtgcagtgtggtatgatcatactttactacagccttgatctcctcagctcaaacaatcatccaaccacagcctcctgagtagctgggactacaggcatgtgccaccatacctggctaatttgttgttttttgttgtttatttgtttggttggttggttggttttgtttttgtttgttttttgtagagacagggatcctgctatgttgcccaggctgttctcaaactccaagcctcaaatgatcctcccacctcagcctcccaaagttttaggattataggcatgagccaccacacccagtccctagcctaattttcttattcttatttttctaatttcttactcttaattttatctttttgcctgtaggcctgaaaatactgtttcatcattaaggtctaataattttaccaggatgtgtcttagacctttcttgtttggggtcagtttttccaggtatgcaataataagctggaaatatagtttctagcttatagagtaatatggtagctcatgccttgcacatgcttttacaccagcagcacatcttttaaatgtgtagatttaaattttcatctatttctggaaagttttcttagactatattttaaatatactattccattgcgttattttttcctcaaggattctgtgtttatgttggatcttcttttcctgtcttccatttcatctactttctctctttgttatgtctttcttctctcattttcattcttttggttgtttgccttcattttttcagtgtacctttttagattttcactttattaatgtattcagcatggtgcactttgtaatttatttctgggattgttttttccttttattgcatttcttccctgattactttgtcctagtaatgttgaagacatggtcatatattgttttatttgtacttcttgtggcttattgagagaatacgaagataaatttggtttcagattattgccattatcctgaaatagattttgaactgtttttctgtgctactactttgttactctaatttaggaatgccatttatattatcttagattcacttttcctcttgttctgtccttttctcaccaatttattttattacctttgttagttcctatttcattttgcttgctttacacagtcctgacctccattttatttactatatttttatcagtgtttttttctccatttctttgatggttgcatttttctttcacactctcttgagcccagccagtttgtgtttcaccatctgttaatatgtttaattataacttctctatactttagtgtctctgcttaatagggataattgcttcatgaattttgtccatgcatttgcttataattgatgtgtgttccattactatatatttctgttaaatgtcttgtatgtgtcatttactttgctactttttttttcttctgtcctcatacaaattctgttctggttcctttttcatttctcatcttcgaatatggtattttcctacattagctattttacatgaggtttaattaaggaaggggttacacatgtatttcatactatgaagaattgtccatatgatgcacatatgccagttcaattaatggtcttaactcaggacaatacaaatagtacctattgtttcctaccactattcctaagcaccttatatcagattttcttttccttaacccttggagacatctagggaagattcatcgtagtttttagtcactttcagctgttaaggaaattgccctgcttttggttatttaaacaaattttaagtctgttgttaaaaatgtcagtcttaaactgtgtttgtattagtcctttcttgcactactatgaagaaatacctgagactgggtaatttataaagaaaagaagtttagttggtttatggttctgcaggctctacaggaaatgtggctggggaggcctcaggaaactttcaatcatggcagaaggggaagcaggcacatcttacatggctggagcagaaggaagtgagacaagggggagacgctacacactgttaaacaactatagctcattgaaaactcatgcactatcacaagaacagcaaggggaaaaatccaccctcatgatccaatcatctcccaccaggcctctcttgcaacattggggattacaatttgacatgcagcttgggtggggacacagaactaaaccatatcattctgcccctggcttctcccaaatctcatgtctttcctacagtgcaaaatagaatcatcccttcccaacagtcccccaagacttaactcatctcagcattaactcaaaagtccacaatctgaagtctaatcagagacaaggcaatctcttccacctctgagcctgtaaaatacagttagttacttccatgatacaatggagatacaggcattgggtaaatccctgttccaaaagggataaatcagccaaaagagaggggctacaggccccatgcaagtccgaaacccagcagggcagtcattaaatctttaaactccagaataatctttgactctatgtctcacattcaagccacactgatgcaacgagtaggctcccaagggcttgggcagttctgcgtctgttgctctgcagggctcagctcccatgtcagctctcaagggctggcgttgaatgcctgcagcttttccaggtgcatgatgcaagctgtcggtggacctaccattttgaggtctggaggacagtggccctcttctcaccattccaataggcagtttcccagtggggactctgtatgaggactccaaccccacatttctcctttgcattgccctagtagaggttctccatgagggttcacccctgcagcaaacttctgcctggacatcaggtgtttccatacgtcctccgaaatctaggcagaggctcccaagcctcatctcttgccctctgcatacccacaggctaaacactaggtagaagctgccaaggcttacagcttgcaccctctggagcagtggcctgagatgtatctggggctcttttttccatggctgggacgcagggagcagtatcaaggttgcacagggcagctggtccctgagcctggcctaggaaagcactcttcgcttttatgactctgggctggtgatgggaggggctgctgcaaatgtctctgaaataccttagcagcattttccccactgtctcggctattaacatttggctcatttttacttatgcaaatttctacagccaacttaaattcctgcccagaaaatttctcttttctaccacacggtcaggctgtacattttccaaactttccaaattctgtttcccttttaaatataagttccagtttcagatcatctctttgctcacatatatgagcatatgctgttagaagcagacaggatacatcttgaatgttttgctgcttagatatttcttctcccagataccataaatcatctctctcaagttcaaagttccacatttccctaaagaaggagcacaatgctgctagtctctttgctaaagcatagcaagagtgaccttcactccatttgccaagaagttcctcatctccatctgagacctcctcagtctggacttgactgtccatagcactatcagcatttaggttacaaccatttaacaagtctctaggaagttccaaacttacccgtatcttactatattcttatgagccctccaaactgtttcaacctctgtgtgttacactgttccaacgttgcttccacattttcagtcatctttatagccatgccccagtcgtaggtaccatttttccgtattagtttgttctcgtactgctataaagaactacctgagactgggtaccttagaaagaaaagaggtttaattggctcatagttccgcaggctctacaggacatatggcttgggaggcctcaggaaacttacaatcatggcagaaggggaagcaggcacatcttaaatggctggagcagaaggaagagagacaagagggaggtgctacacactgtttaacatccagatctcattgagaactcgctcattatcacaagaacagcaagagggatatctgccccactaggcccctcttctaacactggggattaaaataaacacgtgattcggatgggaacacaaatctaaacctatcagtgtttacattttttatttttattatttttattacaaagctcagctttccaatatactctgcttataaactgaaatttttaatattatttaaaatgtcaattctccctacagtgagccatagaatcaatgcctttccaaccaaaaaacaagatttttgtgaaactttaccatacatttctatggaaaagcaaaacggcaagaatattcaaactactcctgaagagggacaacaaagtgggatgtagcctaccatatatctgaacattctgtgatttttgtaatatagcagttcgctattaggacagtggtagaccagtgtaatgggacagagaggacagagacagatgccttcatttccataaggaaatggttgattattcaataaatggtgctgcgataattattttttcataacaaaaaagtgaaatcaaatttctgttttatactatacacaaaaatcaatttcaggtgaattatagatctaaatatgaaggtaaaatgacagagcttttggaaggtaacttttgagaatatctgtatgatctcggggtgtggaaaaatttcttaagcaggacacaaaagcataaaggcaaagactaataagttgtaccacattaaaattaagagcctttgtttatcaataggtacctttaaaagattaaaaggcaagccactgagtaggagaagacatgtgtgacacaaataacccagaaagaattaatatccataatatattttcaaaattttagtaatcaatatggaaaagacaacacagaagaaaaatagtcaaaagataccaacaggaaatttaccttagaagaaaatcacatgtgtattgaaggaatgaaaaattgttctacctcatcattaattagggaaatgcattagccgggcatggtggcacatgcctgtattcccagcaattcaggaggctgagacgggagtattgcttgagcccaggatgtcaaggttgcagtgtggtatgatcttaccactgcactccagcctgggtgacagagtgagaccctgtctcaaaataaataaataaataaataaataaataaataaataaataaataatcctttgaaaaataagggaaattcaaatgtaatccacaatgaggtatcattttataccagttgataaaaattttaaagtctaaaaatttcaaatgctgcataaaattagaattactgactcttacacacttgaagatacaaattccctactatccccagaaaatgttattgcttttagacactaattatatccaatatctagaacttagtctaataaactatgaacaaggcctctaccaagaacacttaaaacataattgtgagaacttaaaatgtaaatggaggtgtgttttaaagatgtttatttattagaagactcaatactgtaaagatgcaatatttgtccattttagtctgtaatttcaatgcaattctgattaaaatcctaacaagtaggggtgtatatgagtgtaaattgacaaactcatttttatatgtttttggaaagtcaaaggataataatagccaagaccatcttcaagacaaataagatgggagaatttactggtgatatggttaggctttttctcccatatccccaaatctcatcttgaattgtaatccctataatccccacgtgtcaaaggagagacctggtgggaggtgattggatcatgggggcggtatccttcaggctggtctcatgatagtaagtgagttctcatgagatctgatgatattataagtgtagttgtcttttccacacttgcacgctctctctctctctcgcctgccaccatgtaagacgtgtgtcttccccttctgccataattgtaagtttcctgaggtcactctagccatgtggaactgtgaatcaattaactcttttttctttagaaaatacccagtcttgggcagtactttataaccgtgtgagaacagactaatacaactggatattgagtcatcttataaagttaaaataataagacattgtgacattggtgcagtgataaataatggaacagaataggaaacccaaaaacacaccaacaggtatagttttccattttgattgttcctttcattagatgtttaaaactttataatgaatatgtacttttagtcaaaatttatttacttgagaagcaaagtgatgtatggattatggcctctgaggctataatgtgagtttgacccaaataatgatccaaatgtgagttccagtcccagttttgtcctatactactagctgtttgagcgtattcaactggtctgtggttcttagtttttttatctttaacacaagataataaaattacctctcagaattatggtgagaatttgacataacaagtataatcctgctggcacatgctgttcccttgatgaggggaatttgttattatgtttcttaggaacacaaaacttctgtttattcttggtaagaattcatgtttcccagatctatgtgtactatttgttatatttaaggttatcaaattgtatccttggtaatggttgccactggatcttttttggaatatgtacaactccttattcaaagtggctttctaatcatgattagttttttgtagttttggaagagccatattactgccctgcattcataaagcagtcttgtaaacactgattatgatagtgttttgaaaaattaaaagcctccaaaatcactaatttttaaaaaataatgcagttaaatatagaaaaggattagccatagatattttgtagttaaccctattatcattaacctaagtgaatagaacctaatttttgtacttgctaataattgctattaagaattttgttaatcgtgtgtggattggtgcttgagttcagaatgaatgattgataggggacaactctaagaaatacagcacttacattaatgttttattaaacagaaaaagctttaatgttttattaaacagattttaagagttacagtcttaaaatctttattatttattttatgaaatatttcattttgttttttttctgggcactttaaaattgagatgaggatggtagaatttgccagtttattttttggctattttttttttaacccatcttattttgagaacgaatttagtaatatttttctcaacatcctgaaattgtgtaacctgtagaaacttcccactgtctttttaaacttattcttaaataccacatttaatataggataaataagtcacaaagcttgcttatcaaaacagaatattgtattcagctttccatcggagcttttggggaagacatcacagtattgtactgtctcccaagatgcaaagtatcaggctttaaataatgaaaataagggaaatgccaatagaaaattagaaaaaatgttagaacagttaaaaacagcatactgaagcctgcattatttggcttatctaaaaatcatatgttttcaaccaatcagtacttatagtcattctatttaatcttttaagaaggagacataatccaccctcaccaagtgattcagtgtagcatcctaactaataatgacttaatgtgtgtccaaatggcatgtaatgagaagtatgaaacattgtctgtatactttcttgcctaagatacttaactgagtctaatcataaagttcagacatatcttcactgtggaacatttctacaagacaacggcctggactcttcaaaaatgccactgtcatgaaagacagtaaggagaatggaaggagactttcagattaagggagactaaagagacttaagcaaatgtagtattagatccttgactatatattagataatactacatcactgccacattttgtgcttatataggaaaatctccttggtcagtatgtatcataatagggtcataatgtctgcaacttattttccagtggtttgaggggaaaaaagacgtgtgtgtgtgtgtgtgtgtgtgtgtgtgtgtaaagaatatgttctaattgatacatatacgtaaatagcataggagtgttcatttgtactactctcaattttttctataggcttggtttcaagatgaaatttgaaaaaccttaagggaaaatatgtttaaagtatgataataacaaattagcacactagataaactttttatagcttttgtgagtttttttccttcagaaaatcatatttatgtagatagcaggattaaagaaaacttttctaaatttcagatgtcagaaatggagacatctaaattgtttttccatttcatctctaaatgctaatgaaaactggacttttacgacattaaagacatttaattgatctctgtgggatttcatgtttagcttttttcaacagctatatattgaacatttaggtgatgagattgagtagctaatcttagaggcgctctattgagattgtccagattccaaccctgatcccacaacttaccacctttgtgatcttggacaagtaatttgagatatctgtgcctcattctcctcaaatattcaacaggataataataatacataccagtttcttaggattgtagtaatgcttaaatgaattaatatatttggagcacttaggaaagagccaagtacatagtaattttctaaaaattatacctacttattatgtggatctttgctgaggaaatatgagtaagcatacaagactggacaggctttgagtagtgaagatgttttactcacaagcaaggtaattatgccttttatattaaaagaaagttcatatggaacactctgcttatatgcttcatcttcttttcaatcagataataagttctccaatgtagaagggaaatgtcagcctcacacataaaaatatacctgtcagagattatataagtgtcaaaataatactatctagagaaattcaggacatttggataaataaaggaatgtcatgtagtttggatagaacatagagaagtgaggaaaggagacattcccagatagaataacagctcaatgacttgaacaaggatacagatgcatgtagtatacacagtggactagaccatttatgtgtgtatgtacatatgtgaaaaaaagtctttgaaatgtttgcatttcaattaaattctgattttaagaacttattttccccctgtatcctgtgtgtgctagcattctgtttcctaaggcattctttcagacagacatacctagtcctgaaaatgctgctattattgttccagatacaaagcaggatgtcataattttttttttttactattccaactggaataatatggctcaacttaagttctgtacaaaactacttaatgataactcacaaaattaaaccaatttatattttctgcagttaaaatagaatgcacagatttttaaagacctaggacacattattatatctagttcctgaaatcattaaatgtccatggggaagaaaaaaacttgtgtaagtaggaataatataattggatttgcaatgctctcttaagagattctttaaaatcatgtgaaataagtagagtttctatgattttttaaaaatcacaaatagcatatatccgttttatctttaatagtgtttgagcccatcatttgaaagcattggagcatgtaaccaatatttctgaaaatgaaccatggttccagtcataatctatatgctttaaaattccttccctttattctttcttcccaaatccatgacatctgaatttcaataaggaagaaaataagcatgtttttaaaatgttttagaaaagattttcaaaattagattaaaatgtttgaggaaataaaaacttctttatgtattcattgtgatactgatttttatcaatgtctttttgtaaaaatacctatatactaactttgaataggtccaacatatggtaatgtgttatgcaattaatgataatgtagaacgatgttaaacccacagaatattgccaaggatttaccaacaaccaaaaatgtaattatatagaagaaaagtgtagttacaaatgcagtcttttgtctttttacattctctatatgtagagggtaacagaaatactgtatcactttttagtatatgttctcccagaataagttgccacaattagaacagagtttaggagcctatattaagctttactagttatggttatttccatagtgctagtaaataagagaaaaaaactttttgaacccatgtctcattgtaggtctcctaaaggaaagtggcccaaagtccaaatacttcaataccgttcgtctctgcctgataacaaagtgttttgtttttgtttttaccctcggacaagccagtcagctgatctttgtcctaatttgttcctggtagaattgaacaagatgtttgcagaagcttcctctagtttgaaaattgtattgattttttttccccatagtaactcacagatggcttctcaggttggaaataatggtgtccatgtttaggtaccacgtgttagatcagatttgtactcatggatctgtgattattttaactttttcttgttatttataaaaataattatgtacttctctctggggtttaatgtgtctttttattctcaaaaaatgtagtacattgatcagccacctaaaatactagccctatagaattctaatagttaggttttatatacagccatttgtcgattaaatattaaataccggatcagcttaaaatggacacacaaaaaaacactaccacataagctatacagtgccttttttcacagtgtcttataggtggaagatactcagtgagtgtttgttgagtgaataaaggatcttcacttggtgcatcccatttccttacaatttattattttttattttactttactttgagtcaggatctcactaggttgcccaagctggacttgaacttttagatccaagcaatcctcctgcgtcagcctctcaagcagctgggactacagggatatgtcactatgttcggctttaatttttattttattatgaaagttttcaagtagcaaaagcgatgtaatgaaccccatctacccattactgagattcaataattactaagattttgccacacttgctttatctagtctttaaagaaatttctccactgaatgatttactttaaaatacttgacctcctggccttttactctgtattttaaagaaagctgtagtaatttgtgacataaaccaatagagagcagctaaattttgttatatcttcatagcaattgactatattttggtttgtcttaccaataatttgatgaatgacctttcattttcaatttatctttggtaactaagtagataagtgggagtgtaggtttacttatttaaattctttgaatttgtgtgtgtgtgttgctttcccccccgatagaaactataaatggtagtgttattgtggttaggagtatggggctatggagttggggaaaacatgtatgaatctcagttctactactttaccttttgaatgtgggcaagacaagtctcagagttgttttagtttttttaattttaactttgaaataattgtagaaaaatagcaaaactagtttaatgaattcccatatgttaatatttaccacagctattgtatgtatgtatgtagagtttttttcctgagtcgtttgagagtaagttgcaaaaataatgcctctttaacctctaaatacttgaggtgtggttagtaaaaattcacgttttgttacataaccacagtatatttatccaaaacaggaaattaacatggataaagtattactgtcttatctagagatcttattcaaattttttcagttataccactaatacccttcatggcaaaagaaaaattattttattcttaggttgaatccaagatcacatgttacatttagttgtcatctctagaaactgctggtagtcctagctatttgggaggctgaggagggaggatcacttgagcccaagagttcgagtctgacctgggcaacataataagactctgtctcttaaaaaaaagaaagaaaagaaaagagacagaagaagaaaacagaataagctcatggactgttataaaggcaataaatgtgacataaaggatgctaaccaaaacagataaatagtaaaaggttaaataacagaggacttagctatttgcaagtactgacaaattttcatgattgggcaatgaatgatgtgacgttaacacatctgactttatctttcatgactttgatatttttgaaaagtataggctgcttattttgtagaatgtaccttaagttttttttatgtttccttatgattagatttaggttatgccttttcataaaatactatggatatgacctatccttcatgtaccatattaggaggtacatgatacctgttttatcctattgctgatgatgttaccctttgatcataacattatattttcaaatttctctaccataaagttaccattttccttttgtaatggatctcttgtgggaagatactctgagagtacctaactatcctatttctcattacatgttcacatgctagttttgacatccattcttcctagagacagttattactatggagattgccaaataatgatttgtttttcattccatcattttttctgcatttgttagttggctttcagcttcaatttttatatctgtaaaatgaacctaattgatgtaaaattggttaataacacccaaatcatgtagggtataagataatgcattttattttattttattttactttactgagacagagtctcagtctgtcacccaggctggagtgcagtgagtgacatgattatggctcattgcagccttgaactcctgggatcaagtgatcctcccacctcaggcctccctagtagttgagaccacaggtgtgcaccaacacacccagcatgtatgtgtgtgtgtgtgtatatacatatatatgtatatccacacatacatacatacacacatctttacatatatagacctcatctatatatatatatatatctcatctatatagaagagatatatatagagagatatatagatatagagagagatatagatatatagatatagatatagatatagatagacatagatatatatctcatctgtatatatatagatgaggtctccatatgttgcccaggttggtctcgaaatcctgggctcaagtgatccacccacctcagcctcccaaataatacattgatttgggacaattcttagcacataactctttaaaatattagatattataatttttattatgctagtatctacttttcagttgaagaaatagatcattttaaagatctttgaaaggtcataggaaatgttaaaaatatcaggtattttatgtgtacctaccatgaatgttttacctcatctttggtaaggtcagaagtgagatgatgtaacagccatcatatgtatgtgtattttttttattgacctgagacagtttttggttatttaatgcagaaaatatatttgcagtgtacttcatatgatatgcagtactttaaatacttgttgtaatgtggtcatttaataggagagaaacttagagacatggtaaattaagttttgatttagtatactgaatgatgaaatagaattatttatggtcattttaattctttaaaagtttttaaattagtattttaaaataatatatgtacacagtttactgattttgtccttaagggtatactgtggaaaagagcaataccctgccctgtactttgacagcccttttagctatttcttcttttacctacctccatatttttaatcacctcacctatccaggttagatattatgtacttaccaacttcctactatgataagataaatatttgtctctcttatatacatacattctgtcctctcctcctctccagttctccagtagagtttttgataaatcagttttcagcataaataatattatacagatgtatgtattatttatttctgagacaaattatattctatggtgttttacaacttttagtttctcctagagtttagaattcccttatctttttgtttccttaggtttctttatacctgtggtgacttccatacacatatcttccaatagcttctcacatttattttgtgcatagttaaaaatgtgagttttaatttgtaaaggtaattataaatcatgtgctctgaaagctttgtttttcttatttttttctttctctctctttttttgtttttgagatatagtctcactctgttgcccaggctggagtgcagtggcatgatctcagctcactgcaacctctgcctcccgggctcaagcgattctcctgcctcagcctcccaaatagctaggattacaggggtgagccaccacacccggccaagttcttttgatggctcacatccttcattaactttctgagaaaaaatacaagggagataaatattttgagaaccaaagtgtctcaaagtatctctgtttactcactctggattaatatatgggctccatgtggaattctagtgagaaaatttattttctttagactcttgaaaccattgctctattatattctaaacttacatattgtttttgagaggtctggttcttttttttcctaagcctttatatatgatctgccttttctctagaagcatttatgatctgtctctggttttctaaagtttcatgataaataataatgatgtagatctcttcattaattcattatattaatacattattccctataaatttagacaataagtcagttctgtgaatttttaaatgaaattttacttcctgggttgatcctctatttttcattttttctttctttttgatttttttttccttttttttctctttcattgaagttgagctttttgcatactcttctcaagtgtctggtaatgctggtagtgcatttatatttaagagtgatgcactagacaatgtacaaaatgagacctttcaacttccttagggtatttgagtaaaagacagctttttcataggggaagtaatttacatgcaccttctccagggctatttaatttctccaaggaaaaatggattctctaattttctttttgggtgaacttaagcctaagtactggtcaggaaaagggtcagaagggctatttggtatgtaagtgttcacataaccagcccagcctgttcttagttcagcacttcacccatttccctatcttcctttgtgcttggagttcctgagtctgaagcctttccagttctttcctagcctaccttccctccattattctgcagaggtaggaaaaggacacttgtcaggctatatgaggtgggaatggggtctgaaagttctgctgttaattatctccctattttcagctctactagttacctggtaccaccattttctgaattttccaaggtttggagggtgaatcagcttgatttttgttggaatctcctcttagtaggcttttatactttagctttcttccccctgctaatctaattaccttttctccatatactgtctgacctcagaaattgtaatccaggattatcagtatcttctagtttttttactaatatggttagttgtaatttttcattattgtcttgagatgatttttgataggagaatgtgcagaaatgtttatattttggcatcagaaatatcacctttggagggggcgagggggtcttacctaggctggagtgcagtaatgcagtcacagctcacttcagcctctacctcctgggctcaagcaatcctcctgcctcagcctttcaagtaacttggactacaggcatgtgccactgctatggttttgctctgtgtccccacccaaatctcaccttgaattgtaataatctccacatgtcaagggtgggaccaggtggaggtaattgaatcatgggggtggtttcctccatgctgttctcatgataattaatgaatctcacaagatcagatggtttaataagcatctggcatttccgctgcttgcattcattctctctcctgccaccttgtgaagaggtaccttccgccatgattgtaagtttcctgaggcttccagccatgctgaaccatgagttgattaaacttcttttctttataaattacccagtctcaggtattccttcacagcagtgtgagaatggacgaatacagccaccatgccacactatgtttttaatttttttgtagacacagaatcttgctgtgttgcccaggctggtctcaaactccttggctcaagtgatcctcttgcttccacctcccatagtgctaggattataggcgtgaaccaccatgcctagccagaaatactatcttaaaatcaactctgcataattcactgacccatcattaaaatttgtcagtacttaaaaatagctaagtcctctattattttatttaaccttttactgtgtagtttatttgttttggttggtatcatttaagcctcatttattgcctttacagcagtccaaacagaacctattctgttttctttctcctcctctctcattttttttctcttttttaagagacagagtcttacagtgttgcccaggttggactcaaatgcttgggctaaagtgatcctccctgctcagcctcccaagtagcagagactacagggactacgggcgccaccttgcctagctccccctctctcttatcttctttaccctagttaaattatttctgctttgtcccaaaaaataatatttgtacattactctccacatggctttatggtggagtaagggtgatgcttgagtgtaagaagttttacactgggatgtggtacttttccttttttcacttatagttgttttgaagtttgggcattctttttgtcttcaaattgtgctgaaggcatggtgtttttgtagatttatttttctgtccttgttctatattcttttggagagaaacagggcttaggtggcaaccattgcttcagctgtctggaattcctcaatttattttaactttatataccatcttttctcccacctctctcttcattataagcagactcattcattcacagtatgtttagtgagtgctatgtgccaggcatggttctagggatatggtaatgaacaaatgtctttgccctcataaatattatattctggtggtagagacaaagaataaaacaaaaaagtgaatatatactataatgttaggtagtgattaatgctatgttttaaaaaaataaacaagatgagtgcagtggtacactcctgtagtcccagctgcttgggaggcagagacaggatggtcacttgagcccaggagtttgagtagccactgcacgtcagcctgagcaataaaacaagactgtgtctctaaaagtatagatatatcaatcaagaacctggggaagttctagtgctacctacaagagttgaggaagaccttttcttttttttttttcttttttttgagacggagtctcactctgtcacccaggccggagtgcaatggcccgatctcggctcactgcaagctccgcctcccgggttcatgccattctcctgcctcagcctccccagtagctgggactacaggcacctgccaccacgcccggctaattttttgtatttttagtagggatgggatttcaccgtgttagccaggatggtgttgatctcctgacctcatgatccacttgcctcagcctcccaaagtgctggaattacaggcatgagccactgcgcctggccaaggaagacctctttgaaaaagtgttacattagcaaattttgttttgttatagaatagtaagtacatctttttatattagcatttaccttatgtaaatcattaagattttaccactgatcaggtttccatgataaattgtttaattttaaaacttctgtagtagaatgggcatgtggtgttatggaattcataccaaataagaagaattttacagaaagtaaaaccataagctgtctactattcaactcttctcattctgctttagagaactgctattgataaaagattatttgagaaacatataatctatccttttctctaataactctacactttattttttatttttattatactttaagttttagggtacatgtgcacaacgtgcaggttagttacatatgtatacatgtgccatattggtgtgctgcacccattaacttgtcatttaacattaggtttatctcctaatgctatccctctccccttcccccagcccacaacaggccttgtgtgtgttgttccccttcctgtgtccatgtgttctcattgttcaattcccacctatgagtgagaacatgtacactattcacaatagcaaagacttggaaccaacccaaatgtccaacaatgatagactggattaagaaaatgtggcacatatacaccatggaatactatgcagccataaaaaatgatgtgttcatgtcctttgtagggacatggatgaagctggaaaccatcattctcagtaaactatcacaaggacaaaaaactctacattttatgcttggactatcagaaaaactgtttacttgaaaacagtttacagaaaaactctttaccctgacatgtattgatttgttgctttgtgttttttgagacagggtcccactctgtcacccaggctggattgcagtggtatgatcatagctcactgcaacctcaaactctggggctcaagcaatcctcctacctcagcctccctagtagttgggactacaggcgtgtgccatcacacctggctaaattctgagttgttttttatattgaagccttaatctttcattgaggaataccacaataaacagactgagcttgctgttgagaagttgttgaggacaacatagtcttctgtattaatgtttaacatattaaagaccctatgaaaagtttattttagaatcacgtgtttcttataagaaagtgacatttttggccgggcacaatggctcacgcctgtaatcccagcactttgggaggccgaggcgggtggatcacgaggtcaggagatcgagaccatcctggctgaagcggtgaaaccccatctctactaaaaatacaaaaaattagccaggcgtggtggcgggcgcctgtagtcccagctgctcaggaggctgaggcaggagaatggcgtgaacccgggaggcggagcttgcagtgagcagagatcgcgccactgcactccagcctgggcgacagagcgagactccatctcaaaaaaaaaaaagtgacatttttatctcttcaagcatgaaaagtagataactaggcatgtcttactttttgctttcactgtcaagaaattggaaacaaattcagagctaattcaagacgcctctgccatgtatttctttttctccccaatcttatactgttctgttttctctgatcattttttttaggttgtctcactaattatggaacaatggcagggatgtgtatgaaagagtgagcaggtagataagtcaatagatgaatgctgttgcctcctcaaatcattagttgtatgagcttgggtgagttaaacaacctttctgcactgttaatttcatctgcaaaatgagaggattaatagatcaaatatttgtagctgcagaactctgttttcatgggaaataatttggaagcccgaaatagaagccaagtagtagcagaactgttgtgtcaggccagtgccatagtggccgggaaactaagcctcattttttatccagatcatattagaactgcctcttggaacaaagaaacactacctctagtgtttctgcaatacagtgttctgtattacagccttgactactctactttttcccccactccagtcaagttttacattttgtagtaggcctcctttttgccatcttcgtgaagattctgaattttcctggatggataaaaatcataaggataataaatggatatttcagtgtttttttagtcagtggtttgcaaaaccacctggagggcttgggaaaacacaggttgctgtgtcctacccacacaggtttctgattcagtaagtctggggtatgaccaagatattgcattttgagcaactttccgagtgattcagaaattatactttgagaactactatcctatgtgagtattaaaaatgtattttagtcacttttcttattttaaaaattacatcaaatcatataacttcataaagctcagaaaacaatgtctgagtaatatatggtttttgaaaaataacatttaagtgacatattccgatgtcatggagcaagtgagaaactggtttgaaatgtttgctatctagtgtcaagggctatctatccctttttgacttcttgtgctactggtgcaaatggatagatattaatcctgcagcaatcaggatttgcttcagcaataaagaaattattgatgtctgaaagcaatcctttccttttgacatgttggcagcacctaagaagaaaatgtcagggtcaatataagtgcatttactgacagtttggctctttcctatgttacagaaaatgatttcacatttagcttttatcaaaaacagaaacactgaccactctgaaggatataaacaatagctttcagcttagtcattttccacttataaagtgatactttcatagaaataaacaatgcaaacttcagagagccaaaacaattacacagaaaaaaatcattgcatttttgccatttttaactcagatttaaaacaactgtgtctggtagtaactggagaaaaatcactgttttgtgttctgttaagttaaaacagttaaaatcactttatgataaaatatggccaaaaagaagaatcatcttcaattaggtacttcaagatcacttgtattctctgcttctctttcagagcctgatccatgtatttcttaaacttcttcatcatatataaaatttcgtgtttataaaatttccactaaaacctcaattattagtttcatgaatcagaagttacaattagtttcatttctggctcaccaagatttgtcaatttctggataaaagggactccctattcagaatatccctttaaatcttttttaaaagtgcacctttgatgtgtacatgtttttatgttatttatggcttctgaaaatattatgcaaaaaaattgttatggaaacaacccaaatgtccacaagcaggaagatacattgtgatagatccatacaatggaatatcattcgttcataaaaaagaataaagtactgatgcatgatagaatgtgagtgaacctcaatatcaagaaaatggacgaagccagacataaaggatcacatattgtatgattccatttatatgaagtatccataataggtaaatccacagaaacaaaagcagattggtagttgccagggacttgtggggagtgaggaatggggaataactttttaatgggaagatagggtttcttcttggggtgctaaaaatgttgagaagtagatagaggtcatggttgcacaacactgtgaatataattttatgtgaattttacctcaattttttaaagaaatcagttgatttaagacttaactgaattctagaatttttgaaatgaaggtgtttctcaaggtcatccaacccaatctcctgtttttcacaaatgaaaaaactaaaactcatcaagattaaatactatatatcactaagattgcctagtagctagtccaaacccaggccagaatttgagtatctggatttttagcccagtgatttctttttaaactactgcatgctgctttattatcaattgctattttttttaaatttttttctgggaacatactacaagtgttagtttaaaagtaaactaacataaaagtaaatacaaaaagaagcatagcttcctttgtgccacatataagaaatgtagacatagagagtgtttattgcagtaatttgccaaaaagcaagccatagtttaaattagaagaggtttattccctgcagcactttcacaatcacagaaggcacctatattttaaatgtagtctacattggcctggcttatgaactgcaaccttctatgattgcaattcacttttttaaattaaaaaaaatttcaaaataatttttgcataattattagcacattctaccacttgataattttttgtttctttcaatagacgaaagcactcacattgtaaaaaaattatataaatgaccttgtcttgtgatgaagctagaagatctgttttcaacgaaactattctcagaggcatctagggagaaacatttgagtcaggttgggagttagagatagaaagcagcagcaattaaagcaagataatgtattaccccctggaaattgggtgttatactcaaatgtaaaggacttgtattgatttagtgctagcctcagaaaatagtcagatgtcctcattttaagggaaaactttaggaaatgtaattatatcgtttctttctctctaaatctgccttagttttcaatttctttatgtagttcgttactaagaggaagctacactctcattaccacactaaatggattttctattaatatttatctccaatgttatttttatctgggttgttgttttcatttctacttagtatgtattttcttctttccttttagttcagaggtcaacaaagtatggcctatgagccatacgctacaatagcagagttgagtggttgcaacagataccatgtggcctgcaaacctaaaatatttattggggcattttacagaaaacacttgccagtccttgctttagttgaccaagtagaaaaggaagagcagattctacagagtgaataaatatcaccagcaaaggaaaggatatagaaaggtacaggatttatacttaggctagctagaaactccatatggtcaaagtaagagttttgtggatgtgagtcatcagagattatataggaaagatagattactgtcagatttagaggatttttaatgccacttcaggaacttgagctactattgtttaggaaatgagtcatttaaggttttttgaacaaaggagctttgccagagcaggaaagtgttgcagtagggtttacaaagtaatgagagttatcaactaaagttatattaataggaaggatgacatagttccaggagttgctgtataattaaaattgataggaccttagacactgcattttgagacaaagagataatagtttaaagattaaaacttcattgggcagaaaaattattatttatacacatattagggaagtaaagagctaatttttgtggaaggtttaagttgatggagaaggattataacactacataggataagaaacaaaactgattactagttatcagcattactgaagttgttcactcatcccaggcacaggcaattttttactcgccatattttatctccagggcacccagctgccatcatcttgtcagggtccatctctttataaaatcctcttactttgctctccagaatcccaccctgatacacagatttacttacgctacctcatacagaataaagtacttccattttccaagtactctgaaccatgctcaagaagggctttagctctctcaaataaaaagacttatctcaaggtgtttaattcaagtagagccacagttccgaaactgtgcactgacaccccagggtactgcagcagactcacaagagtgctacaggatattttatatcggtttcaaaattaaattttgctacattccttttggatgatgtctttttaaaaaataattactgttgttgttttttttttaatatgtacctcctgaaaaatcaatgcagaatgggaaatgaaggtagcagtatccacttggaatacaaggcttgaagagtgtgcagtattccataagcatacatattcatttagtaaatacagttaacccttgaacagtgccgggggttagaggcactcccctcccccgggtagttgaaaatccatgtataacttttgactccccagaaactttactaagagcctactgttgaccagaagccttacctgtaacattaatcattgatgaacatgtattttgtatattatatgtattatacagtgtatttttgtaacacagtaagctagagaaaagaaaatcataaggaaaatatattcattgatatggtttggctctgcttccccactcaaatctcatctcgaattttaatccccataatctccacatgttaagggagggacctgttaggaggtcattagatcatgggggccatttcccccatgctgttcttgtgatagtgagttctcgtggaacctgttagttttataagtgtttgacagttcctctctcatgtgccctctctcgcctgctgccatgtatgacatgcctgcttccccttctgccatgattgtgtttcctgaggcctccccagccatgcagaactgtgagtcaattaaacctcttttctttataaattagtcagtcttgggcagttctttataggagtgtgaaaacggactaatacatttattgttcattaagtggaggtggatcatcataaacatcttcatcctagtagtcttcacactgagcaggctgaagaggagggtggggaagagctggtcttcctgtctcaggggtagcaggggtggaaatgatgaaggaggtggaaaggatggcagaagaggtaggcatactcagtgtaactttacagaaatacgttgtaatttctgtcttatttttcatttccctaaaaatgttactctaaaaatgtttctatatggcacctatccttccaccttttgcttttggttcagtgcccatatcatagaagggtccatgttgtaaaagaagtcaaaagcagtcttttgaataactggaatcattctgttatatggtctaatatgaatttgtttctggcactacttattctacatcttctttctcatcatctggcactgatttggaagcactcatctccatcaagtcatcttctgttaattcctgtgatatggtgtctgttagctcttgaattactccaagatccgtatcttgaaactcttcaacttccccccacttttttttttttttttttgccatatccacagtctcttttatgatatccttgattgactctgttgtaaatcctatgaagtcatatacaccattggacacagtttttctctagcatcaatttatttttttgggcttgatggctttcatggctacttttgtaacaatggcgttttccatgatttgattctttcagatatccttggtgttctctaagttgaggtctacttccatagcattgacaatcttttctatagattaccatgtgtaatgatctttaaaggtccttatgaccccctaatctagatctgaattagagatattgtgtttgatggcaagtagaccactttgacacctttgttgttgaactcctggtgtgggtgacccggggcattgttcaatatctaaagaaatttaaaagacagttccttactgacaaggtacttctttgtcagcagaagttacttctcctcttatccattttttgaagccaaacctctttctaaaaatgtcaagccatcctttgctgacattaaattctccagctttaaatccttcaccttccttttgctttaagttgtcatataatgacttcaagtcttactagagtatgcctttcttatagcaattctgtactcacattgtattttaaatataagataaaaagatattttacagaaacttcaaggttttcatgcctgctgtcgtagctgcagtgatggctccacaaagtcctcccccaaccacaatggtccttacactggattcatctatcttgaaatggtgggcaaccacagctgcagacctcaatctacggtacatatcaagcaagtcagcttttttttgtaatgatttttctctgcttcttgggagcacttccagcatcactagtgacatttcatatgggtcccatggtgatgttcaagatttacagtattgcactaaacatgatgaaaaataattcaagaaccatgagagatcactttttattgcaatatgcaatttactgtaagatgtagggttcactcagagatgattagcatcagatgtcattttcaatggatacaacacttgagctcactgcaaaagcaacaggtggtagttacaacgttgttacaatagtacagtatttactgcagttcattttatgcagttaggatttaatactgaatttttacatttgtttacatttctcttgactcaaatgctgccgtgtatggtctgtaagtgtttgcctgtgtaagttttgatagattttaactttttataatacatttttatagttttatgatagtgataaaatagtatctacatatactttatgagttcatgacatacttaacaatttttatcaatatttctaggctacacagtttgtctgtagagtatttcaaactatcacaaatttccaaaaaattttctgatatacttcttgaaaaaatttttacacacaagtggatccatgcagttcaaacccaagttgtacaagggtcaactgtattgtagttattttttaatgagattttaaaaacttttttcaatttatatgtatttttcttaactgagtattaaattctgaagctagtacttattaaattgtttggacttaacattaaacaggactgttaggcatttgttagcataccatgaaaaaatgaaaaaaataacaaaaacactaaaaacactgtaaactgggaaagtttcagattctctgaatttgagagagttgttcaactctaaaatgaatgcattcttccataagcatgtgaaaaggcagcagtctttcttttttctctttttttcaaaattgctttctagactgggcacagtggctcacacttgtaatcccagcattttgggaggctgaggtggacagatcgcttgagcccaggagtttgagaccagcctgggcaacatggtaaaaccccatctctacaaaacatccaaaaattaaccaggtgtggtggtgcacacctgtagtctcagcttctgtggaggctgtgaggtgggagaatcgcttgagcccaggaggcagaggttgcagtgagccgagatcgtgccactccactccagcctggtgacagtgaaatcccctctcaaaaaaaaacaaaaaaacaaatttgaaaacacattctagtgacatgggattttgtgtagcatcttaacaaaaatgtaatcacatatttaaaaattttctgtgctttttgctgtatcaaacaaaaaaagtaagaagtgctcttccctttaaggttatggtcaggtcagagtggtaagacaaatacaagttgcttatatcattaagtaaaataaaataattaccctcatttatttcataatatcacatattatgggcattcaaagaagaatgtgtacatctgttagtgggaatgaagaaagaatttgttagattttaaatgggcattgacatgttggtaaattctaacatgtagaggtagtggacatttcagatagaaggaaaaacataaaaactcaagatttattttgggagaagcaaattattctatatgactgaagcaaggacatatgttatgaagtaatgtagattacagctggtttactataagttggagtactatcgtggagcactttgaatgctggggtgtgaggcatttggattcaatttactaggaaaagaagagtgattagggtgattaatctgtcagcaagatataggatgattaaatcaaggagagaaaggaggcagggatagctttttaaaagggaatgatggattttgctttatgtatatgtatttcaaaggaaacaccaaactgttgatctttaaagagcatacttttgttcagcactgtaactaacagttgtaacataaaactcacttttctgatgggaggcagaagactttctaactttcttgttatttctagaggaataatatcaatacaatgtaaatatgtatggaatgcatactataggccaagaactatattaagcatttatttaattctcacaacccttgagagacattattattcccattttacaggtgagaacagtaaagcctagtaaagttaatgttgtccagagtcacatagttaataagtagacagattagcaaaaatttttaaaataagtttactagttggtttaaactaaggagaattgagttaattctccttgggtcttatcaaattatcttcatctgacttaggcatagtttctctctttttttatttttcatatcactcctgatctcttcccaccatgggtactcttaatgtgtttgatatggctcttacatttggatgtgtcctttaagactgtattgtgttattttagatgcatgcatatgtgtttaaattatacataatatataaaagggtaaattatagcttgtctgatttgatatatatgtttctactctattgcttttatatttttattttataagaaacacacatttttattttataagaaacaaggtcttgctattaatatgttaccaagaccagaatgcagtagttattcacaggtgtgatcattgtgcagatagccttgaactcctggcctcaccctatcctcccacttgagcctcctaaatagctggaactacaggtgcatgcagctgggcctggcttagtttactgcttttttaaaaataatttacaaataataattgtacatattcatggaatacattatgatttttttttttttttgagacggagtctcactctgtcgccaggttggagtgcagtggcgcgatctcgcctcactgcaacctccaccccctgggttcaagcgattctcctgcctcagcttcctgagtagctgggactacaggtgtgcaccaccatacctagctaatgtttgtatttttagtagagatggggtttcaccatgttggccgggatgatctcgatctcttgacctcttcatatgcctgcctcagcctcccaaagtgctgggattacaggcgtaagccaccgtgcccggcccataatgatgttttgatacctgtaatgtatagtaatcagacagggataaatagcatatccatcatctcaaacatttatcatttctttgtgttaagaacatttaatatcctccatctacctatttaaactatttaatatatttttgttaactaaatagtcatcctgcagaggtatagaattctataacttactcttatctagttgtaattttggtatcctttaacaaatttttccctatccttcctttccccctactttcccagcctccaatatcctctgttctaccttttacttctataagatcaacttttttttatcttctacttatgagtgaaaacataccatgtttaactttctgttcctaacatttcacttaacataatgtcctccagttttatctatgttgccatgaaccacaggattttatgcttttttatggctgaatggtttttctttgtgtatacattacacattttctttatccattcatttgttgttggacacctaggtttgttccatatcttggctattgtggatagtgctgcaataagcataggggtacacatgtcccttaaatataatgatttccattcctttggataaattcctagtagtaggattgctggatcatgtagtagttctacttgtggtttttaggaaactccaactattctccatagtggctattcccaccaacaatgtattaagagttcccttttctccatcctcaccaacatttttttttctttttgataatagccatcctaactggggtgagatgatacctcattgtggttttgatctgcatttctctgatgattagtgatgttgggcactttttcatatatttgttggccatttgtatctcttttgagaaatgtctgttcagatcatttacctattttttaataagattggttttttgctattgagatgtttgagttccttgtatattcttagtattaatcccctatctgatgttatgaatagtttgcaaatattttttcccattctgtaggttgtcttttcactctattgattgtttcctttgctgtgctaaagattttcagtttgatataatctcatttgtttatttttacttttgttgcttgtgcttttgaagttgtattcataaaatatttttccagatcaatgtcctaaagcatttcacctgtgttttcttctaggagggttatccttttaggtcatatatttagttctttgatcatttttttgagacagggtcttgctgtgtcacccaggctgcagtgcagtggtgcgataatgactcactgcagccttgacctcctaggctaaggcagttctcccgcctcagccagctgagtagctgggactacaagcatatgccaccatgcctggctaatttttatattttttgtagagatagggtttcaccatgttgtcgaggctgatctcaaactcctgggctcaagagatccacctgccttgacctcccaagatgttgggatcacaggtgtgagccaccatgcccagcctctttgatccactttgagttgatttttgcatgcagtgagaggtagaagtgtagtttcattcttctgcatatggctatccagtttgctcaggaccatttattgaacagactattcattccccaatgacaattcttggcacttttgtcaaaaatcattttgctgtagataatgtggataaatttctgggttctctatgcctttccattggtctatatgtctgtttttatgctggtaccatgctgtttgtgttattatagctttgtgatatattttgaggtctgatagtgtggtacctccagctttgttctttttactcaggattgcttcagctattcagggttttctatgtttccatacaaattttagaatttttttccatttctgtgaaaagtgtcattggtagtttgatagggattgcactgaatctatagatgtctttccatttatttgtatgcacttcaatttctttcatcagtgttttgtaatcttccttgtagaggtcttttatcaccttggttcagtttgttcccaagattttattttcttttctagctattgtaaatgaggttgcctttttgaattcttgttcaactactttgttgtttatgtacagaaacactactgatttttgtgtgttgattttatatcctgcaactttatggaattcatttatcagttctaagagttttttggtagagtctttaggctttttaatatgtagaatcattacatatgcaaatagggacaatttaacttccttcttctcaattttgatatggtttatttctttctcttgcctaattgctgtggctagtacttccagtactatgttgaataagagtggtgagagagggcatcattgtctgttccagttcttagaggaaatgctttcaggtttcagtaagatgctagctgtgagtttgtcatgttgaggtaatttcaacatgttattatgttgaggtactttccttctatacctaatttattaagagtttttatgaaggaatattaaattttatcaaaagcattttctgcttttcattgagatgatcatatgatttttgtccttcattctattgataggatataagacattcattcagtgacatatggtggaccatctttgcattcttgggataatcctcacttgctcataatctttttgagacactgttgggttcagtttgctagtattttgttgtggacttttgcatgtatgttcatcagggatattggcctatcattttctttttttgttttgtccttatctgtttttggtatcacggttatgttggcttcatagaatcaattaggaagtatttcctctgcttcatttttggaataatttgggacaaattggttttaattcaacagtgaagccatccagttctggactttttttttttttttttggtgttggaagactttttgttattaaatcaatcttgtttcttgtcattggtctgtttaggctttctatttcttctttcagtcttggtaggttttacgtatccaggaatgtgtccatttcctctaggttttcaaatttgttggcatatagttgttcacggtagtctctagtgatcctttgtatttctgtagtatcttttgtgatgtctccttttttgtttcctattttaattatttagatcttctctcttttttcttattctagctaatggtttgtcaattttgtttagaagccagctttttgttttgttgatcttttgtattttttttgtcttatttttgtttatttctacactgatcattattatttctttccttccattaattttgggtttagtttattcttttctagttctttgaggtttatcatcaagttgtttacttgaaatctttcttgttttttgatataagcatttattcctataaacttgactctgaatactgtttttgctgtgtcccataggttttggtatgttgtgtttctgttttcctttgtgtcaaagaatttttaaattttattcttaatttctttctttatccattggtcattcaggagcatattgtttaattttcatgtaatggtatatttctaaatgattctcttgttatagatatctaagtttacgccattgtgttcagataagtacttgatattttgatcctttaagaatattttgagacttctattgtgtccttacacacgattgatcctgagactgttgaatgggctgatgaaaagaatgtgtattctgccactgttggctgaaatgttctataaatatctgttgtatttagtctatggtgcagtttaactctgatgtttctttgttgactttttgtctacataatctgcccagtgttgagagtgggatgttgaagtccccaactgttatttcactttagatctaataatatttgctttacatatctgggtgcttcagtattgggtgcatatatatttacagttgttatattctcttgttggatcaatccttttataattatatagtagccctctgtcttcttttacagcttttgacttgaagagtgttttacctcgtataattatagctattcctgtttgcttttagtttccatttgcactgaatattttttccatccacttccagtctgtgtgtgtatacaggtgatacaagtttcttgtagatagcatataattgggtcttgtttttttaaaatccattcagctagtatgtatcttttaaatgtggaacttaatctatttacaatcgtgttattattgataggtgaggacttactcctgtcattttattgattgttttctggtggtttgtatatcctttgttcattactttctctcagtgttatttttgcagttgaatggttttctctagtgaaaaggtttgattcctttctccttctcctttgtacagcagctctatcagtgtgttttatagtttcacatattttcatgatggtgattattgtttttcatttccacatgtaagacccccttgagcatttcttgcaaggccagactagtggtgatggattcccttagttttgctagtctgtgaaatattttatttgtcctttatttctgaaggttagctttgctgggcgtattcttgggctaataatttttttcttctagtactttgactatattatcctgtcctctcctggactataggatttctgctgagaaattcactgttagtctaatggggattcccttatatgacttgatgcttttatcttgctgcttttagaattctttctttgtctttgacttttgacaatttaactgtaatgtgccttgcagaggtcctgtttgaggtgaatatatttgagctttctcgacttggatgtctctctgtctttctgttattatttcattaaatatgtttttctcacctttcccttcaccttctggagatatttatttgcttaatggtatcccataaatcctttaggctttttcattctctttttttttttaaagttagtctgcctgtgttatttcaaaagatcattcttcaagttcagaaattcttcttcttggtctagtctgttgtttagctctttattgtattttttatttcattcattaaattcttcagctctaggatttctgcttcattcttttttatgatatctgtctttgttgaatttctctttcaaatcataaactcttctcctgactttgttgagttatctatcggtattctcttgtatcttattggatttctttaagattattattttgatttttttcccacatttcatatatttccttatagtttggagtctgttactagataattattgttttccttttgacattacatgttttcttgctttttttccttcttcttcttttaagacaagttctcattctgttgcccaggctggagtgcagtggcacaatctcggctcactgcagcctctacctcgtatgctcgagtgatcctcccacctcaactccccaagtagctggaactacagacactcaccaatatgccctgctaatttttgtggtttttagtagagacagggtttcaccatgttgcccaggctttttcttgctttttcacggttgatgtgtccctgtgttgatttctatgcatctggtggaaaagtcacctcttttaattttatggaatagatttcataagaaagaatacgaatgagtcttgggttgttggtttggtggggtacattagccttatttctagatacagttttgtagtctctgagtaatttcttcagctgtaatccactctagtggcatttgtgagtttctcagtggcatgggctgagagagtttgtggcaatggtgatgccactttgccaggggtgggctcactagactgtttctcaggtctggggtatgtatgtgcacatagtaggtcagccaacttggttggtgagattggcttactgagactggggccacaaggctgttactctgaccagaaatacaagtataaggttgcttgggcaacctggggacatgcctgccaggagcagctttcaggtcggggacgtgggcttttggccacttggctggcttggagatattccctgtggcacgggggcagtctgcgggactatctctcaggccattattgggggtaaaggactgttgggcaggccaagggcgtgcctatgggggacctgtgtgtctgtttctcaggttctgattgcttgcaggtagccctactctgctggccctgggccatatcaccttctcagaggctcagggaggtctcctgcttagagaagggagcccagcagtttggccagcttaagagcaggcttgctgtgggtaggactggcagactggtttctctgttggtggtatggccatggttcttggttttcttgctgtgcaagaccagaataacagccagtccagggtccagccttcaccagcttggatcatggtgttcagaaacttgtttggagttggcataatgaagatggagccccagttctggagaggtgcagtggccactttccccccagaggagggcatactacacaggtggctattctcaagatgacgccatgttacagcagtttggctcacagtggtgggatggggagtacacaccttgtgctcttaatccaggtcagtgcgtctgcatgaattcctggcagctctccaaaatgggctcagggcttgtgaggactatgggattcttgtgtagtaaggccttcatgtgtttgtggtggcaaagaggctggtagggatcttctgctgacttttttccctgcaatagcaattccctcccgtctccaggcagatctgatctaggtggggaagatgggaccacgagtttgagtgcctctatgctgccttcctagatttccaatcaccacaggtgcatcttcattctatcagtgcaccccactactcttccttcacactccagtcaaatcttagctgtttgtttgttgccttgatcctttttttgtgtgtgggttagacaagcaccaggtatccctactcagccatcttgctgatgttactcctttattgcttttcttttcttttcttttctttttttttttttgagatggagtcgcgccctgttgcccaggctggagtgcaatggtgtgatctcagatcactgcaacctccacctccttggttcaagcgaccaagtagcctcagcctcccaagtagctgggactacaggcacccaccaccacacccaactaatttttgtatttttggtagagacgggagctcaccatgttggccaggctggttttgaactcctgacctcaagtgatccgcctgcctcagcctcccaaagtgctgggattataggctggagccactgtgcccaactcctttattgcttttaatctctgcatagtagtgtgtgtattagtctgttttcatgctgctgataaaggcatacctgagactgggaagaaaaagaggtttaattggacttacaggtccacatggcttgggaggcctcagaatcatggtgggaggcaaaaacagaaacccctgagaaaaccgtcagatctcgtgagatttattcactaccacgagaacagcatgagggaaaccaccctcatgattcaaattatctcccaccagtctctcccacaacacgtgggagcacaattaaagatgagatttgggtgggaacacagagccaaaccatatcagtgtgcattcaccacattctcatcttttcccctagaaatagacttctaggatttctcacactttatgttcaacagagctatataaatatgctcctatgtattcccttaaagcccatcttctttctactatatctttttcctcattttacttccttttttgagggagttatgtgggatagaagaaaaatggacttcttcatttataacatacctgaagttgggagtattttaatccttaaacagattaaaatgagctgggtgtggtggctcacacctgtaaccccagcactttaggaggctgagggaggcgtatggcttgagctcagtagttggaaaccagactgggcaacatgacaaaatcctgtttctactaaaaatacaaaaactagctgggcgtcgtggtgcatgcctgtagtcccagctacttaggaggcagaggtgggaggatcacctgagcccaggaggtcgagggtgcactgagctgtgattgcaccactgcactctagtctaggcaactgggcgagtctctgtctcaaaaaaaaaaaaaaaagagtaaaagatatgcagactatgtgattttctgcttccaaaaggaaccacatagacaggaagaagatccaagtgaattattctcttctatttctttacattgccttctgtcattggtaacataacctttatggcattcacaagtatatttgttctagctttcttcttttagtaattctgttgctgtcgtttgtgtgaaatactgcatattataacattgtaattataaatgatttatacattatcttaatcgttgtcagggccaacgtttttcttacaagcagataggaactatgctttgttgtaactcatatttgatcgactctgagaacaaaatgtattttatactttcttggagtagtcccacaaaacatgtaggacccattaagaggaagaaagcatgctatatggttgttatatttgttatttttgacttgtaatttattcattctctcagccctgttctctgactagtgttactatggcacctaagttatggcatggaaaacaagctaattatgttcttcagaacagacgacagtgatacatcttgagacacaagcatctggtagtcttagccctttcctcatcagtgctagtctaggcttggttgggctctctggttgtccaaatatttttctgttacaacacatccttctttattttatttttcttctataaatagtggtttatgctttctaaagcctctagtctcatatttagtttgttcctttttgagccttctgtctactcaaagaagtaatatagacttactcccagctgtgtatgatctactcttactcctgtttattgagttaagctttttactatttgtaaacatctcttggttgtgtagacacaaatacaccaaaactaaaaatggttaaattggggtgaaaacttacggatatttcttacaatttatttttcaaaattcagtgatgtagttagatggctctcctgataaaaattgtttaagagatatgagtaatcaatacttttttatcagaagtgacatctaaccatattaccaaattttgaaaaacaaagaaaatattagaattatccacaatttttgtacctaaacttaaccagttttacttttgtttattcccttataatcttttttactattgatttaatgtaggttataatcatactgtgtacacactatttgtatgtcttctatttaattgaatatttatgtgccataagcattttctactttactacttagttttcatcatcatcatcatttgtaatatctttaaaatattctctggagtggtgctattcaatagaaatataatttaaaattttccaggacccatatgaaaaatgtaaaaagaaacagcttaataatggattttatttaatctaatatatctaaaatatttattgtttcaacatgtaaaaattatataccgtattagacataaaaattattagattttaaccttcttttcatagtacatctttgaaatgtacctattttacatatataccagtgaattacgtcactaaactttcaatgtcaaaataaaatgtagtcctaccaaaacaataaagctccagcagaaaaatatgaaatgcttcaatttttacatttaaattaatgaaagtaaattaaaaatttagtttcacgatcatactagccacgttacttatgctcatcatgtacatgtagcttcttcatttaaatttaaattacatttaaaattcaagcctctctttgcactagtcacattttaagtgatcagtagtgagctttagagtatatagccaattcttgactgttcctctgtcatttttttacattgatttcaatgaaataagtacactgataagtttatgaatgtatattttcccatgttttggattactttcttaaagtagactctcagaagtagaattactgggtcaaagagtataatcaacccttcttcatcattgttaccatattgtttctttagttactagagaggaatatttctctacatatttatttactatgtatttctctttcaatggaatactttttaatgttatggtttatttatctattggtgtcctaatgtttgtttaatttttagtctacttttaaatttctttgtggactaaagatactaacgctttgtcttgtttttcctcatcttttgtttatttgtttgtttttttccttctgggagtaccaactgaaccctttacttttactatagcaaatatttagataatacttcctctgtaagcttcaaagtttttcccactctagaagtttgatatttacttctcttttatcatagattttctatgtatttttaaaaaatgtttttatcaaactggaatatatgattatgtaattgtgagaaaataaactaaattacaagttcttaaccttcagttgaatccagtgcttacccattatttttagataaagcctcattatatatagttgctgaccaccactgcatagttttacgcatatgtgtagttaatcaggaagtagatggacccaaatagattaaaatctactgtttcaaatatttcaaaataatatcatatattcttccctattatattctgatcagaatattgttctcagtaaaaacaaagtcttttttttttctatatcaccatgtatccacagttgattaattatagtcatggttattttacataggtttatttccttttgaattaatatagacttatacttccaagagttataaataactgaaatttacatagttgtgtatgcacacatacacatacacatacccctattcctcacataattggtaatagaaataatgaaaagaggttgtgttcttaggcaaggacaatttaaaagaaccccaaatgattaccttgaattaaggtaaacactggtaaaaaaaaaaagagcaaaaagggcaattttttcctttagtatattaaacaatgttgtttctaacattccctcacgtttagactactctgaaaaatccttagagtggttgtgtaatgtgtttaagttttttcgatttccaagcattaagtctggctccactaaaacggttgtttggttctattttagtctgtccctatctgtcctactgctaccactttgtgttgttttgttttctgttataatgaatacaacagtcccacttcattctcagttctaattaacgttatccagcctctaagtgttagcatctactttgcttttggttataggatcaacgataaacagctaactgttgtgcagactgaaatccctaattagtaaagcacaagattttattggttatatatttttctaaactatagacttgattttgttgcaaaccttacatgtagaaaaaaaattttgtaatggcactgtttttatttttggtgatactatagtctggaacatgtggcccagcaaaggttataaatctagcaagaaaaattatggatggcatcaattttaacagtctttgcgatctaacagagcataaaccccaaattgtttaaatactaaatatttacttaaagaaaaacaagagatcattcaaaaatagaatttaaatagtgaatttgccttttatttaaaagttgacaagttttgtatatttataaaattaacaaaattgacatcatactatccatatcacaagactcttgtgttgtattttaaaggaaaacacacacacagcatacatacatttggattggggccagatttagactccaggggcacagtgttctgtaccttaaattacaatcagatgtattttagcacagatcaaattttcagtctgaagttggtgagaagcctaattatttgaccaggttactatttatgtagaccattctgtggctggctgtggttaatccacagctggcagaatgctagctatgggaggtttttatttgatgctggaacagtttggggagaaatagagggggaaagctttaaaatcttctcattaaatgaaagactaaaaagcaagacagtacatccatattactatggagacaagatgctgtataaactgttcgttttaattctccaagtgacagaaatagcaaagcagcagcttggatgctcatagtttgcaagtgataggatacttggttaaaaaagaaagataaaaacatttaaaaataataactaagactaagatttgttgcctcttagaacacttgaatattggtaaagaattaatggattcaatttttaaatgatgagaaatattgttattatacaaaaacattttgtatttcactaaacatactaaaacatttagaatttcactagcagtactttaaagtgataagaggcagttgtaggggagaaaaagtaacatattttcctcatccatcgcaagggtcatgactgaaccctctgtaacgaaacagattaacaagagaaaagcataatttatttaacaaagttttacatgacacaggagccttcagaaattaagacccaaagaccagcaaaaactgtatttttatgcgaagtctgatgaaagacatggatagttgtagagaaacattagacaaaaggggtatgatctaatggtaataaacctagggttgaaggatgtggaagccagcaagtcctgtctgttagattattcttggccaccaggtataggacaggacccctttggaaaagggttttatggccagctttcacacagaaaggtgggagaaggtcagagtgaccttgcttctgcgggttttctcaattgctagggggccatattttggggtattgtattctgggccctgacacaattatagtagacgattctctcttaacgtctcagaatatgtataaaggcaataaacccttccttaaaagatggaccccaatacacatggctcctgccactaaattaatttttttagtcttcttattgtagtctatttgaaatttgaaagtaatattttaaaagatttttttttctttttaaacttttcagagtttgcattatggaaatcgttggtccctcagttataagtgaatatctcagtagcatttttgtaacttttaacagaagtttcttttatattttcaaggttatttcttccatttataagccagttcttctccccttctagtttccagtgctcccacttcctctagttctttgctctaattatcctctctcccttgcctcttcattcttctatttctccaatagatccttttctttgaaaagcaaaatctttccaactttccctgcccttaaaagcaaatctcttctttcctcccttccctgcccacccttccccgcaaaaaagcgtttgtgccttttcctcctcttattatctgctcaaattagcaacatatctggagtcatatgaatccaggcttcatcacatgtaagctgtgtgtcctaagaaacatctcttaacttctctatcttgctttatttatcaaaagaaactaatatgtccacctcataggtttgatgtaaggaaaaaacaataactgagttgctgtatagtatagtgcctgggacacaataattactcattacatttcagatggttttattatcattactgatgaagctttgaaaataattattcttaccttactttctcaccattccttttttaacaactacttctaccatcatactaagtgctttctgttaatcatcaaatcttatgacttttactcattcctttctttctctacttccccatagcaccttcttaaaatttcccttgcttagtttctccaccatcacttctcctctcctcatttggcctcctcttgttttctccttttccttttttatttcctctaatttttgttctccattttttccttcgtcgtcttttgttctgtgttctctgccttgggaattacaccacctctttgacctcacctctttcatgacctttcctctaagtccaactttctggtagatacttagagatcccttagaacctcaactgtagtatgaccacaactaaacactctttaccatctaagccagatcttattctggaattttccacttttattaatggtagaaccagattcaaaaatctcaatcatcttttgactcttttcttctttgccttccacatcttaaacaattgccaagtcctgtatgtagtactcctaatatggttttcttttacacagccaaatgtagacatttattaactgttgctgaattgttgctgcccaggttaactttgctttaaattttcccataagcttgttattccttcctttcacggaaatattcattacccatgatccacccctacccctcttgcacattgcccaccaaatagattcctaccctgccatccaaggccctttgtattcttaacttcgccgaccttttcaagtctctattattgccctttgtgtattcctttacttgtttgtgcaccatccaaactaatttcctgtatatacatgtatgtctttgcttatgctttcctctagaaagcatgaatatgttttaataagactttcattaatattaaagctgtacataaatagcattttaaatgcagctttcctgacatgaaattttaaagaaatttaaagaaaattttaaagaaaaattaaatatttttcttttgcattactgcattcttttctcattatttgaaaattctaattcagaatcttcctcaaaaatcaatttagatatttcttaaggtaacaagttatgattgattgattgattgatatagagacaaggtctccgtgtatttcccaggctggagtgcagtggtgtcatctcggctcacttcaacctccaccacctgggctatagcaatcctcccgtctcagtctcatgagtagctgggaccacaggcacacaccaacacacccagctaatttttgaaatttttgtagagacagagttccgccatgttgcccaagctggtttggaactcctagactcaagtgattggcccaccttggcctcccaaagtgctggaattccaggtgtgattcattgtacccagccagaagttatgatcttaattaacagattattttaaagtcacttataagaatacaaactcagccaggctcagtggtgtgcacctgtaatcccagctacttggagggctgaggtaggaggattgctttatcccaggagttcaggaccagcctgggcaatatagtgaaaccttatctcaaaaaatatatattccaaactgtttgtaagaagctaaaaggattcagtttgccttcatagtacaatttccctaattcgaatgtaattattgtcttgaatgagacctttcaaacattttttctttcatgaatttccagaattctttagtattgagcatataaacctagtatgaaataagtaatgctttattctctgaagtaatggcatgtatcaagcatatggtactcatatgatcaaatatccttccagtcaaatgttgctattttctgccttgcatcttataattgtattttatatacttttgtattttgtataggtttcttttattctcactgagagtgactgtggagatggtatttctaattttccctccttttttcttcatccagggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagtgagttacctttcctttttcaaaagaacctgggggttttttgtttgtttatttctgatgtgtgtatatatgtttagaaatatataaattaaatcctaaatttttgtgtaaatgtccttgagaattgtgcaacaaaattgcctcaatgtcaactgctctcagtattttcaatatttccttcagtatatactaacttctttcttagtgaagcatttatttatttatttttatatttttatttttttgaggtggagtttccctcttttcatccaggctggagtataatggcatgatcttggctcactacaacctctccttcccgggttcaagcagttctcctgcctcagcctcctaagtagctggggttataggcgcatgccaccatgcccagctaaattttgtgtttttagtagagacagggtttcaccatgttggccaggctggtcacgaactcctgacctcaggtgatctgatcgcctcagcctcccaaagtgctaggattacaggtatgagccactgtgcccggcccaacatttatttttttaaggtgtttgacgtttgatttacttatagtaagagtcatcctttttactgtaatttctgtgagtttttacagatggatacctgtcctgttactatgaccacaatcaggataaaaaagcacattcatcacttttttaagtctcttcagagtctaagtccatttgatatttgtttaataaattatgagtaaattttgatatattacatttatatttctttattaataatatttttaaaatattgtctgttatagttgaaggtgataaaatggaatttcatctcaacaagtacagttttttctttctaccaagaatgtattttcttccattctaaattatggaaatgcttatttacttaaatgcttatttactttgattgcttgtttactgtttatacctcttatttactgtttatacctctttaaaaatccatgaaagaggaaaaaatccttcagtgtgtcttcctatgacttggccatgtcacttgatggtttaatgtatacaatgaaggtattgtattaatcatcccagaagttcattctgattctaattccatagttctaacatagtttgaatatattcatcaattttatatctaataactgccatctgcctagaataacataaaaattgacctggaagtttacgagatcacctgggtaaagattaaaggatgatccatagaaataatatcacagtgtatctgcaaaggtgatggttacattggttataaatggtgacattggaaggaaatgctatattcttgataattcacaaattgagatactggcaagaaatagtggtaatagccaagtgccatataactgctagaagcctaatttgactaagatctaccatttagtttttccttattaacagttttattttgtaaagggtaaaagaagtaaatgggaaaagtgctattcaagccttttgaataacattaaagcattggtctcagtagtcttgagaatcattgggagaagttaacatttggtctcagagttctaaatagtcaagaaagatcagactggcagcacttaaataagttctctagagtttaagagacaaatcttaaaacttttaaaaaagataaatatgattccaaagaggccgggcacggtggctcacgcctgtgatcccagcactttgggaggcagaggcgggtggatcacgaggtcaggagattgagaccatcctggctaacacggtgaaagcccgtctctacttaaaatacaaaaaatgagccaggcgtggtggcgagtgcctgtagtcccagctactcgggaggctgagacaggagaatggcgtgaacccaggaggcggagcttgcagtgagccgagatcgcgccactgcactccagcctggacagagcgagactccgtctcaaaaaacaaacaaacaaaaaaaaaaaaacataaatatgattccaaagaatgaaactttggaagtaaagaaagcttagggagattgaatgccataaaaaatgctatttggactttatagtcacaaatgatcttaattaaggagagaatgtggagggaccttttgaaaaaatatagcagagcacgcagaaaactctttaataagagctcaaatttggaggataacgagatagctgcctctgcctttgccggtgcagtgagagcagcttcaggaatcttatggcctctgaatattttggcatcttcagcctaccaaaactgtgtcaaaaatgcctctcttatttctgcattgtccactggacgttttagtcatattcagacaccagttgtttcctccactcccagacttaccacatctgagagaaacctgacatgtgggcatacttcagcgatccttaatagagtggccctcttgcttccaagtgtcttgaagctgccagccagatctctaacatacgtcagtacaggaaaaggcaagagaaggattgtgaaagctgtcatctataggtttcttcgacttcattgtggcctttggatgagaagggctggttataagaaaaaattatggaaaaaggcacctgcaagaaaaaagcgattgagggaatttgtattcggcaataaaacccagagtaaactcttaagataaaatgacgacgtccttctggaagaggtgaaactggtatgtccatgatccttatcagaagtgtcatgatcgaacaaacctgaaagtatagatcagaagtttcacttgtttctcagttattgaatatgtatctttgtgtacatatctgcaaaaatggataagtaaaaatctcgatgtaaattgtatcaatgaatatgtaaacatacagtgacaacactgaacttataaaagttttaaaacttaaaaaaaaagctcaaatttgtaaaagacatgtaaaaagaaggtggaaaatgtatttagaatcagggaatgatgctaaaagtttggtagagacaaaagagaaaagaaagtcccaaaagtggtttaagtttgcagcagatgctgatgatatcaaaacaatcttcacttaaaaaaaaaaaaaagactccaaagtacaagcaacaaatggaaaaaatagataaattagacatcatcaaaattaacaatttttgggcatcgaaggacactaacaagaatgtgaaaagacaactagtggaatgggagttaatatttgcaaatcatatatctgataaaggattcatattcagaatatttaacacagtaacaactcaacaataagcaaactaacaacataattcaataatgatcaaaggaatttaataaacatttattcgaagaagatatacagatggccagtaaacacatgaaaagatgctcaacataaccattcaagaagtgcaaatcaaaaccaaaattagataccacttcacacccatcagaatgacaattgttttaaaaaatggaaattaacaagtattggtgaagatgtggagaaattggaaacacttgtgtattgctggtgggaatgtaaaatgggaatgtagaagacaatttggtggttcctcaaaatgttaaacatagaattattaccatatgatctagcagttctacttctaggtatattacccaaaataactgaaagcagggactcagataattgtacaccaatgtccatagcagcattattcacaatagctaagatagaagcaaatcaaatattcatcaacagatgaataaacaaaatttcatgtatatatacaatggagtattatttagccttaaataaaattttgatacatgctacaacatgaatgaattttggaaatactatgttaagtaaaataagccagacacatcagacaattattggattttctaagaagaattccacttacaagaagtatctagaataggcaaattcatagagacacatagtaggatagtgattacctgggagtggggtggggaggaatgaggcattattgtgtaataagtacagagcttctgtttgggatgatgaaaaagttctggaaatggatagtggtgatagttgcgccacactgtgaatgtatttagtgccaatgaattgcatacttaaaatggaaaattttatcatatgtatagtttaccacaatttttttgaaaaagttttattctacaaatcagtaaacttaaaagttggatcacagcttagcatagattattaaaggaattatttttccccacctagaagaggaagtggtaaaactgtaagctgctacgtggctgtaagtcatggggcaagaaaatcttttctcttttggtatgattattgttcatttgaattcgcttcaagaggtatttatatagtacctaagtacctattatggcagaccaataagcagtggatacatagtatattttagaacatctgtcattacgtggactatagaataataaagattggctataagacaattagaggtatttggtattttattgaagcagtctcaaaaggtctgttgataaataaattgatttctaggggtacgcctcagtgtttaccctgcctttgcttaagtaaacagtgatttagataaagctatatttgcatataattcaaatgcaaataatacaacaccttaatacatactaggtaagttgaaggtcaaaatcagatttttttaaatgttagtagactctaaatatcagttgagtgatgaaatttaatagggataataaaaattatatcgtatttgattataaaaagcaagtagagtaaaatgctttatccctttaatctcatcatccattgtttttctccttgaatactatagtgataatgttatcttcagttttccaggaaaaaagagacattttacttctaaaatgtgacgaaggataaaatatagttatcagagaatatacgtaggattctttaatatttcccccctcaaaaaaataaagtatactgtgtttagtataaatttttaaaatgtcaaaactcagctaaaatcaaacacacttggcccttattttctacatgtcaccttcctcttgtcagaggattgtacagtagtaatgatgatttaaaacttctgatagcctcaatatttaaaaaaaataataccttgtccacaaagattatttcttcacaggcaatgatcaatgatccctgtgagacaagaaataaataagataaacctgatgattaccccagctaactccttggagataatttccaggcaacagaagaaaggtaactaaggccaagcacagtggctcacgcctgtaataccagcactttgggaggctgaagcgagtggatcctttgaggtcaggagttcaagaccagcctggccaacatggtgaaaccccctctctactaaaaatacaaaaaagcctggcagggtggttgtgcgcctgtaatcccagctactcgggtggctgaggcatgagaattacttgaacctgggaagcagaggttgcagcgagccaaaattgcaccactgcactccagccagtgtgattgagactctgtctcaaaaagaaaaaagaagggtatctcaagtagacccttgcagtctcttttaatgaggagttggagccggaagttcaaggagtctaagacagctagtgtttgtaagttaaaagtaccagagaagaaatagctgaatagagggagaacacaggacatttgcagaatcccaacaagtcttcagctgagtatgaatcagtgcatttttgtgaagaaattaaggaagaccacaaaaagaaccacctaaaaagattgtagaagacaatcctcagtgcacacatgaggacctataaccattcctatcctactagtcagagtggataacctcgtaattcacgaggcttcaagtagagtattaaaaggaattttgtctcattagcaggttaaaatcagctctagactagatgttctggtccctcctgtcaatattattacaatatatttgacaacctttatgaaatggacaaatttgttaaaagacacaaagtactaaatcatactcaagaagaaatagaaaaagtctgtttagattattaaagaaattgaatttgtagttaaaacccttgctacaaagaaacttcaaaggctgaattgcttcagtgtttaattcttttctgtttgtttgtttgtttgttttgagacaaggtctcactctctcacccaggctataatacaatggcacaatcatgtctcactgcaagctcaaactcctgggttcaaatgatcctcctacctcaacctcccgagaagctaggacgacaggtgcaaaccaccacagctggctaatttttaatttttgtagagaggaggtctcgttttgttgcccaggctggtttcaacctcctgcactgaagcgagtccttctacctcagcctcccaaagtgctgggattacaagcatgagccactgcacttggcagtgttgaattttaacacagatttcagaaagatgtagtaccaattgtatacaaactgtcccagaaaattgaagagggagaaatatacctatcttatttcatgaggtcagcattaccttcataccaaaaacaaagtattgcaagaaaactacagaccaatatccctcataaacacagatgtaaaaattcttcaaataattttagcacatcaaaccgaacaatatattaaaagagtaattcatcatgactaggagtgtagaattggtttagcattttgaaatccatcaatgtaattaaatatgttaagactaaaaagaaaaatcacatgattatcctaaaagcttttgaaaaatccagacatctatttctgttaaaagccctcggaggctgggcatggtggctcatgcctgcaatcccaatagggattggtgagggtcaggagtttgagaccagcctggccaacattgcaaaacctcatctctactaataatacacaaaatagcagggcatgttggtgggcacctgtaattccagctacttgggaggctgaggcaggagaatcgcttgaactggggaggcagaggttgcagtgagccaagatcatgccaccacacgccagcctgggcaacagggtgaaactgtgtcaaaaaaaaaaaaaaaacccttggaatagtagaagcatgaaaaaatccagatttagaaagaaggaagtaaaactgtctctattatcaaaagcatgatcatcttcatacaaaatctgatgtcatcttcaaaaagctattagaactggctgggcatagtgcatcacgcctgtaatcccagcactttgggaggccgaggctggtggatcatttgaggtcaagagttctagaccagtgtggccaacatggcaaaaccgcgtctctactaaaaatacaaaaattagctgggcatggtggcacacgcctgtaattccagctacttgggaggctgaggcaggagaacccgggaggctgacctgaggcaggagaacccaggaggcggaggttgcgatgagccgagatcatgccactgcactccagtctgggcgacagagcaagactctgtctcaaaaaaaaaaaaaaaaaaaaagctattagaactaagtgacgtagcaagattgtagcatacagaataaaaaatttaaatctcaaatgtatttttctatattagcaagaaacaaccagaaatttaaaaatacgatttccaataccatcaaaaagtataacaaagtatttactttgggataaaccagaccaaagatgtatacactgaacactacaaaacattgttgaaaaaatttaagaagacccaaatgggagatatatcatgttcatagattagaagactctgtattgttaaatataaattctactcaaaataatctatagtttagtgtaattcagtcagaatttcagaagttttttttaaagtcaagttgattctaatatttatatggaaaagcactggactagagtagccaaaccaacgtggattttaaaaaccaaatcagaagacctttacatgatttgaagacttattacaaagctacagtaatccagacaatgtggcattggtgtaatgatagacaaatagtcaatggaacagaagggaacgtccagaaatagacctaaatttatttttcaacaatgtttcagaggctttttcatggaggaagaaaacagtctttttgacaagtcgttctggagcaattaaatatccatatctaaaaacgcaaacttcaacccacgtaacaaacaactgcacggctattagaatgtctgaaagtgtgaccataccaaatattggtaaggatatatggagcagctagaatgtaaaatggtacaactactttggagaatggtgttcttgtttcttacaaagttaaatatacatcctccaaatgacctagctatcccactcctagatattcacccaggacagatgaaagcatctgtccatgtaaagacatacacaggtgtttatagcagctttatttgtaatggccaaagtctggaaaacaaaccaaacatccacaactagtaactggttaaacaaattgtgatatttccatagaatagaatactactcaactataaaagaattgtactattgataagaaatgaaccaacagcatagaagaattttagaatacctatgctgagtgtaagatactgtaaagtacattctatatgattctatttatattctagaaagtgctaacaaatttatggtgatggcagatccattgttgtctggggacagggttatgctatgaggcagtgatcacaaacgggcatgaggaaacttttaggagtaatagatgtgttcccattgaggttgtggttgcagtactttatacatacgtcaagttttatctaattaaacacttttagtttgtgcagataattgtatgtcagttatacctcagtaaagctattaaaatgaatatatactttgattccatttatatgtttaaaagtaggaaacattattctaaagccattaagttccaaaaatacactgctaaaatgaagaagtgccaatttgttattttttgatcaccatatatgaaacttctgttatttccatggaagatccccttatatttaagtagcaatgtcaagccagaggaagagtgttttgatagtcctgggttctaatcatgacaactaaaaattatcataacctaccattgaataatgctttaaagttaaaaagggtattcacaaaaaccgtcatttaatctacaaggcaattccatgtgtttttctaatgcatgtaaagtttcagcttggctcatggaatatattctcaatttttgttaggtaatgttggtagtagttttaggagtattgatcatgttatctattaagtttcacttcactttaacttgctttgataactcacactcttcattcattcctgttaaaacataatgaatatagtaccaagtgcatgagggaaaactcacagctattgggctgctctctgctataccaccttacttctgttccaacaaagttatttgcttacaaaagttaattatgtttttcctaaacttggtgaaatttgtgttcattatttaattatttaacattatatattctgatgaaatatgaatgcaagtagaatgagaattagtttaatgagttaaggttggttccaaaactaaatacatatgagttatttttaatgttgctattgaattggatgtgggcatgaaaagtataaaagattaaaggcagtaaaaagctgtaaacatctgtattcaggagtgcttcataggtgtttttatgttttctctctgctttaaagaagttgaaactaggccaggaaccatagcgcacacctgtaatcctagcactttgggaggttgaagtgggaggattgcttgagcagaggtgttggaaaccagcctgggcaacatagttggaccccatctctccaattattttcttaaaattagccaggcatggtggcacacacttgtattcccagctattcgggaggctaaggtgggaggatcgcttgcacctgggaggttgaggctgcagtgagctacgatcatgcaactgcactccggtctgggtaacagagtaagaccctgtctaaaaataaaatttttaagaaagtaaaatgagaattcataaactatgaattctagatgtggttctacaagaaaaactctagaatgtcagtctgtaggcatgctcaaaggttttgaccctatttttttttttttttttttgagacagagtcttgctcttattgcctaggctggagtgcagtggcaccatcacagctcactgcaacctccacttcccaggttcaagcaattctcgtgtctcagcttcccgagtagctgagactacaggcgtgcacaaccatgcctggctaatttttgtatttttagtagagatggggttttgccatgttggccaggctgattttgaactcctggcctcaagtgattttgaactgcccacctctgcctcccaaagtgctgagattacaggtgtgagccccccacccagctgaccctattttaaatattagcaaatgatgtatctttatatattaaaataaaatgtttagattatgaaagctattttttgttcccttaatttaatcatcactctgatttatttatcaactactattccttttcctcatctgtaaattgaggggatttgcatagaaatactagataatcttttaaattttttcttaaagcttaaacatgttataaaactgatgattcattttttttccacattctaagattaatactgttagattttattataaattaataaagttcctcttttaacatgtaaaataatgcctgacatttcttttaggtagttctgattttttattatgagtgtagccttaactgtagtgcctttgaagctgaattctccccatttgtgaccccagtattccttttttgtttagtgaacctaggggaaatgatatttctctccaaaaaatacctgaaaatatttggttagacacgtgctgggacaaaaagtgaagtatccacagtaataccattgctatgttcttgtgatataaccagattataattactaaatgatacaatttactttctttttttaattctggtaaaaaaaaaatacacaatataaaatttagaccattttaactatttttaagtgtacaaatcagtggcattaagtacatttgcaatgttgtacagccatcaccactattcctctccagaactttttttttttttaatcaacccaagcagaagctctgtacccattaaacaataactcactatttcctgtttcctccttcctcctcacccttggtaactgttttactgtctatctatgaatttgcctattttaggtacctcatacaagtaggatcatacaaaagttgtctgacttaatttcacttagcataatctttttaaacttcatccatgttatagcatgttatcagaatttcatcttttttaaggctgaataatatttcattgtatgtgtgaaattttgttttttgcttcattttgttgatagacatttaatttgtttccacctttgattattatgaacaatgctactgtgaatgttaatgaacaagtatctgtttgagttcctgcttttaactcttttggatatatacctagatgtggaactgttggatccacaacaggtacaccattttacattcctaccatcaatacacaagggttccaatttctccacctcctcaccaacacttattttgcatttaaaaaataatagccatcctgctgggcacgaggtggcatctcactttggttttgatttgtgtggtttactttcagccaaggttcagaaatacatagtgacaaatttctgtttctttaatttaaaatctttggtaacctgttacattgcattttgtacttttaaattacacatctgaattgattggttatccttgttaaagtagttccaaaattactgtagtttaaaaactctttaaatattacattgtagttttaatttgtttctgacatcttcaaagtttgaaattttcccttcagcaacaaccatttgttagctacattcacacgaaagcagcttaataaaggacattctacacaaaggtaattataatccattgatgccccttaatgcaagctgctttgtagtcattatctagcagtagatgactaaagaacttgattattcttgtttttcatttttattaaattaagaaggtttttttaaattatgtcattttgcaaatggttcttaggagtaatgcctttcaaggctccataatcactagataattaacctgcaaggattaagtacactcaactttgcctcaggatgcttaactctcaaatacagtcaattatctcatgataataactgctttgtcaagagttaccacttaactccacagtgaaaagtcaaatcacccataccatgcactttaagatagtttcaataataaaataacagtttgaaatggggcagaagaattcagttaaattttttcatagggataagaatgatatgctttagataaagctccccctcatatctagtattttgaatttcacaaatgacttcaatttataaagataatataggccaggtgcagtggctcatgcctgtaatcccagcactttgggagaccaaggtgggcagatcacctgaggtcaggagttccagaacagcctggccaacatggtgaaaccccatctctaataaacacaaaaattagctgggtgtggtggcacgcgcctatagtcccagctgctcaggaggctgaggcaggagaatcctgagaaccctggaggcggaggttgcagctagccaagatcacaccactgccctccagcctggcaacagagcgagactccgtctcacaaaaaaaaaaaaaaaggtaatgtattgctctgcttcatcagtccttttgctggcagtgttcctgcattgcaaattttcttataggaaagccattttgtctgttaacctcacagaggattcaatatattaaaaatctctaatatacaccaagaaaatggaaattactttctttacatattgatttaacttttaaaaaatctcgtttatcaacaaacgaattacaaaacagtgagcaaaattctgcagtttgttgtggttgttttttgttgttgagtagcttcactcatatttggacaggatatgccaaaaacagaaagactgctagatagatcaggacattttgaaagaaaatataaaaatgtctttaggtttgttatccatgtcctctaagcctgaatgatgcttgtatctctttataagtaaactatcattatctttttactaaaccagatgggatacattggctttttcttctgttatatattttactgccatggggatgggaagagactttattgatattttgtttacacttttaaaccctttttaatgtttctaatagttaattaataatttgaaaccatcaattctttaaattgtaaataactttgatacaggttatcttatttttcagtttctatacttctgtaaaatagaagtcatttgctcttttaagataaaaaatctgtgtgaatctatgtgtaattatgtacaccaaatagtgctatacatgcatacaacttctttcagatattcttcttttggttaagagcctttttttctttgtaaaggtattattttaatttttagaactatttttctgtgcactggagcacatgtttgggaggaaaaaagaaactttctgtcaagtccctatacacagagaattcttgtttgaatttttaaaaaattttgtcaagtctagttcttttatttatttatttattatcagttagagacagggtctcactgtgttgtccaggctgttctcaaactcctggcctcaagcagtcttcccgccttggcctccctaaggttctgggattacaggcatgagcgaccaagcctggccaagtctaattctttaaaggatgtgatttccaagtatttccaggaattcaagactgttacctagatccgtattctgacaaaagagatgatcttttctttcttcatatcagaatatttcccccatgaattgagggaaatggggctgtatctaaaaatggtaactctgccctttaaagtatacagaagtgccctgtttcttcctaagagaggtggaagtcccctttctgagactgtgcatatagatctctttattcccctttttctgctataagtgataagaggggctatgtagacaaaatgtaaggttgttataaaatcatcaaggaattgggaaagaaactttatcggaggatatacataaccccttcagaaaaaaaaacaaaaacttatggtgctttttggaagaaattctgacatagttgtattttctgagaaggataatgaaatttcagttaacatggaactgtaacttcgtaaaattgctgctcagctcctagatttaactttctccctagggtttttctaatatatttactcatctgaaaaaagtgagattgactgtagcacaagggagacttctgatgtcagtggcatgttgtaaagatgtgctatgggaaagattcagaaaatgcaaaggctatttaactatatgctctgcatctctcttcctttctacatagctctctcctttctttcttactccttcgtctccctctttacgccaactacattgcctctctgaagatgaaatgcttttaaatcatccccaatctaacatccatcactggtaaaaagccatctaattattatgtgttgatttttaaaaattaaaaaaaattattagaaaattaagaagagcatttaaatgtttttaattgcaaggagaaaataaatacactcaagtaaagaaaaacactgtgtaatttgaaatagtttgaattactacggagataatcatattttatgcagtaatgcctttctattttattcactatttctattaatctttatttgtttcagttactgtactataaatttgtaagtgattattttggtattatttgtatagtatgccataatataaaaataatgaaaaatattaaatatatatttaatgttcttatttaatgcctttaattttttttttctttgagacaaggtctcactctgttacccaggctggagtacagtgatgcaatctcggctcactgcaaactccacctcccaggttcaagcgattctcaagtctcagctttccacatagctgggattacaggaatgcgccatcacactcagctaatgtttgtatttttagtagagatggggttttgccatgttggccaggctgatcttgaactccaggcctcaagtgatccacctgcctcggcctcccatgtgctggggttacaggagtgagacacctcacccagccaaaaattattgtttattaaaaatcatttaatgacattgacatccttataaataaaaactgtaaatttatatcacagtagaaaaagtgctagacctaaatttagaaaacctgtcttttatcctagctcttgagtttttcacagagaaaataggagtcaagaagccaaaattctgacatgagggaaataattagcaaaatttaaataggtgccattgattagtcaatggtattttatcaacattaatttttattttattatttatttatttattttgatatggagtcttgctctgttgcccagactggagtgcagtggcatcatctcggctcactgcaacctccaccttccgggttcaagcaattctcctgcctcagcctcctgagtagctggggttacaagttcctgccaccatgcctggctaatttttgtattactagtagagacggggtttcgccatgttggccatgctggtctcgaactcctgacctcaggtgattggcctgccttggcctcgcaaagtgctgggattacaggcatgagtcaccgcacccagcttaacattaatttttttagttttggtaattttaatatggctatatagaatgtttacatttggaaaaatcctaatatcctttttgactgatccagatccagtccaggttgctcacattgcatttagttaccacatttccttcgtctctttaatctagaatggttcttcagtctttgtctttatgaccatgacaattttgaagagtcctgactggttttttgtagaatgcccttcagtgtggagtttcctcatgattaatacattttttataggaataccatagaaacagcctgggcaacatagcaagatgctgtctctacaaaaagtaaaattcaccaggcatgatggcacattcctgtagtcccaactacttgggaggctgaggcaggaggattgcttgagcccaggagtttgaggctgcattgagccatgattgccaccctggactccagcctgggttacagaacgagaacccccacacaccccccccccctaaaaaaaaacaacacaacacagaaatgctattgtgtcttttttcatgcgttatactaagattttagtgtgtttcgttactggtaatactaactttgatcacatggttaagaaaatgttggcccagtttattcacttcaaagttactatttctggccaggcatagtggcttacgcctgtaatcccagcactctggggagccaaggaggacagatcgcttgggcttaggagttcaagaccagcctgggcaacatggtataaccctatctgtactaaaaatataaaaattagctgggcatagtggcatgcacctgtagtcccagctacttgggaggctgaggtaagaggatcgcttgagcccaggaggtcacatggtgaccttggaagcaaatgctccctcaaacacgagatgactgcagccctggtctacatctcagttgcagtcttgtgaaatcttgagtcagaggcactcagctaagccatgcctggattccttttcctggaaactatggagataataagtgtttgttattttaagtcactaagttttggagcaatttgttacacaataataactaatatgctgtgaaaaacaaatttactaagagctcaatatctgtgtacaattttttttgtctttagccttttgtgtatattgtcaaaacacaggcttttagttaaagttagttcctttccccttcaagtattttaattttttttaaatatgtgaaacatttatatggttcttaacatcagaactatatgaaaaggtttactcagtagtgtcgctcctcccttatccctcatcttcctcattccccattctgtctctattcctaccctgtttcttcctacctaccctctataaataatctcattagtttctggctcacatttctaaatttcttttagcacaaattagcagctaaatgcatattttactgtatcttctttgttacatgaaaggtagcacactatagatagatcctctttgaacttagctttttttcaatcaagtgcatcttagaaatcattccataaaagctcatagagatccttctcatttttaattttattttagttatttatttatttatttatttatttttttaatgagatggagtctcgctctgtcacccaggctggagtgcagtggtgcgatctcggctcacagcaacttccacttcccgggttcaagggattctcctgcctcagcctcccaagtagctgggactacaggtgcctgccaccacccacggttaattttttgtatttttagtaaagacggggtttcaccatgttagccaggctggtcttgatctcctgtcctcgtgatcctcccgccttggcctcccaaagtgctgggattacaggcgtgagccacagcgcctggcctatttcatttaaaaaaaaaaaaaaaactgagacagggtctcactgtgttgcccaggctggtcttgaactcctgggctcaagcaatcctcctgcaatccttctgccttgacctcccaaagtgctggtattacagacatccagccacaataatcctcatttttttagttggattttccccattgtgtgaatgtaccatattttacccagtcactctcttatgtatggacattaagactgtttccagagtcttgcacttaaaaacaatctttcaatgaataatcttgttcatacatatttcttgggttgctagaggtatttcttcagagtaaattccttgaaatggaattgttgggtcaaaggataagtgcatataacgttttgttagatgttgctaaattcctctccaaaataattagaaatgttttcattctcagcagtagtgtaggtgaatgcctgtttttaatggggttattttaatatttggttatcaattattaagcattgctatcaaatggaattcactagaagcatgtaaaattctagctttatttcaaatacttagttgaaccagccaattcattttagcacagtaaaagtaatccaagaactaaaaagtgatcattctttaaggtacagattttaaagactcttttatcttttttttttcttttttttgctattttatcagacacattagaggaatatgaattaatccccattatacactctttagtttcattttctggccctgtattttcatcttatacttctctcctacaagcacctcttcctttctcctgtactgcctaactattcatgttttcttatcatcaatactcatttcatatattccctacctcacattctccccttctttccctcccttctccactcccattcagttggttattttataaatgtgattctgtgatcttgtgtatataattacaatgcttacatgtttcttttacactagaatgtgttcctttacagcagtgactttcattcttcactacattctggccacttgattggtgatcactttctgaccggaagttccaattatttaatcacaaagttggactttctggtgaccacttcccatcctggggctgacagtgagtcgccccatcagcataacaaaggcacttttaacaatcaggaaattctgagggtttttgaagctctgtgctaggaatccagacaaggacttgatatattttttactataccagtttaagggttaatgataccatgtaacaactttattaatagattactatttatagaaacttgataaatgtggtgggaggtggtgcagaatcatgtgatataatcaattataaatgaaagcacagataaaatttgaaataataagagagaaataagaatgaaggttggccacggtggctcacacttgtaatcccagcattttggggggctgaggcgggcagatcacgaggtcaggagatcgagaccatcctggccaacatggtgaaaccccttctccactaaaaatacaaacattagctgggcgtggtgatgcatgctactcgggaggctgaggcaggagaatcacttgaacccgggaggtggaggttgcggtgagctgagatggtaccactgcactccagcctggggacagagtgagattctgtctcaaaaaataatgaaaaccgaggagttttttctttctttctttttttttttttgagacggaatcttgccatgtcgccaggttaaaataaactttcaattctcttctcttgaatatctctcacccaacaatgtttttttcatgttgatcactttactaaagcgaacaattggggttttaccaaaattgtgaaggattttattcttccatacttatgtctgtgttcagggtcatacagattctactttttccttttagtttaaggtattctcttggagatttaatgtacttaaatttgaccacaatttattgagagcatattctgtgtcagacattgcactctgcactagatattcaggaatttctaaaaagaatgttaacattgctgttacatagtcagttactgatcacattcttttcctctcaacttttttcaaaataggaatctgcggtatgttttcacgtatggagttcaggtcaggcttaggggtccctgacaatgtgaatagttttaagctgggcctcaattcgtggtacccttatactaatttaacaagccgtggactctaggttccaccaaaaatattttgttccatcctctctggtttcagtccatggtgtacagaaagaaaactaaggaacttcagccccaaattgtcaaattttgctacttaagaaacagaagatttaaatctatcattttgtcttatattccagagttgactggttcctcctgtctttaacttcttgtccttgaagggtattctaattttcattcagaaatatgacttctcatagggtttgtgttagatattttcagggccagatggatatgatgttcccatttctgttttattgttaaactactattccttttgagctgtaatgaacaattcattctgagaggcaatatatgttttcagtaattgacttgaataaaagtaaatgttaaacatggagttactaagttaatacagtgggtattagtactaatttgttcaaattaagatagaattcttaatttgataaatagaattcttatattacagcatcagtccaattggattgatagtttgtagaaaggtaatttcttacatgaggaaagacaggttttctttctcttagcaaggtattaatgcaaaaatgacctcttcatttcctaccagcttccagaagggaaatgctggttaggaggtaaattcaatttactctacaagcaaacttcacatctgttatgctgaagtcagagtttatctttcttgttatgtggaacctagaaatataccatgaggaatactgaaaaataaactagcagaaattttgcgtgatgctgaggatttttagatggctgcaaaatgggtgaaagtaatataaacttaacaaagaatgttgtcacaactctctggaacttagtactgtttttcaactaacaaatggaagatttgtgagactaggtcgacttaatgtgatttcaatgcagtaattactgtgtggcatgggcatggtaagagataggccttttctagaaatattctcatctctgttttttttagttgctcttacttagatttatattaactcagcttcacattttcatttctttttattttattttaaacaatgagaaaaatactccacgatgtcactgatttagttatcagatttgctttatttctgtatataataggtaatgtgagtacaggaaatatatctgaaaaggttacttgtacctaaattttaagttagatcatttaaaaattacttataagtctcttgagtgttttatatagtagggcagatggaaaaacttatttgatattcatttttggtacctcttaggaaaataattgggaatgtattcagttggaaaaaatgttgagaagagtgttttatataatgattatttagtaaaacattaaaaataatttcttattctggaggtttatagacatcaaaattgacaaagattcatggattatacatttcatcaaggtacctttaagcgattttttaaaaaaaattctgactctaacaatgcatgctcattgtagagcgttaaaaatacaaaaacatgcaaaagaaaaaattaaaattaacatgtgtcatatcacccagcattaactactctataatttttcctgtgtttccttgtagggtttttcccacacatttttatttgtttttatcatatttatttttattccacacactttttattttgaaatgatttacaatctaggaaagaattataagaagagtacagagttctctcctactacacttttgagcattcttgctttttctctctttctgtctctctaaatatatgtgcttaaccatagtacatattcagatttttctagctgtcccaagaatgttctttctagtgattttgttttccaggatcatggatcatgcattgccttaacttgtcatgtttctttggtttccttaatctggagttccttgatctttctccttcatgccattgcatttataaagagtgttgtcaactgttctgtgtatgtaaattcttaaccaattgaaatagattttacatcatttttcccactttatatatatatatatatttatttatttatttatttatttatttttattttattatttttttttttttttggagacagagccttgctctgtcaccaggctggagtgcagtggtgcaatctcggctcactgcaacctccacctcctggattgaagtgattctcctgcctcagcctcccaagtagctgggaatacaggcgcgcaccaccatgcccagctaattttttgttttgttttgttttgttttgagacagagttttgctcttgttacccaggctaagagtgcaatagcgccatcttggcccaccacaacctccacctcctggattgaagcaattctcctgcctcagcctcccgaatagctgggattacaggcatgtgccacaacatccggctaattttgtatttttggtagagacagggtttctccatgttagtcaggctggtcttgaactcccaacctcaggtgatctccctgcctcagcctcccaaagtgctgggattacaggcgtgagccaccgcgcccggcctaatttttgtatttttagcagagactgggtttcatcatgttggccatgacggtctcgatctcctgaccttgtgatccacctgccttggcctcccaaagtgctgggattacaggcgtgagtcaccacacctggccacttaatatattttcaacattttccaatgtctttaattatgtcaattataattttggattgctgtataatataatttattttcattagtcttctagtgttggaaatttttactgtttgttttcttttcagtattgcaaatacaattgggaaataaactttgtaaataaatctttgttgtaattttaatttctgaatctatcaagtatttgttaaaacataaagcaacaaaacaaaaatcctacagaagaggataattaaatgttaatctttttgattctgaatacaattagaatggaaatttggaaaaggggaaaattgccagataaagaggttgccagatttagcaaataaaaatacaggatgcccatttaaatttgaatttcagaagggacacacgatatctgggacatacttatactaaaaaattattcattgcatatctgaaacttaaatatgactgagcatcatgtattttatctggcaaccctaccagtggtttgagtattcgggaagacttcatggtagagataaagagagggaataaagaagatgttttacacaaaaggaatggttgagattacctccaaaacaagagtgaacatagtttatgtgaaatagtctccataaagataaagactttgtgtctcattcactgctgtatccccgatcccttaaacaatctgtacactgtagtcactcaataaatatttgttgaacgagtaaatgaatttgcactataaataaagccaggcaacttgggacaaagattacctgttgtaactaagtagataaagataaaatttccatgaaagtggaaaacctggcagaagaatttggacttcctgccttcccttatttattttataatgattcattaagtgactgttatgtgccacatgcacaggatactttggagaacaaaaacagacatggcttctaccctcatggattttatagtctgtattagaggcagacattcaatttataattcaattattcatttaatagtcaataaatttcaattcaattatagcgtacaacttataaaattgaatttttaatcattcaatttataaatatgagtactgtaagggaaaagtatataatacttacattctgaaatcacacacagtgagggggtattcttgaaagaacctgatcaagataaatgtacatggtgttgtgtcttagggatagatccaatcttttctttgaaatcttcattcattcactaattttccctcgaatttatagaacactctttggactattacacttatacatcttttaaaatctttttatatgtgcaatttagtttacttactagattgtaaattaattaatttatttatttatttagagacagggtctcactcacatcacccaggctggagtacagtggcacaatcaccactcagtggcagtctcaacttcccaggctcaggtgatcctcccaccttaacctcctgagtggcttggactacaggtgcacatcaccactcctgtcttatttttcatatcttgtgtagagatggggttttgccatgttgcccaggctggtttcaaactcctgggctcaagtgatccgcctacctcggcctcccaagatcctgggattacaggcataagccctgcacctggcctagatcgtaaattctttagtgagctgggggtatttcaatttgcttttatcccctattgtttcatgtatgtaaaatatacacaggcgttaattattgacatgttgattcattgaaattataatggggcttttaatagctatagatatgccatgagcacataaaagacgatttcctgattctttgaccctcttaaagaagtttatgatgcctacttgtcattcttgggtccttagaccttctgtggcaatattaggtcggggatagatgtctaatgatttgcagtcagggagctttgataaccattgtcacatgttagcataaatcagaacccaatcacttttttttttttttttgagatggagtctcattctgtcgcccaggctgcagtgcagtggcgtgatcttggctcactgcaacctctgcctcccgggttcaagtgattcttctgcctcagcctcccaagtagctgggatcacaggcatccaccaccatgcccagctaatttttgtattcttagtagagacagggtttcactgtgttggccaggctggtctcgaactcctgacctcaggcgatcctcccgcctcagcctcccaaagtactgggattacaggtacgagccaccacgtccagccgagaacccaatcacttttgactctgccttcaatatatattgcaaatctaactaccttttactacctctacttcttcccttctagttcatgatgccattatcacttgcccagattattacagtagtctcataattgctctccctgcctctggttttgcctctcccctccagcagtgataggaaataatggaagtttttaagtaagcatggtagtatcactggatctgttctttgacacagctggctagtagtgtttggtagattggaataggggcatagtaaatgtgggttgacatggtatagtaggtagtcaagacagtccaacaatcaatcttaaagacatttcattttcttggtagttaaagaatataggcctaccagtacttgtaattttaattttaattgatttatatcattttacttattaatattcatttgaatcttagtttataatatctataatcatatgctatgctcaaatgtaattgagttactttttagagacaaggtctcgctatgttgcaggtttcaccatgttgtccagggtggtcttgaactcctgcgttcaagcaatcctcctgcttcagcctcccaagtagttggatctacagggatggcatgcaccatcatacccagctctgaactattttttaagtaaaattttttttagatgaagacaagcttgtatacaagagtagttaagacagtgtggtactgactcaaggatgtactaatagacaaaggatagaaaacagacccacacacatacagtcatacagttacagcaaagatgccactgggatatagaggagaaaggatagtattgggatcagtggatattcatatggaaaaaattaactcctaccttataccacacaccaaaattaattctatatgattgtacataaatgtaaaatagaacaataacacctctagaagaaatcgtatgaaaatatcatggtcttggttaggcaaagctttcttacaaagaatttaaaaatgttaacaataaagaaaatatagtctggtccaaatgcagtggtatttacaactaattgatcacagccagttacagatttctttgttccttctccacttccactgctttacttgactagccttaggaaaaaacaatttttcaggaaaaataagttggatgtgtcaaaattgaggacctttccccagaagacattgtgaaagtgaaaaggcaaaatataaagtgggcttaagaattatgagaagttcagcacagaggactagtggaagaaaatatgtttgtacataatttctttccctataaccaatactaagaatagagaaccctatatttaactgaaggcagaaaatattttgaggccatatttgttctcattttatgccatttacttagtaaatgtacataccttatagattcatgcatataatatacagtcctcccttggtatcttcaggggattggtttcaggacccctctcacacatacacaggataccagtattcaagtcccttgcataaaatggtgaagtatttgcatataacctatgcatatactcccatgtactttaaatattaatctctagattctttataatacctgatacaatgtaaatgccatgtaaatagttgctataccatggttttttgtattattattattattttttattgttggatttttttcatattttcagttcatagttggttgaatgtggatgcagatacagtgggccaactgtatacatattttgggatcattttagtgggtagtaaaacttggttttccccaactgtttctgttaattcacagccagttatgaaatatgccacatttgtcctgattaaatagtgaaatgtcttagccctttccactgattatattgatagaaaagattaaaaagtggtggataaacctaaccaaaaaaaaaatgttttcataagccactgctgtcagcacttatttgagattttaaaacattttgtagttctttatttttaaatgaccttacattttcaaaagggtttgttaattcaaaaggtctcctatggttaaggcagttcaaatagtagactgagggtagaagagggattgactgtaaataggcatggaggtatcttttgggggtgatgtaaatgttctaaaactggattgtggtgatgtttgcacaaaatttgcacaaaagcattgaattatacactgaaagcatattttatagtgtgtaaatgaatgccttaataaagcttttttttttttttaaggataccattaagataatgaattgtccagccacagattaggagaaaacatttacaattcatgtatctgacaaatgattgtatccagaaatcaataataagacaaatcaatagacaaatagcataatttttaaaaattgggcaaaagacttggacacttcatagagggaaataatctaatggccaaataagcacactaaaagaggatgaacattattaatcattaggaaacacaaattaacatcacagtgagatactgacccatcactcatccacttgaatggttaaaatcaaaaggactactaattgttgacaaggatgcagaacaactggaactctcattctttgctggtgagaccatgcagtgggaccacacatttgaaaaactgtatggtagttttttattttttttttcctggtaaaaattaaccgtacatctaccctatgatccagcaagtcatttacctgagaagaacaaaaacatatatccacaaaaagagttgtgcaagaagattcatagcagcaaacaggcatgttcattaacaagacaatttttcagcacattgtgtttttttttttttttttttttttttttttgagacagagtctcactctgtcaccaggctggagtgcagtggtgcaatctctgctcactgcaacctccacctcccaggttcaagcgattctcctgcctcagcctcccaagtagctgggactagaggcacgcaccacgacacccagctaatttttgtatttgtagtagagatggggtttcaccatgttggccaggatggtctcgatctcttgacctcatgatctgccctcctcggcctcccaaagtgctgggattacaggcatgagccaccgcgcctggcctatgtattcatttaacagtacactactgggcaataaaaataaatgaactactactacccccaactacatggataaatctcaggaacattatgttgaacaagaagagtcagatgcaaaacagtatttgtgttctacattataccattcaaacaaacaaaaacagtctataatagaaatcagaaagtagtttcctttttgttagggggtatagggattgactggtaagagacagtagaaaactttctgggattatagaaatgttctatgtcttgttttggataaccatttaagatccgtacatcgtattttatgtgatcatacctcagtaataagaatgcaaaatgctacaaaagcaagtcaacccaacatctctactaataaatctcaccattttaaaaagaacagtaaatcctacatctctattttgagaaaaaataattataattttatttaatgctatttaacatatgcttatatatgacatataaattgtgaaaagattatttaaacaaattggctaaagaaacttcatgaagaaggtgaatcttttgccttattgcatatgcttttatattgagtaaaaccaaagtgatttcccatggtagcttcttatactctgttctcatactctttcttgtgataaaatggaaactgatgttcttcccatgaaagggtaattatacattaatgtactctttttccctcctgtcctttttttattatgaaatatttcatatatcaaagaatatgtctaacatatgtgtattacaaagtatatcctctgcctccctcctcatttgaagatcctgccaatcctctgcagagctaatgcttattctgactttggggttttcatttcctttcatatatcccttatatatgtagtcctagtaggtgtatacatatgtatatcatgaatagttatatatataataattgcaaatacatcctgtttatttaatgggttatgtttctttaagttccaatacaatattttctaaattagaaaggtattacaattttaaaaaatgtgccaggacaaaattaataccaaattacaagaatggtaaagcttagaacattgtcattgactataaataatagctgcaattctattgttggtttcttttttcactagtccattttgataatatttcttgttgtggccaggcacaatggctcatgcctgaaatcctagcactttgggaggccacggcagatggatcgcttgagctcaggagtttgagaccagcctggacaacatggcaagaccttgtctctatttaaaaaaaaaaaaaaaattgttgtagtgaagcagtgttttctttcccacagaatatcgttcttcatttatttataaaaatatgatttggtatatatgcaaatgtagcttattttatatataaccatactgtaatagtctttgtggtaagcaattcagttaatatgactacaggtttaagatataatgtgaaatttggaatagattttaacttttaaaaaataatttatgttaggctgggcacggtggctcacgcctgtaatcccatcactttgggaggccaaggcaggaagatcacttgagcccaggagttcaagaccagcctgggcaacatagggagaccccgtctctacaaaaaaaagaaaattagccctgcatggcccatgcctgtagtctcagatctccagaggttgaggctgcagtgagccatcaccatgccactgtgctcccacttgagcaacagagcaagaccttgtctcaataataataacaataataatataacttatgttaagggctggtctttctttttctatatttaactgattaaactgattaactgtttgttgtttttttttatgtcataggtgtcagatccagctagcagtgccataagccagaattatagatggaagtgggggagagagagaattgtcagaaaaacttactaagatttctatcctggccaggtatagtggcttatgcctataattccagcattttggaaggccaaggtggaaggatccctggaacccaggagttcgaagctgcagtgatctatgatcatcccattgcactctagcctgggatacagagcaagaccttgtctcgaaaaaaaaaaaaaaaatctaagtggcttcatacagaaagtttaaagttaaatgtatactgttatgaatatcttattaaaatgcaagacaatcagagactgatctaaaagtaatcaaggatgatcatgtcttgggagtatcctgtttctcagttgctctggacagaaagcacctagaaggttgagataattcaatgcaaaatcagagatttccccccatgtaatcaacctcagaacttgagttggtcctaacagtagactcaaccccttggaaaagactaggcagagcaattttcctattgactacatctgagacgccattcattcttgtgtcacatgagacatagcatatactttttaggtctctaataatagcagttctctaagaagcaaactgggatgaaagacactattcacttattttcttaaatggggaaggcattaaaaggagtgaaggtttattaatgccacttttaaagatataaatagtagatttttattctaataagtcatacatcaataaaatttgttattgcagctccggggcagcaattacttatatattgacaacttatacatgttttacatgcccatttgctctccttttcactactgaaatgtagttaccatagcaatgaacacatcacatggttcctgtgctagttctaaaatagagaacagcaatatgccatatgagctctgcttattttctacgtaaggactgcatatacaacttgaggctattccataaccttctcagtgcagatagcttatcattgatttagaaagctttcaaagtaaaaagcaattggcagtaatatatttcaagtctctagcttctcttgtactgttatttgccactgagctaaaagaacagtttcactagctttgaccaccagggactctgctgttgtatatttagccatagattgtctatggaatagcagtgccacttagaagattggtgggagaggcatatatagcattcatggacacattttctaagtcttactgagcaattcttaaccaatcttagcttttctcctactgtctcccttaatgtttcaagtttttaaaaatataggactctgttttagaatttgaggaaaggaagatgccaggcacaactggaggcatgctattagttccttttatgtccattattgttgtgtaaggttttaaaatgcattggttatatagcagtttatctatagaaaaggacttcagatttcagtgcctggtggtatcaggccgtatttatgccttactatcacatttagagtgtgttgtaggctgtcagacctccagaaataaagtaggaacatacccctcttactgtgactcttaccagatacttatttgaaacagtccaagcactggcatattagggaatggtgctaactctttctaaccattaataagcaaaataaatttcaatgtgagcttttggctatactatacctatggtcaagtggcactacaaattcaaaattttaaatattctttattgaaactactaggaacaactgttttatatatagtagaggaaaccagggctttattctcttgactgaaacgtgtaagaagtgattcataggtcttcaaacacaaattagtaaatttaggaagctaaaaaggcatatatatttgactactgatgggggcaatatgttgattgtgtaatatttttatctaccctttcatctcagttataatttaaaaaccatttatatactacataaactatgtaatattggatacttctgtgtctatataatttgcaacaaagtagaataaatggccagagatgttattgtaatcttatggttgaatgttatttcttttttctaggtcattgtttaaaatctggacatcatagaaacagataatgcagagagaaaattctttcataattccaccacatctcaatctttgttattagttttaaaatatgtccttctagacatattttattgtaaaaagtatttaaaatactcattttattttattgccgcaagagagagaagggcatttattgtagggcaccaagcaaggaagatgggcagctcatgcttaagacccaacctccctgctggcttacaagcatgggtttttaaaggcaggggtacatttcaggaaagtagaagttacaggcaaaattgttaatcaatacatagaggttatacatgggttggctcaaaaaggagtaaggttttgagtgggggcttacaggtcatcaatggattaggagattctttgatttgcagttggttaaggaagaaaggctttgtctaaaaacttggggtcagcagaaaggagtgttgaggtttggccttaacataggttagttaggataaggaaacctgttaatcattatggggtgctatgtcagggtcaaggtatgagagcaagccacgatgcactgggtcagagtgaccagtttaggaaattgatagcccacaggtgtgactctctccaggcccctcaggaagcaatttagaacaaagagcagcagtcagagttcagtcttcagtttccctttatcaaaggtctatgtgacagcagttgacattttcttttttctgttttcttaaatttatttattaaaagaagtgtctcattctgttgcccaggctggagtgcagtggcacgttcatagctcactgcagtctcgaactcctggcctcaggcaatcctcctgcctcaacctcctgagtagctaggactacaggcacatgccactgtgcccagctcatcattttctatctggtgggtatgctggcatgttggaggaaggacctggcgagaggtgcttggatcatgggggcagttttccccatgctgttctcatgacaggagtaaattctctcaagatctgatagtttaaaagtgtgtggcagtttcctgctcgtgctctctgtctctcctaccactgtgtaagatgcaccttgcttctccttcaccttcagccatgattataagtttcctgaggcctccccagtcatgtggaactatgagtcaactaaacctcttttctttttaagttacccagtctccggtagttatttatggcagtgtgaaaacaggctaatacacttggtttctgaaaagtaatttggctggctttgaagtggggatgggccatgagccaaaggatgcaggcacttctggaagctagaaaggcaagaaaagattatcccttggagcttcaaaagaaatcaaccctgcatgcaccttgattttaccctagtgaggccgggctggacttctgatgcttcagagacaagggttcctccctcatctgtctcaggaagacttaggactaactttaggctttgaagtaaacagaagctgaaacatttgaatgtttgattttcatgatccagaactcaagcctcataggtcccatgcattccctgaacccaataggatgtcacagtctgcataccttcacaccatggcagtctggcttcttccctctcaggcctgcagcctcatgctctgggcttccctggaagctggtgttgtgggggcctgcagttgccaccctgctgtgtgtcagcactgctccctgacgctgttcatccactgacctccattccttggcccagctgcccaggcatggcagactacacgcaacctgggttgtggggaccaggcggagccagcagcactaggacctgatggccaaaacactcattttaatgaaatcatactttaattctgttttgtatcttctcacataaaatagctagatctcttttcctagtagtacaaacttatctatctgccttattttgtataagagtggtattatatgaatacatcattgtttattcttctattgaaagcttttatgttgttttctgggtttttgttattatagttctgtagtaatatgtcttatgtacttttgtgtaaatagttctataggctcaatctccagaattgaactgccaattcttagtaaaggaaaatttaacttttgatacattttaccaaactgccccttcaggggattctaccaaatcatattctctgtttaaatgtctttttaagctttgccaaactgatatatttaaaatggtattttattgtttcaatttgcagttttagaggtaatgttgtaattctatatcttttcatattatagtgcatttatattttcctcttctcttaactccttgtttgcctagctttctttttcttttggttggttcaatttttccaactaagttttttcatgttgtttttttttttctttttcctttgtatttgggaaataaatccttacttgtaaatacttcttgcagtttgtccattgactttttttttgagacaggatcttgctttgtcgtgcaggctggagtgcaatggcatgatcacagctcactgtagcctcaaccttgcagccctctggccacaggctcctgagtagctgggactacaagtgcgcaccaccatgcccagataatttttttaaaaaatttttttgtagaaaaaggacctatgttgcccagactagtctcaatctcctgagctcaagtgatcctccctccttggcctcccaaagttctgggattgcaggcatgagccaccatacccagcctgtctgttgattttattttcggtgctttttttgtatatggaactttttctattagtatttagtcatatttgttagtcttgtcctttatcccttctagcctttaccttatttagtaatatcagatgatgtgtttcatatgggtctaatttatgcattcattcacttacagaagctaatcatttgagtcctagtgtaccaagtatcttagatgatgggtcattgctgactgtacaatctaagaagaatcttatttgcaacaatgatgctttagcgtagcagcagaccaaattctctaggatgattagcagctaattctgaatattgctgtaaagtcatagtagcatgtaacatgtacagcaatagtaaaaacatgtaacagtttgttccttcctaaaattttgttaatttagtcttttatgtgtccttatatttataaatattagttttgtggctaaaatgtgtacatttttccaagttatagtattgagaagcatagctagtagcatttcacccaacagaaaaaattcctttagataaaagccaaatcacagttggcctcattctacatactgttctacaaattacaaaatcagtaaatgtttattgggtacctgtttttattgctaagctcttgcaagagaaagagagaggtggtaggatttttttaaggtgcgagctattatcctatttttaaagagctcataatctagtttggaatgtttggcataagtacatccaaaggtaaataataaaacaaatgataattgctcaacaatatgtaaagacccccctctccaaaccaaaacaaaacagaacaacaaaattgtcagtctcttctgtgagcagtattatctgctgaggacatgttactggtcgaagagctttggctgcagtcattcctagaatgcaaaatgaaatcatccaaaaaactgagagtggccagttttactagtcaaatggagtaagtggtcatctgtgagtttgtgaatctgtctgccagaatatatttattttcttgcttattccaccagttactccttcttgttaaagctttcaccgttattaaagagaagtacctcctggaaattttagcctgctagatgttgtcaaacctgatagcacagtgtgataggctaagattctttgttcatttgttttggatagggaaggaaagacacaatgaaaagactaggagtctgaggtgagggaagatgatgaagaatatgaatcaagggatcaggcatcaagataaccgttcatttatttaaatgtagactttatctgtcttgatcaggcatcaatataacctacatttatttaaaagtaaactttatttgtctaatgtatgtgttcctaatccctgaatctattcatttcattgaaattgatgagtactttcaatacaaatagttacaatattttaagatgttcactgtttataacatcattatatgagtccatgttaaaccagagaagcagaaccagtagacaatatagatttagagatttgttacaaggaattggatgatggaagtatggaggctggctaagcgagtccaaagcccagtcaagaggaaagcaggctagaaacccatgggcataagctgtttagagtccctcagctcagggaaagcctaagctctctttcaaagggctcacctaactttgccttgtaattttctataatggattcctagagtttaccaactaatatgacggtctagagttacatttaagtgaaatttgattgtgagattgtattcttaactgtctatatctggtgctcttgagcacgtatacaaccttctcgccttctctaggtccctaaaagtcatttcttaattcaaaaaatatttaaatgcctgctatgtaccaagcacttctcttgatagagtggtgagcatgacaatctagtagaaaagtgagacagggaaacaccaacattactgtggaaaacatagttacaggggaagtagaaggacattagtcatgtttttttcttcatgacccactgcctaacacatagtagatgcttaataaatgccttttaaataaataagaccacatggcatttttaaaggagtaaggacctctttaaaaataagtatatatggggaaggaaagagatgatgagaagactaggagtctgagtcttgctacagaactagggtaactggagctagtagaaaagcaaagaagcttctgatttggggatggattcaagagtatattgggatgggtgcaaacactttcactgattagcagtttacatatttccttcaaggatagtcttactctccttgtcctaacttttaacctttgcttcaaattagtttagcagtttgtactaagaggaattgccagtgaccaagtgaatatgatatacatataaaagaacagagaaaatcaagtctttactatgttgctgtatcactaattcaggcttccagctaaatgccagaacataaattaggtcccttatcaaatctggcacaaaaatatttaggatcctttttaatatagtacatgtgctttcaataaatgcctgctttggcaaaaaataaaaccagtgttttttgtgtcaagtacaagctgttgtactctgtaacttttaaactgtccttgtgaaccaggttgagggtaaaattaaatttggattttgtattcagttttacaatcaacaaataccattttttttctttgtgttgtgttgtcttatgggtgtttgttttattttggtttggttttggtttggttttcacttagaacaaaattcaaaatctactaaatactccctagccacactggcctgttttcagtttgagatttttttatttttaattttttttaaagatgacatcccactgtgttgtccaggctggagtgcggtggctattctcaggcatgattatagcacaactacatccttgaattcctgggctaaagaggtcctcctgcctcagccactcaagtagctgggactataggcttgcacctccacacctgacttctttctgtttttaagacagttgagctctttcacctgtcccctcaaactgtttgtacatgctcttccctctgccttgacctatttttacatcatgttcagtgttactcacccatcttactctcactaatttattaagtctcaaatattttctcagagattctttcttcacccatgcctccatatctcagttagatctcccttaaaaatctcttctgtgttactagttcctagcatatagtggatgtgtgataagtgaaaggatggactgaaacatagagcacatacaataggtatattctagtcattataaaatgtcctcaaggaactttcttaaatctgagttccaaagggccatgttattttgtaaataatattcttacttttactttagggaacaaaatcagcatttttaaatgaaatagatttaaaaatataggcatgtacattgtataaatgcatgtatacatatgtctaaatatggcaagttgcaaagtaacatgaataccatgattgctgtcataaaccttgaaagccactgtgttagtggatactgttgtataataatctccaaataagcacgtctagaaaacaacctgttttacttatcaatttccccaaacatctctctggtgactgcgtctttggcttcttttttatttatttatttattttttattattatactttaagttttagggtacatgtgcacaatgtgcaggttagttacctatgtatacatgtgccatgctggtgcgctgcacccactaactcgtcatctagcattaggtatatctcccaatgctatccctcccccctcccccaaccccacaacagtccccagagtgtgatgttccccttcctgtgtccatgtgttctcattgttcaattcccacctatgagtgagaatatgcggtgtttggttttttgttcttgggatagtttactgagaatgatgcgtctttggcttctaagagttctttgctgagagtaaagagccagaatctcagaaatcccccagaaagacgatttaagttaaatgcacccatcaagctttgaaggaaggcggcttaaaaaaagaaaaacactatattacattctacttttaattttcaaaacctgaaaaccttctcaaatccaggaaaactaatggtatttccatctattctctttgatagcccacaattcctatgattttcttagcatcccataatacattttgcttttatccttttactgtttttcttcctagaattttctttcaaggtccaacacagaaatcctttttctcaacaaacctttcctgactaaccctgtttccttttttaaaattctttgcattttctcaacagtttttgatatttattttttaacgtttgtatacaatactataatacagtcagttatttataactttattttgtgttagaagtaggttttttgtgtgtttgcattcttcctaattttacatgtgcaaaaagttactttaatcttatttttcttaaatgaaataatccaattttaaatccctttcctggagaattaaatataagtcattttgggggtgctttccttcacctcccccagaatctcacacaaaataaaacattcagagaattaatcgcccctgccccaccccaccctaatcttctgtccatgttggctgtcctgagttgtccactgttaaaccacataatcccttatagttcagtggctctgttgcttcttaggacatgaacatcttggccaaggcttcaatagctttctgtgttggatattttctcctggcatctccagatagactttttactcttttctttccctattctgtgcccaaaggccctgagaaaattgctaagtattagtaacatggagaaaaaagggatatagtttctgggactgtaaattattcaaaggatagttttaaagctctgggaaagtttggtgaaagttaaaaacgtgttcagagaggaggagttggagcctagtcaagtcacaaatcttctaattcagccaagctctagtagcactcctgaaacattactactatatccttaacatgtgcttttttagttcatgaaacaatattggcataactgttcccctaacaacttaatgagaaagttaaagattttaacaactcaagattgctgcctatgatacttatgatttttaaacaagttgtcatatcaataataataataaaaaaaccataaacctagctgggcatggtggctgacgcctgtaatcccagcactttgggaggctgaggcgggcagatcacctgaggttgggagttcgacaccatcctgaccaacatggagaaactccatctctactaaaaatacaaaattagctgggcatggtggcgcatgcctgtaatcccagctactggggaggctgaggcaggagaatcgcttgaacccaggaggcagaggttgcagtgagccgagatcatgccattgcactccagcctgggcaacaagagcgaaactccgtctcaaaaaaaaaaaaaaaaaaaaaaccatgaaccttcctttaggaaatagagcaatgtagtataaccccacttgcaattttatttttcagattaatgaatatgattaaaattaagatggaataaaaattaaaacaattaaataaaatacaaattggttgtataataaagacaaaattgttatcttgagacacatgttgcatctttccatatgttctaaaattccttaggaacttggcacaagtgctgctgaaataatttctgactgataagtggcagatgccttatcttttattgtggtattaattctaaatcccatcaaataagacaatgcatgatacaaaggataaatttataagcatttgcctcccaatttagacacagaatcattatcatagtacattcactttcaacttgtttctatgttctttctctccttcacatctggcctcttcatgtttttattttctctctctctcttttttttttttttttttttttgtggagacagtctcactctgtcacccaggctagagtgcagtggcacgatcacagctcactgcagcctccaactcctgggctcaagtaatcctcccacctcagcctcctgagtagctgggaccacagacatgcaccaccacacccggctatgtttttgatgtcttgtagagacagggtctcactatgtgagaggctggtcttgcactcatgggctcaggcagtccttcctcagtctcccaacgtgctgggattacatgcgtgagccaccatacctgggcctgttttctctttcttttcattctaaccataatcacttatctatttatggtttttgtttctatttctgaatacatttaaatgccagttataaaatcagaaattcttatttgtgcttaaacatagtaagatttagcagtagtttgaacttcaacatgattattaaatgtggattttaatactagtgatgattcacattttccaacttttatactttacaatttgtttttcttgatgagagtttaggtatctatgaatgaggagaaaagttaattgaattttggcttctagaaacaagtaattaatcttttcctgttaccttttaaaaagatactttactttttatagaaagatagcagtagaaaagaacaggtatttaaatctactcactgacttagaccaattatttcataatggaatctctacttctgtgaatatgtgttttgcttaacgagacctcctaaaaactcatttttatggtcattgaattttagagttagaaaagactttagaaagtgttattagcctctcattttttaaaaacagtttgtatcttgcccaaagtcacactaggggtaaagtaagaggcaaaggaagaactggaattcaagtttctagattccaagtccaggactctttctttttatctcattattttatgaaacatggagagcaagctgattgttcatttaagttcattacactgtatcttggaatttgtcatttctatgcttcactatttaaattaaaatattttatgtttatcacctgttttttgatctgccatgtaagaattttcacttattgtcttccctttaacattgagtctgcatactgctgctaaataatctttctacagtatagtcctaattatgtccctcaaaaaccataatatatctcaccccttctatcagccacatagttaaataaattaaatccaatcatttaacccattgcagactaaatctgcctttcaaatcttagtactttccactcctctgctcatattttatgggccaggcaaatggactacttacttgctattctcaggacacacgtctcatttttcataccactctatcctttcttatacatataacaactttgcctaaaattgtgcccatttgttgagactttgatcaaatttcacatttcccatttcttttgttctctctctctctgttttttttgttttttttgtttttttttttttttttgagatggagtctcgctctgtcgcccaggctggagtgcagtggcgcgatctcagctcactgcaacctccgcctcccagattcacgccattctcctgcctcagcctcctgagtagttaggactacaggcgcctgccaccacgcccagctaatttttttgtatttttagtagaggcagagtttcaccgagttagccaggatggtctcaatctcctgacctcgtaatccgcccgcctcagcttcccaaagtgctgggattacaggcctgagccaccgcgccaggccctattctctctctttttaattccaattacagtgtagtacaagcttgtccaaactatgacccatgggccacatgcagccctggatggctttgaatgcagcctaacacaaattcataaactttgttaaaagattatgaggtgggtgttgctgggtgtgtgtgtgtgtttagctcatcagctgttgttagtgtttgtacattttatgtgtggcccaagacaattctttttcttttaattgtgaccaaaggaagccaaaagattggacatcctttatgtattatattctgactttaaatattgctttccccttaatttttttttcattgtcatctcctcactttattgcaagtacagtcagcatcaatgttgagaactttttctcctaggaggtacaggatttggctctgatacggtgttgcctccacagttgctcagaatctaggctccatctgttacaggaaaggggtcctaatccagaacccaagagaaagttcttggatcttgcacaagaaagaattcagggcaagtccacagtgcaaagcaaaagcaagtttattaagaaagtaagagaataaaagaatggctactccatagacagagcagccctgaggactgctggttgcccatttctatggttatttcttttttttttttttacatgttctattttttaataaaaatatttatttggtcttatgaatacagaattattttatttttatttcaaatgcctaggtattataattctgtataatagttatttgtactttttatatttttatcttttttttattatactttaagttttagggtacatgtgcacaacgtgcaggttagttacatatgtatacgtgtgccatgttggtgtgctgcacccagtgactcgtcatttaacattaggtatatctccaaatgctatccctcccccctcccccaaccccacaacaggccccggtgtgtgatgttccccttcctgtgtccatgtgttctcattgttcaattcccacctatgagtgagaacatgcattgtttggctttttgtccttgcagtagtttgctgagaatgatggtctccagcttcatccatgtccctacaaaagacatgaactcatcattttttatggctgcatagtattccatggtgtacatgtgccacgttttcttaatccagtctatcattgttggacatttgggttggttccaagtctttgctattgtgaatagtgccgcaataaacatacgtgtgcatgtgtctttatggcagcatgatttataatcccttgggtatatacccagtagtgggattgctgggtcaaatggtatttctagttctagatccctgaggaatcgccacactgacttccacaatggttgaactagtttacagtcccaccaacagtgtgaaagtgtttctatttctccacatcctctccagcacctgctgtttcctgactttttaatgatcgccattctaactggtgtgagatggtatctcattgtggttttgatttgcatttctctgatggccaatgatgatgagcattttttcatgtgtcttttggctgcaaaaatgtcttcttttgagaagtgtctgttcatatccttcgcccactttttgatgaggctgtttttttcttgtgaatttgttggagttcattgtagattctggatattagccctttgtcagatgagcagattgcaaaaattttctcctattctgtaggttgcctgttcactctgatggtagtttcttttgctgtgcagaagctctttagcttaatcagatcccatttgtcaattttgacttttgttgccattgcttttggtgtcttagatttgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacttatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactatagccttgtagtatagtttgaagtcaggtagcgtgatgcctccagctttgttcttttggcttaggattgacttggcgatgcgggctcttttttgattccatatgaactttaaagtagttttttccaattctgtgaagaaagtcattggcagtttgatggggatggcattgaatctataaattaccttgggcaatatggccattttcacaatattgattcttcctacccatgagcatggaatgttcttccatttgtttgtatcctcttttatttcattgagcagtggtttgtagttctccttgaagaggtccctccttgaagaggtccttcacatcccttgtaagttggattcctaggtattttattctctttgaagcaattgtgaatgggatttcactcatgatttggctctgtttgtctgttattggtgtataagaatgcttgtgatttttgcatattgattttgtatcctgagactttgctgaagttgcttatcagcttaaggagattttgggctgagacgatggggttttctagatatacaatcatgtcatctcaaacagggacaatttgacttcctcttttcctaattgaataccctttatttccttctcctgcctgattgccctggccagaacttccaacactatgttgaataggagtggtgagagagggcatccctgtcttgtgcccattttcaaagggaatgcttccagtttttgcccattcagtatgatactggctatgggtttgtcatagatagctgttattattttgagatacgtcccatcaatacctaatttattgagagtttttagcatgaagagttgttgaattttatcaaaggccttttctgcatctattgagataatcatgtggtttttgtctttggttctgtttatatgctggattacatttattgatttgcgtatattgaaccagctttgcatcccagggatgaagcccacttgatcatggtggataagctttttgatgtgctgctggattcggtttgccagtattttattgaggatttttgcattgatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcagctgtgaatccatctggtcctggactctttttggttggtaagctattgattattgccacaatttcagagcctgttattcgtctattcagagagtcaacttcttcctggtttagtcttgggagggtgtatgtgtcgagggatttattcatttcttctagattttctagtttatttgcgtagaggtgtttatagtattctctgatggtagtttgtatttctgtgggatcggtggtgatatccccttattttttattgcgtctatttgattcttctctctttttttctttattagtcttgctagcggtctatcaattttgttgatcctttcaaaaaagcagctcctggattcattaattttttgaagggttttttgtgtctctatttccttcagttctgctctgattttagttatttcttgccttctgctagcttttgaatgtgtttgctcttgcttttctagttcttttaattgtgatgttagttttgagcctatgtgtgtctctgcacgtgagatgggtttcctgaatacagcacactgatgggtcttgactctttatccagtttgccagtcggtgtcttttaattggagcatttagcccatttacatttaaggttaatattgttatgtgtgaatttgatcctgtcattatgatgttagctggttattttgctcgttagttgatgcagtttcttcctagcctcgatggtctttacaatttggcatgattttgcagtggctggtaccggttgttcctttccatgtttagtgcttccttcaggagctcttttagggcaggcctgatggtgacaaaatctctcagcatttgcttgtctgtaaagtattttatttctccttcacttatgaagcttagtttggctggatatgaaattctgtgttgaaaattcttttctttaagaatgttgaatattggcccccactctcttctggcttttagagtttttgccgagagatctgctgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtgtttgctgaatctgaatgttggctgccttgctagattggggaagttctcctggataatatcctgcagagtgttttccaacttggttccattctccccgtcactttcaggtacacaaatcagacgtagatttggtcttttcacttagtcccatatttcttggaggctttgtttgtttctttttattcttttttctctaaacttcccttctcgcttcatttcattcatttcatcttccatcactgataccctttcttccagttgatcgaatcggctcctgaggcttctgcattcttcacgtagttctcgagccttggctttcagctccatcagctcctttaagcacttctctatattggttattctagttatatattcatctaaatttttttcaaagttttcaacttctttgcctttggtttgaatttcctcctgtagctcggagtagtttgatcatctgaagccttcttctctcaactcgtcaaagtcattctccatccagctttgttccgttgctgctgaggagctgcgttcctttggaggaggagaggcgctctgctttttagagtttccagtttttctgctctgttttttccccatctttgtggttttatctacttttggtctttgatgatggtgatgtacagacgggtttttggtgtggatgtcctttctgtttgttagttttccttctaacagacaggaccctcagctgcaggtctgttggagtttgctagaggtccactccagaccctgtttgcctgggtatcagcagcggtggctgcagaacagcagattttcgtgaaccacaaatgctgctgtctgattgttcctctggaatttttgtctcagaggagtgcccggccgtgtgaggtgtcagtctgcccctactgggggatgcctcccagttaggctgctcaggggtcagcggtcagggacccacttgaggaggcagtctgcccgttctcagatctccatctgcgtgctgggagaaccactgctctcttcaaagctgtcagatagggacatttaagtctgcagaggttactgctgtctttttgtttgtctgtgccctgcccccagaggtggagcctacagaggcaggcaggcctccttgagctgtggtgagctccacccagttggagcttcctggctgctttgtttacccaagcaagcctcggcaatggcgggcgcccctcccccagcctcgctgctgccttgcagtttgatctcagactgctgtgctagcaatcagcgagactccatgggcgtaggaccctccgagccaggtgcgggatataatctcctggtgcgccattttttaagcctgttggaaaagcgcagtattgaggtgggaatgacccgatcttccaggtgccgtctgtcacccctttctttgactaggaaagggaactccctgaccccttgcgcttcccgagtgaggcaatgcctcgccctgctttggctcacgcacagtgcgctgcacccactgtcctgcgcccactgtctggcactccctagtgagatgaacccggtaccccaaatggaaatgcagaaatcacacgttttctgcgtcgctcacactgggagctgtagactggagctgttcccatttggccatcttggctccgctactttctttctttttttttttttttttttgagaaagattctcactcagccaccaggctggagtacagtggtgcgatctcagctcaccgcaacctccatccacctccgacattgaagcgattctcctgcctcagcctcccaagtagctgggactacaggcgcatgccaccacgccctgttaatttttgtatttttagtagagacggggtttcaccttgttggccaggatggtctcgctctcttgacctcgtgatctgcctgcctcagcctcccaaagtgctgggattacaggcatgagccactgtgcctggccattcttgctactttcatagcaaaacatttggctttggctttgctattctgctttattgtactctttgatatccagtatctaccagtaatgtctggactgcatacatcgttgaaaatacaactgtaattaaagatttaaatgcaatattctttcaggaaaatctctttccctgattttgtttgatattggaaatgaaacaataccataatccttcaggataacttcccacagcaggacaactgcaggaatggcacaaaatatgaattgcataaatactcttatagaacacatcagactagcactttcccaagtttttagtcagatctttgctaccatccctgaaactgttaatgcatatgagtagaaaaattttttacctttgtaagcaaagattctactactagaataatcaaattaactcattctaatgcacatttacttaattcatactatgtgtgaggcagttttaggatgtgatagaaaactttgttttgaagaagctgataaactaggtgggggggaaacagagtacaaataaattataatgcaacataagaaatagcataatagaagaatattcagaccactaaagtcagtcaactctgatccccaaaattaagtatgaaccacaaaaaaatcaagtcagtgtcaatctaatgcagatttatttgagggcttctcttttcttctttgcttaatgtaggtgagtgctttatccttgctatttggtaaatcagcaaggatttattatctattctttgcagagtagtatgttagatgctttgaggatactaaatgaaaaagagtttctgcaccaagaatgtataatctagtagaggagataagctatctatacaaataactgtgtctgcagtctgcacataattgttataaaagaagcctttacaacttgagccaaattcttttacaatgcagaaagccactcctggaggtagagaaaggagagaacatgaacaattcaagaagacttctgttatgcaaaagatggctgaactaaccctggagggatgggtaggattttgacaagagtggttgaaggtattctaattcacttagtacctacatgtgcgaggcagcatgaaggcaaaaaagcctggggcatgttcagagaatagcaagtattctagtttgagtggcacctggtacgtatataagggaatagtaaaagatctggctggaaaggaaaagtaggggcaggttacgaaggacctctgaaagtcagactgtggaactggaacttttatcaggaagcagtagttagttttttcaagcaaaagctaattagagttgatatttaggaggatgaatctaacagttgtgtgcaaggatgccttcaaactgagtgagactagtactggagactggttaagagactacaacaataacctgagtaagaattaatacaggcctgacctagttttgagtgagtaggattggaaacaagagttttaggtattataggatttatgcatataaaatggacttgacagaacttgaagaaagagaaagtgtcaaaaggacacagaaagtgaggcaggatatcttacaatgttaaaggaaaggaataatagaagttaccccccaccccagagaaaaaaaagtaaagagaaaagattggaaagttaaaaactgaacttttagagaaagactgcatttagggaatgtagcaaataagataagcaacagaaaagtgagagaatgggaataaagatatgcaacagaaaagaagggaagagagttcctaggaaagggtggggaaattcaaattctaaaatatcgatgaagtctcatttttcatgtattaaattatccagtggagttggaagatccaaaagagagcaattaaatatgctagagtgcatggggaaaattgacaaaagacctaaaagaaaaatatttaaccacaaaatgaaaagtaataggagatgctaagaaattttggatgggagttaaaattaaatctctgaaagaataaaagggaattaatactcaatttatatcttaaataaatatttctaaatgttacactatgcagaaatccttcttccctggaaaaaatgagatcaagtcctattcaaaaaggtcaagaagaaagactgaggttggtgacccgtgagaaaagtttctgagataagtgtaggtggaatttgtagtattatttatcataagtcagatggctgttaacaaaaagttaattttacatctcatctgttagcccagtcgctttataatgttcggtacaacagaaatgccactactttgtaaccacctaaatgctgtattaccttcaatttccattgtgttgttgatacccaagcagaactcattctttgtcatggagactacagaataccacaagcaggcactaaggttggataatgtgttatctcacattctgaaaggagggtctacatggtagatacatttcttgattctgttttgggataattggctcctaagataattggctatttcattattaaatgcagtatgaactttgcagaagtattcagtatctcttaaaacctgtttcttttccatatagcagtggtacctactttcaatttagtatttattcaccatctactacatgctccacttagtgttttgtattatttctctgtgtgtgtgtgtgtgtgtgtgtgtgtgtgtgtgtgtgtgtgtagtctaacttgtacatttggccaatttctttttcaagcatgttagatttttctctctgacttctttgtagatgtggggtagttttgttttttacttaagagacctgtattgattatttctatggctgtccttgctaattcccactggccattgtgaaaaatcttgtctatggtgtatttgtttctaagacagccacattacaatacactctgtacataattactatgaatcagctggcaagaaagaagaaaataatactggttattggtaatatttgttgattttatatgttagctttattaaagatttttttttcttatcttttttctttcaactattgctacctctgaagaggcttttggtagtatttagatgggttgtgctatccataggtaaaaattctgacctgggggatattacctttatttttcactagatgtaggaaagtagatgctgctctgtttttactccattttgttacattaaaaaaaaattacaatgtagtcctataagtttctttttttattttatccagtactattttagactgtgaatattactggaatttctagttctattccctcttctccctctaaaaatcaaaagtgccaaagagtagtagaccttttgtgatatgttctagtcaaaatagctaaaaactagcgctctctctttaaagttcatattcatctagaacatctcacaccttactcttaccactttactcacagtagtttaaaaaataaaactgtaccctgtatatttgttcatttttgtgttttatgtagagtttccattttgtttttactttttttcaagagtgaattttgtaaaacttccagagtagagtaagttacggccattagagtagccctggaggatgagacttatagtggcaatgattatcacaccttgacaacttgggaagggccatgggatgtggatgtggaaaatatataaaaggacattggttcacatttgaacaaagtggaaggaattattagaaaagcacttaacaagggtgctgatctctccccatctgaggtcttctttcttcttttcatctaattttaagcactgatcagtgaattctttctcattattttacataagcaggtatctaaacttataaaaaattgattatttatcttgtcttttagtgcctttttattaatataagttatttggtttttaaattgtgttgccaatgaatgaaggaagtcctgtcaaaagatatacattttacttatcttaaggctaacagccaccatgtccagcctagcaaacattttttttaatgaaagtccaagtagtatggtctctgttaagctactctacttcaactctgtctgtggtagcataaaagcaaccatagataatatggaaacaaatagtcatttgctgtattccaataagactttataaaaacaggtggcaggatgaatttgtcctataggctgtaggttgctgatcctagcataatgtattgattatacattatggtagagccctctgttggttggaagagaggaccagggaaaaaaaagtgaagatgtattagctatacagaactttctagttggtaagacaaaaagcaagaaaattacagtaatatagaatatgtaaaataaaggaggattcagaactgagtaggtaattcttcagagcatgtcaaatgtagattatggtaaagtagaatgtttatggtttaatacatcaagaactatatccttcataaaataaaatgtagctggacatggtggctacatcttagccaccatatttttacatgtacatgtttggtacaggcttatggtggcatgtaattccaacattttgggaggccgaggcaggtggatcacctgagatcaggagttcaagaccagcctggccaacatggcaaaaccccatctctactgaaaatacagaaattagccgggtgtggtggcgtgtgtctgtagtcccagcttctagggagactgaggcatgagaatcgcttgaaccggggaggcagaggttgcagtgagctgagatcatgccactgcactccagcctgggcaacagagtgagaccctgtcttaaaaaaaaaaaaaaagtgaagaacaaggtaagacacatttaatatatctgatcaagtggtcttgtccaaaaaatgtcctgatacatttttttaaactaataaatggaggattgcagacttactgaatatggcaggatcctttagcatgtaatactttaaaatggatccacactgaacttctgctggatgtactggagtaagagtggccagatttatcctccctcctcaaacaatgcaaaaaccagacaaggtatataacataagagtttttagacactagacaatactgggcagtgatccctgagagaaaatgaatgaggcatccctacaatttccatagcattctgcctagatagcttccagtctgtagtctgcaggaaggagatccaaaacagaaagaacccagtggcccaactgaatggagacaaagccaaggtggctagaatttgcatgagacagtgcgagagaagacagagctccacagagatagagcacacacactggatatctgcagagggctccccttgatttttaagccaagtactgaaccacataagtatgctaggaaactacttagggacagggataaagccactggaaaggaataagtggaacatttcctgaactcagataagattaataatagtttatagccccaataatcacagtggaaaagcctctaataaattggacatcttttttagtactcaaaagaatattacatcagttggggacaatattagctctagattaagagctgctctcatctcacctagtaaagcttctaaataagcttgtaaagaatcaagttgtttttgagtaaccaactgaatttcagagtaaagttagggccattagagtagccctgaaaatatataatgagaaacaaaatatttgatatggtttggctgtgtccccatccaaatctcaccttgaattcccacgtgttgtgggacccagtgggaggtaattgaatcatgggagcaagtctttcccatcctattctcatggtagtgtataagtctcatgagatctgatggttttaaaaagaggagttcctggccaggcacggtggctcacacctgtaatcccagcattttgggagtccaaggcaggtggatcacttgaggtcaggaattcaaaaccagcttgaccaacatggtgaaaccccatctctattaaaaatacaaaattagccaggcatggtggcacacgcctgtaatcccagctacttgagaggctgaggcaggagaattgcttgaacccagaaggcagaggttacagtgagctgagatcatgccattgcacttcagcctgggcaacaagagcaaaactccatctaaaaaaaaaaaaaaaaggagttaccctgcacaagctctctctctttgcctgctgtcatccatgtaagatgtgacgtgctcctccttgccttctgccatgattgtgaggcttccccagccacatggaactctaagtccaaataaacctctttcttttgtaaactgcccagtcttgggtatgtctttatcagcagcatgaaaatggactaatacaatattctacacctaaaacataaaattcataatgtctgttatccaatcaaaaattacctttcattacctgagaaaggcattgttaaaaaataaataagtaagccaggcacagtgacaaatgcctgtagtttctagctacttgagaggtggaaacaagaagatagcttgagcccaggattttgaggccagcctgtgcaacacagcaagaccctatctcagtcaatcaataataaatacacacacacacacacacacacacacacacacacgtatatataaccattcatgcgaagaagcaggaaaatacaacccataatgaggagaaatattaatagaaatggatttagaaatgatacagatgttaggattcgttgacaaagatgttaaaacagcatttctaaatatattatgtatttcaagaaggtaaataaaaacataatcctattaaagagtaatgtgggaaatgtaaaaaaagacctaatttctagaaataaaaaataccatgtctgaggtgaaaagttcactgggtaagatgtggcactacagaagaaaagattaaggatcttgaagacatagcaatagcaattgttcaaaatgaaacacctagagggaaaaaaagactggaaaaacaagcagtgtcactgtgagctgtgagacaactttagatgatcaaatatataaagactacggatggggcagggagacagaaaaaatatttgaagacataagggctgaaatttttccaaatttgataataactgtaaacccacaaatccaaaaagctcaacaaaccaaaagcagaagaaacactgaaaagctacaccaaggaacataatcaaattgcataagatcagtaataaagaaaaaaaacttaaagtagctaggtttctaaaaacaacaacaacaacaacaaaaatgcattacatacagagaaacaaagataagaatagcagcagtctcctcaacagaaacaatgcaagctagaccttggaacacagaaggaaagagaatattaacccagaattctagacccagtgaaaatacctttcaaaaacaaaagcagaatactttttcagacgtataaaacctgaaagagttcatcagcaggagaccattcagaaagcctcagatctaaatgctgcctgtaacaattacctgctgtatggccttggacatacttgaatctctctgaaccttcaaattttcatctgtaagataaaaataatgctaatttttaggggtttcgtgagaatccaatgatagaaaggaaaagaactgacattcattgaatgtcttctttataccaaccacgtattatctcattaaaaatggaaataacctgcctgggcaacatggcaaaaccctgtctctacaaaaaaatacaaaaattagctgagcatggtggtgcatacctgtagtgccaactgtttgggaggctgaggtgagcctgggaggttgaggctaaagtaagctgtgatcctgccactgtattccatcctgggcaacagagtgagacccaatctcaaaaaaaaaataaaaaataaaaatggaaataaaattcccaataatagggctactatcctaacatttttcttatgctagcctctttcttcttgttctttaatactaaaaacttgggttgttctgaaagaaattagtctaagtagcttgtctgtcttacgttttgatgaagcactttttcctaacttaatttgttctttagttaccagattaaatatgcttaaaagtgggaatgaacaactctccttgctagaatagacaagtcagttaatcactttgtgaaacagttaagtttcttgtaaactgcactttatttttttgcctgtgttttggctgcttaatttttttcagttatgtttattgaggtataatttatatactgtttatctaatttttattataaacctattggatagaggcatgagtgtctttatagctgtgcattgccccatagagtttttggcactcaataaaatgttaaataatatttttattcagcattctgtagacgggaagcatatggtaacaaatgtcagagcacaggttgaaaatctccaaaaagttatatgatatattctttggaaaagctagtagagatacttttgtgaatgaaatttctcttaaaaggggttcccagactcacattttatgcaacaaatttctccagccttcagttactttatttacaaattaaagtttttccttatcagaaataatgcataagttaaaatagtataatactaacgtggtatcataagaaagtatataaatggtttgatagataacataaagtaaaggtaactcatagtttgaaggacagcatgagaaaatatttagaagctttagcagtataagtctttatgttgtgatatattgtatgaaaagaaatacacagtggatagttctttattgttaaatttcagcatgacttagttatgtcactgctacagctgttgcagacattctagtggtaggagactttgactcaatattgtttttctcacctgaggattctagcactatttaatactcttattttagtgtcagaaacaatcattgcttcagaataacagaagacattgtgaattaaaacttcaaataaatttcatgcaaaggataatatctcccggttaatctgtgttgaagaaatggttgaccataatcaggtatacaaagccatttagatagcatatatctaaattttctttccagaatttgcttaccctctgatttgctgaccacacttgctttgaagttttggtttttgttgtcttgctatgttgcccaggcatgtctcaaattcctggacacaagcaatcctcccacctcagcctcccaaaatgttgggattacaggcatgagccactgcacctggccactttgaagtttttattaacataatttgaatgtgaaattacctgagtttttcttgttaacctcatgtataaaatgtgggatagggaatccaggcactgcttacttagcttggtgcctctggctctcataagacttttaataaaggtgtcaaccaggtttgtagtcatcttgctgctcagctaggggaggatcttcttccaagcccactcatgtccggtcacagccctcagatcctcactggttattgatcatgcaccactccatagtcctcacaacattgcaacttatttctcctagagcgagggctcagagagagaaggcttgtgatcaagaagatgaacaaaacataccatcacttttgtcatatatttgttaaagcaagtcactaggtctagagcacattcaaggggaggagaatgtacaaggatttgaataccaggttcaaggatcattgaaaaccattttgaagactgcctcctacacatataatccacagatgggacagatcattaaagtactctaggtgctctgacactcatttgtttatcctgagatcttaacaagaacttgaattcaataggcaaaatgatttcagtttcacataaagtatttcatttattcctagcaacaatgcaacgaaataggtatggttaaccccaatgttattgatgaagaaattgatgtactgagtgactggctcaagattacatagcaaataatttgtaaaactgggaccttagtgtaggccttttgattctagaccctgtactctttccattggctataattgcttcctaccagtactatgttgcacttaaagccattcaaggagaatattatacctctaaatttatatacaattatatgaatttttattatacagagatttttatacatatatgtagagaaagacagacacccccctgtcttaatctctaacctataccactccgtttaggagttatagtattattgagtcaaagtctaatatcattataaggcctgtaacagctgtagcaatgacacacatgtacacagatgctagcagcctaaaactacacttaggaggtaaatgtttgttgcatggagagatgaagaagcaaagtaagaaaacagacctggtctggtggctccattcccccttggcttgtcagtatacagaaatcattgtgtttctatataactagtaacaaataattggaattgcagtgagtatgggcaagttatggttttagtttaatattgattatagataattctactttataagtaagaacttgtgttatcagatgaaatatagagaaagttttctcctccatagttgtctttcatatacgcaaacatgcacttgagtttctttcctttcctgcataatctgaggattgtgctttttaatagtggcttgctgatccctttaaatagctcttaatgtaagtattccatagttttcattaatctgattaacatagtttttccctaacctccattcaaaaactatatttggttgttgttttaccctggttgctgaagcagcaagcctactgcaaaacctaagtggtgtggtatagatgagagtctaagactttaattatatgtcattttattcacaacactcaattccaggaaggaaaaaatgggtctgtttttgtaaaggacatattatgtgagtatcattcattgtaaaccaaaaatgatactgtattatagcatagacaacaatgagaactgattctgaaaatgtgacctgactgagaaactgagtaatagtgaaagttatcaaaatggaaaaaaagcgttaatgtgaaatccagccttctcagaaatactctttcctggcctgtttagttttgcttttgttgcttgtcatgcatgaatgaaagtgctgtactctcaggggagcaggaaagcctctgtgtcggttgtttatttccttaatccctcctcctttgtgatttttgatgtcagatctaaaatggaaagcctgtaaatataatgattatcacacggataatcacctgcattaggaaccgccctgcttttctattctaacccgagctgttctccacatgtcacatccactctgtggttggattttaacctgactgcttcattagatttgtgaaactcagtacgaggcgccctggggcagcacagatggggacttgcttgttttcttttctcacttttactgcaaaggcacactaaaaagtccttttcaatttagtgcgatcagttcacttggaattatctctgatatttggaacctgtcttgctcttctgcccaccaactatgcctattctttcttccttactttctgacctaatgtcttttctttctgcctctgcatgtcatgaatctgacaactaaaattctgcttacaattcttactgggtcaaactgttcccccgtgttgttttgtttgttttgctgacagggaaaaataaatgttgttccatcattgtacctacaaacaccttcagatcagaggttagctgtgggaaagtctgcagtgatatgagccagctgccttctctaatggagtgacttggggcaccagtccaagatcagaggaaggtgggaggaagtcagaagataagatcattttaagccacagaacaacaagcttagcttttctagtgatagggcacagctcagcaaacctgtgtgagggggcactaagacaaaaaattgagttgactttttttaagtacatctttcctcagtcagaaatatgttgatgcttgaaatagtttacagacatggaagtgtcctagggcctggtttccttaaaagataatgatttgacatttatatatgtgtcttcttgcagttagtcagctccataccataacagatcacagttaatttttaaaaataatttttttgggctgggcatagtaactcatacctgtaatcccagaactttggaaggccaaggcaggtggatcacctgaggtcaggagttcgagaccagcctgatcaatatggtgaaacccccatctctgctaaaaatacaaaattagctgggcatggtggcacacacctgtagttccagctactcgggaggctgaggcaggagaatacctttaacccaggaggcggaggttgcaatgagctgagatcgcaccactgcactccagccagggctacaagagcaaagctctgtctcaaaaaaaaaaaaaaatatatatgtatatatatacacacacacatatttatatacacatatatatacatatacacacacataaattttttacagttaatttcttatatttgagcaaaactggacattaaaaaaattttactgtatgtgaattttgagcatttatggcttagtgcaattttagtcctacacattcttcctttgaactttgtcttacagtcccctggggttctctcatgtctctgatgaagttccatataaataagtggttctagtatagcttttttgttgtctttttcatataagaatttgcttggttcagagtgacagcttgggaagcactacatcaatagcttttgaaccttttcctattccttgatatcaccgccagcaaatgttactgactatgtgatgtacaaagttctaaccttgcttgcacaaattgaccagttgtcaagatcaatatttatttgcttatttttgtctacatgaactaagggtaacttggtcaggcttatgtttctctagtaaatagcgtaaggagttgtactttcaacttaacacttcctgttgacttcagtgtttagctgtaatcatacattttgacctttctaaatcctcaaaatggttctctaacctatatgttattagtacattggaccataggtgcatacatgtatttttttcccaatgttttcccaaatttctgctgaagacactgactgtactttctgccttacatggcttgatgctacagtcgttttagttgagttggatctgctcactactcaggctcaaatcccatccttctattaatatctcttggcaaagataattttggaagaatgtgagttaagatgtagagactcttgacagttgtctgcagttttttttttttttcattttcaagagggaagtagagttgaaaagtaatattgcctcccttttctatctgtcctaaaattaaagtataagcacaaagagtgaagaaagggaaaggatttgattacacatatgtatttttgtcatttagtaacctgttataagagccttagggtatataataatcattagattgtgtccttaagatatttaaaatctagaagaactttgcatattaaaattttttaaccatacatatttttaatgctcaactgtttttaccctgtcatcttatattaaagaggatttttggactgtttattataaaaaatttcaaacaaaaaaggagacattggacccctacatagcacatacatctagatttaacacttgttaacattttgccacttttgcttcattttaatttttttctgcagtattctaaaataaattacatatatcatgacatttcatttctaaatacctcaggattcatcttaagaattaaggacttttaaaatcaaactgataattcctaatattacctaattttcatttcagattcaaatttctccccttgtcccaaaaatgtcttttatagctggtttgtataaaccaattaaggtttatacattgttcttggtcattttcccttttctactttacattacattgacttgttaaaaacattaagctagttgtcctacagaatgtcctaccctatgaatgttttcagttgctttctctgtgtatactttaacttgttcccctatcctctgtatttcttatagactgcaagttactggactaaagttttgattaattcatattaaagtatttaggttagaatactttataggtgatggtgtgaacttcacactgcatcacaacagaaggcaaagaatatttggtgatcccactattagtgatgataagtgatagcatcgatcactgggttaaagtgatgacagcttgatccttccattataaagttatgctttgctcccgtgaccagcatataatctgagatactttgattccatggaaatacccagttccctatcatcctttttacccaatgagtttaacatctactgaggatccttgcctgcataaatttcgttatgaggattgcaaaaagatgatttttctgaatttatacatttattagcaggcattcttctctacataagagctttttgagaggtattgttttaattaaaaacacaaccaccagcatattccttggattgtctttctttgctgaggtcagaacacctgaactcactgtggcagctacagtaaaaacatgtactacatcttctttattccaacttgtgaagtgtgttgacattaggctgcctttttttattattattattccaagggaaaaaagaaatctttattgctgtaagaataaaaattgaactatgtgggtatattgagataattgtgtaaagaagaagactgaatgagtttcaaaaaatggattatttcttcattaccgagcactttataattaactgttcttttttttttttatttcaggaagctgccacttttgctagagagcaaggctttgaggtgagttaacccacaattgcacactaaacagatcctaaaggttttttctagctgataatgaagttcttttggacagtgattgatgtgctattatactctcagagcctcgcagcagttgccatggaaacttggcagtcgtcatggtttctttgttctgccagcacagtgttatgacgcactctgctaggtctgcacccaacatcgcctacagatgttatttattgaattttgaaaagcctcttgggaagccaagaggttgggcacggtttcaagctgcctctgcagatatggggcctgtcagtttgttcagttaaaaagctacctcattagctgcattacatttcataaggattcactgctaaagcagtggtggaacaagactaaataatgaaatataatgtcgtttaaataatttcagccctatcacatgtagattatcattatgcaaattaatttctaaaaggttgtacttaacagttgttaggaactgattaatttaaatcctgcttttataaacttactctttgaacctatcttttcttctctctccctctttttttctggggagacggaggtagcataaaatatacatacattttctgaaataaaatatcaataattggatttaatttctaggtcctaattctgtttttctgatataagtgttatcctgtcaagattcaaaactccatgtggttgttgttggcaaaactgagataaccgtgttttttatctgtataatacccctcttccaactgattgttagaaaacactgactaatatgaacccaggttaactgacagagaattaactaagttggagttgtttatgactatgatatttattgagtgaactatgtagaatgctgtgttcttacagcaacttaaagtgttacagggtagtaatttttaaaaatttaatctaaccacagccgaaatgtaggaactttctttttatttgcatattcagtattgtctatcaaacagggaagaggtgagtggtgattgaatagtatcagtaaggactagtaagctcactttgaactctagagaaagatattatatgagtttgtgaaactctttttaaatgtagtaaaggcagattatcaagcagcaaagtaatacatgttcatgttattcatgtcatcagacttgacaaacgagacatagagcttcctcttcatagaggaaagacaaggaacatgtgatacagatattctgttctgaagatcctataaaagaactactccagagtagggaaacttgcttctttgtactcaattattaggagctgtgatagtttcttacaagtttgcttttttatgctttaccatattatagtaaatctaggtttaagtcacatttagaaaaaggatttccaagtggtgggtttttttctaatttaagtttcacattttaatttcccaaactggcaattatatgtaggacaaaatgtaatcatgggaatattcaattaaaaagtcaaatgttttgatcatgagaatataaataaaaattttcaggaattttttaaagttttactgattttaagttttaatattacaaaaattatattatctgttgatacatcagaattctccatagaagaaaactttcagaacatacatttgtatcctgtcagtttactgtgttaccataaaaaatgtatttttggttctataaaataaccaattttgcagatacttagaaatataatttgttatataacatgatcatgatcctgtagtatctacatagcagtttttaaaaaatagtttattaagcctgattaatacttttatttcccccttgagctacttgcttttcatgtgcctggtttacattcagtcatagcaacaaactactttttctattttccattaactagcactatattcacctttccattagttcttacttactgattcttgaattgtttttgccataaatctgccataattgattacagcatataagcaaaatgataatgattataatcacataccttattacctcctgacatagcaaaactgctctgtcagtgatattgacagtgatatgttagactaaataaagcacatagtgtcttgatgtgtctcttcgtagattcccaaaaccatcacaagcattgcagaatatatttgaaccatgagtagggtaccctcaaatagatatttttaatcaaatgtaatccatgtatggaacactatctagagaaattcaatgattttataatgtcactaaagtttcctaggtcattagacagaaatggcagagcataggtttgaaacttggtattcttaaggaataaaacaaaaataaatcactttatcttaatagttttctgtgtgaaaatgcattaatactcttggctagtgtgacaaactagacaaaaatctgcattttatcccttctaactttaattttgactctaaatttggagcatgaatgagaagaaagaagtgaaaagattaaaagaaaggaaaggtgagtattttttccttccatcagtgccgctgtcctaccctcattttctcctataaatcccaatcagttccaaaagccactgagtattgccactagtgatctggctgctgacagaccaatccaagcgcctctaaaaataaccagtgtttattcgtcaggaaatattctcagtggcattttttttttaattgattattattctggttagcttctctgcaaattttacttttgtaaaaaaaaaaatctttaaactgaattcggcagttttcagtgagaagcagcagcttaggagagcactggagaatgagataaaaactggagctgggcagaacacaaagcataagagaggatttttttatatatataggtgatggaaaattgcatagtgcctgatttaaatgacagacctgctaagaatttaaaatgacaattcttggggtaaaaagttttataaggccttttattattctagaaaatcagttcagactggagtgtgtttttaaatctagcttttcttgagccgaactgattaaatgttcgtatttttagaacataaataaaaataaggtgctcaaaagcatgtttcattataaagccttttttaaactattgaaaattgatttaaataaagtgaagaaaatacctcaaaacctaaatatatatattctctatcttttcattgtctctgcaactgagtaaatgacaaatgatgaagagaattcataccttctctattggatcatttatttccttttactccaagtaataaattttagattttttttaaattttagatctctaagaataatacttctgctcataggggaaacaaagcaatccttttcgcctttttcacttcctccatagcccctgactacccagaagatcctagacttgtagtctttctctgaccaatgaggattctttcatcttacaccactgaaagagaaaagtatggaattgtgctatccaatacagcatctactagccacatgtggctatttaaattaggattaattaaaattaaataaaatttaaaattcatcacttcttggccttttggctaagatcaaatgtaaaattttaaattcagtccttcagtcatactaggcacatattgagtactctatagactatgtagctaatgactactttattggataatgcaggatagaacatatgcatcatcacagaaagtttcattgatcagcatggatagaaagtctacagagaatgtattcaggcagtgttgattaccaaagaattaccttaggtgacttttaggttcctgtgttcttcacaaatataaatagtgcaatgaatgatcactcagagtttcagagtttctgaaaataagaccctaaatcaggccctgctggctaagagagtgcagtgttgtttttgtaggtgcctgaaccccaaaagaggacaattttagaacagttcagttaagggaaagcaataagctagtcttctaattctcttcatttaatcatttatttattcaacaaatatttactgagttcttactatgtacataccactttgatagaccccaagacaaggtggaagtgaccagagagtgtaccatgaaagagcatgtgggaagggttcccattttagctatgatggctatggaatgaccctaaaaatatgaatatctagcaatgacaaaaaaaaagcgacacaaacagcaaaacaaatttcaaacagagagaacaggactataaaagtctctgaacgagagagaacttaatgtactatgtactccaggaactgacagaaggccagtgtgactggaatggagttagtggggacagcatatgagatcaatctggcactgacacatcatataaacagcataactattaaaggagtttctatttggaaaacaaaacaaaatggtatggctagatgactcaatgtgtggaaacactacagttggttttctacagaactaggtagactgtgacaggattgcttaacctttgtataaccagctggttaaaaatagaataaagattttctttatccagtctatcattgatgggcatttgggttggttccaagcctttgctattgtgaatagtgctgcagcaaacatatatgggcatgtgtctttatatcagaatgatttataatcctatgggtatatatccagtaatggtattgctgggtcaaatggtatttcttgttctagatcctttaggaatccagttcatgttctttgcatggacatggatgaagctagaaactatcattctcagcaaactaacacaggaacagaaagccaaacactgcatgttctcactcgtaagtgggaattgaacaatgagaacacatggacacagggagggcaacatcatacaccggggcctgttgtggggtggggggttggggagggatatcatcaggagaaataactaatgtagatgacaggttgatggctgcagcaaaccaccatggcacgcgtatacctctgtaacaaagctgcatgttctgcacaggtatcccagaaattaaagtatgattaaaaaaaatttctagtaatagtaacactactagtaattcaaatgaagtgtgtgtaacagaagaaataaaaaaaaaattaaaatgctacatctgaaaatacctatttcatacaaagcaaggaggtaaagaagggatagaacatatttttttaaaatatgacatatggaaaacaaatagcaaatggcagatattaattcaactgcattaataataatgttaatctggagtaaataatatgataaaaaggcagaaattctcagactagataaaaaaactgaggtctaactatatgctgtctgaaagagatgtatcttcaattcaaagatacaaataggtaaaaaaaaaaaaaaagaatgaagagagtatgttctttgatttggaagacaatgtgatcaccaatgacaataaaaccatatttctacatttataaaatgctcacagtttataaaacctttcccaacatatcagtaatacattcatacttgcacaaaccttgagagataggtagggcatgtattgccatatcagttcaacagattaaaaaaataggctatatggccgggtgtggtggctcccacgcctgtaatcccagcactttgggaggccaaggtgggtggatcacctgacatcaggagttcgagaccagcctggccaacatggtgaaaccccatctccccttaaaatacaaaaaaatagccaggtatggtggcagatgcctataatcccagctacttgggaggctgaggcaggagaattgcttgaaccaggatgtggaggttgcagtgagctgaaattgcaccattgcacaccagcctgggcaacaagagccaaactccatctcaaaaaaaaaaaaaaaaaaaaaggctctatgactttttcaaagtcatatagctaatacattatgtagccagaaccagagctcagctctctatgtctggtgctctttactataaagcacacagctttctctcacacattctaacatgttggaagaggagattagatttcaaaatgactttgagaaatgaaaaatacctttttttttttttttttttttggggagggggtttggctttgtcacgccaggctggagtgcagtggcgtgatctttgctcactgcaagctccgcctcccgggttcactccattctcctgcctcagcctcccgagtagctgggactacaggcccccgccaccacatccggctaattttttgtatttttagtagagacggggtttcactgtgttaaccaggatggtctcgatttcctgacctcatgatccgcccgcctccgtctcccaaagtggtgggattacaagcgtgagctaccgcgcccatcgccatatcagttcaacagattaaaaaaataggctatatggccgggtgtggtggctcccacgcctgtaatcccagcactttgggaggccaaggtgggtggatcacctgaggtcaggagttcgagaccagcctggccaacatggtgaaaccccgtctctactaaaaatacaaaaattagttgggtgtggtggcgggcacctgtaatcccagctactcagaagcctgaggcaggagaatcacttgaacccaggaggcagaggttgcagtgagccaagatcgcaccattgcactccagcctgggcaacaagagcgaaattccatctcaaaaaaaaaaaaaaaaaaaccactgaaattcgctggagtaaaaatatgagccaaattaattaagaaaaaatagcaaacttaaacacaagatcaggaatgacttgtgaatgtggtaggaaaatggtttaggatgaacatgctatagttttgtgataaaaaaaaacaacaaaaagcacattgctagcatttatagaagcactataataatggttaagtgtattatccttggagtcagactgtgggtgctagtctgttctccactacttgtatttatgaccttaggcacattacttaacgtctctgactcagtttcttcatctataaaatggcatattgtattagtacctactgcctagagtagttcagatttaatgagtactttattttattgattggttgattgattgttttgagacagcctcactctgttgccctgactgaaatgcaatgatacggtctcagctcactgcaacctctgcctgctgggctcaagcaatctgtagattcaatgcaatccctatcaaaattccaatgtcattctctctctctctctcttttttttttttgagacagggtctggctctgttgcccacgctggagtgcagtggcgtgatctcagctccctgaaacctctgtctcccaggctcaagccatcctcccacctcagcctcctaagtagctgggactataggcgcatgccaccacacctagcaaatttttgtatttttttgtagagatgaagttttactacgttgcccaggctagtctcaaactcctaggctcaagcgattcacccgcctccgcctcccagtgtgctgggattacaggcatgagccaccacgccttaccttaatgaatactttagagctttatacatggcttttagtttcttcatctataaaatagggataataatagtacctactgactagagaagttaagatttaatgagcactttagagctatgtacatggctcacagctcaattttatgagctttcaactcatacttcttactcctccctgtcttcatcttcttcgttatagatactataattgaatgttccatattcaaaactcttgaagccctttctagcgattttggggcaacctaagtatgtaaccattttagagagtattaaaatgagagtaattagaggaaataaattaatatttaagttcttagcatgtgctaaaattgcattaagctatttcacttacctcatcttctttcatcctcacaatttttaactttttattttaaaataactttagtcttagaaaaattacaaaaatagtacagaattcccacatacccttcacccagtttaccctaatattaacatcttacataaccaaagtataatgaataacagaaaattaacattaaactacaataactgaactatatacaggctttattctggtttcaaccgttttttctctagtttcctttttctgttccagaatcgaatcccacattgcatatttgtcatgtctccttagtctcttctaatctgtgacagttcctcactcttgttgttcatgaactttatacttttgaaaattattggtcagtcattttgtagaatgtccttccatttgagtttgtctgatgttttctcatgtacattgagattaggcatttttggcaggaaaaccacagaagtgatgttcctttcttggtgcatcatatcagggaggtacacagtgtcacagattcttattgctggtgatgctaaacctttatcactaggtttaggtggtgtttgctagtttatcctctgtaattcccattgtatttaataaatatcttggaggagatactactttggggctatggaaacattctattttatccactaattttagcatcactaaactaatctatctggcttaaggtgatgtctgtcaattttctctactataacattatgatttttccttttgtaatgaatatcttagggggacatactttgagactgtaaatatcctgttttctttaatttttgcccactaatcttagcatacttatccctcaaaatcttttaatgtgaacattttcttagttttgtagatgaggaaatggatcttagagaggtttattaacttgccccaaatcatacaaatagtaaatccaagcctgtcatattctaaaagtccttgtaatttcattgtttgttaagatgtgtgagcttaagtgtaagggagaagaacctattggggacagaggagaggaattactgtagaaggagaaataaagttttacatacatctgggaagaattatgttttgtacttggaaagtttattttgtcctttaattgccattttatgaggtttaatttgagacataagaaacatttctttgattaaattaccaaagctctcaacaaaatatgtcttctcacagggttggtagaaagcaaccatggaatcttattcctttttttttttttttttttttttttttgagatggcgtcttgctctgtcaccaggctgcagtgcagtggcatgatctctgcacactgcaacctctgcctcctgggttcaagcgattctcctgcctcagccctcccaagtagctaggactacagacacgtgccaccatgcccaactaatttttgtatttttagtaaagacgggatttcaccatgttagccaggatggtcttcatctctcgacctcgtgatctgccctcctcggcctcccaaagtgctgggattacaggcgtgagccactataaccagccagaatcttattcttaatttattccttatatcaccttgaagaaagactttcttttaaagaacatctagtacattcataagattctgctttcaagatgatgaagtgaatgtgtttttctcttatctttattaaatatgagctgtacttaatcacaagcaaaaatcctatagtagtaaaatatatttgtgctaaggaaattgccaaaatatacatgagtcattttaattatatgtgtacacttatttaggtgagtgaagacattgcatggcattttttggtcctttcagctgttactagtcatttctaaaagtctgtctcctgaaactgagggaatttcttctcatcttatcagagttcagacttagttctgttctaaaataagcaaccgaaagcgaaatagtcagcatgtttgaagtcagcagcactgtcctactacaaatggctattcttttcagaaacaactgtcctctagaagtcatcctgttaggtatattagaagcttagcttcatatattatctggaatttattaaatattgagtgaacaaacaatataaaaatatttcaccactaattgtcatccctttaaaaatgccagtttctggtgacgtttgtaacgattgcaaaccattgtgacttgtctgctttgcttgcctaaatgttctctctcatatattctatttgttctcttatatatactttatttatgccactcagctatatttccgctctgataggtgtttctttctctataactatttgaaactttgcatagtgatagaataaactagttttgttagcaaagcccaaaactatggacagttttaaaagcccactgaatacagacatggattttcaaattatccaaaatggttgaaaagatgattctaaaacctctgcctttagctcaaggttaggtttcaagatttcagaaaacttcaataaagatttcagtaaaactttatggcctatgtggtgtgaaaaacagcatcagagtttgacaattagtttgtcattttttaaactttatcttttttaaagaaaattaagtctttgtaggaaaggattagcatttctttctctcaaatcagtcctttgaaaaattgacattataagaactgtattttttccaaagtcagcataattatgttctgtaaacctctaaaataattaaattttcctctttataaaaacctctctttaattgggaatttgaaaactgcctggatatttgctgatacttagtcattgttaataatttttgaagtatgataatagttttgtggttatgtttatcattacctttcaaagatatatactaaaacatttatagatgaaattatgtatagttcttggagtttactttagaataatttgaaaagcaagtggatgaggatataggtgaaataagattcatcatacattttaaatttgtgtagatcattgatgggttccttggaagtcactgtgctattctatttacttttgtatatggttaaagaaatttttaatgtctcttaatagatatgcaggtctcttattttgatcaatagaagctaaattgttaatctactaataaagttttgttttattttattggtcatgagaattttttccttccttctattaatagactaaagacattaaagagatagccaaaaagacacaagccctgccaaagatgaactcaaagaggcagcgaatcgtgatcttcacccaagggagagatgacactataatggctacaggtacatgtgggaaatgtgtgatgaatctagtattatggagattaatcaattacaaaaaaaaattctgtattctttctattataatatatacaatatacatatacaatatatataaaatgaaatattttattttaataaatatttctaccctgtatctcagtagaaaagatttcatgttcaagaagatagtttattaacatttagttaaataaaccactttgatataatttatttacttagttatcttggggattttgtcaatcaagaaatatctttcctgaaaaaaagaatacatttcatttataaaatacctgcactagagtaaaataaatttactcaattatgaacaaataaaatccagaactaagttacattttccatttttccttcaagaagaaaatctcattttttgttttatttcaccatctattttatagcactcataaaacaggaatttcatctagtaagcaaacatgttattgattaaaatgattaatagtgttaatatggagctacccactattaaaaatataaatgttttaattctgtctgtaccattcagattaaaaccaatcagttgattagttattgtaaactggagcaatttagtattacctatgtgtttgttcagtactctgctgaacactgaaatataaaataggaaccttaaagatctaactgggaattaatattcataaaatataagtacaaagtaaaatataattatagttcttatctattggtgctaactatatggattgtattgactcaggagatcagtaaatcttgaaaaaagatgttatagtgaatatgaagtacatttgtgttgaattaaatataaagcctgaaataggccaaagatgaaattactgtcaagatattttctttcttttttaaaataaattttattctttatatttgaggtttataacatgatgttataggatacatagatatatatagatcaactttcttatttcagaatggtcaaaagcaagattcagagatttgtttcaaaaaatatttgcttcaaagtagttcagtgagtggtagataaagtgagggtataaatgaaatgagactggtaatgaattaattgttgaagctagacagtggatatatgggggcatcattatgctattatctccacttgtggatatgttttaaattatccataattaaaactttaaaaaaagaaagaaaagtttttttttttaaatttcaaacaagattcagagatgttgagtggctttcccaagatacattgatatccttgctaatccttaaattctaggaaggattaaaagaaaggaggacaagtgggcacagtggctcacacctgtaaccctagcaccttgggaagtcaaggtgggaggattgcttgatcccaggagttggagaccagccttggtaacagcaagacttcatctctacaaaaaaaaatggaaaaaaaaaaaaaattagctgagagagtagtggcacatgcccatagtcctggctacttgggaggctgatgcaagaagatcacttgagcccagaagttcgaggctgtgttgagctatgatctctccactgcaccccagcatggatgacagaccaagaccctgtctccaaaaaaaaaaaaaaaaaaaaaaaagaacggagggcaatggagtcaaagaggatcaagtaagcaaaggcacaagtactagcaatcttttattgtgatggcaagaagaaccaccttgttaatttgtacaagagagaaaagaaaccatgaaaagatatccctgcactgatacaaactatctgaattgctttcttcctatagtataaggattattcctgtcttagcagtggacagtttagaaaagtgaaaaacatacaggcttcttataggaattgtagtactaccttcagatttacaaaatattctttggttgctctttgtggagacattcattttaagtctttgtatattctagatatacatactgtacaagtgtcttccttattgtgaatttgcagttttcccaaaattgaaaattaacctccccattctgtgactgtatttccttgtgaactcattttattctttattaaatctattaagccattcttaggaatgcttacaagctggaatttatttgaggaaagacactggctaatctttgctgttcctaccatatgaaaatgaacttaaatcaaaggatgcactatatctgcaatgcatgataaatacaagatggatagagaatctgttcagtggtgtcagctacaaaagcaaacatgataaatgttaatgcagttttgagccctgggataagctattcagtgcacaagtgtagctgaatctctttgctatgttgttattcattgcagccaaataaatgtcaataataaaagagaattaaagattttcatttcccagaggcagtcctctaatacggcttgatctttcatttcatttgtaattcgttctcatgtcaggatgcaatcattcgccaggctctgggtgtcatgttaagccatttaataatgattaagaacataaaaatgcttggcctgtggggcaattcacaaaagagatgccaatttgttattgttttccctcctttcctcttgaatatggatcagctttttcccacctcctagcattaaaatactaatggaagatagggagggaaagtgtcccttaatttaccataagtgacattccagaatggcacaaggcagtgctaacacacatattaaaagactaattaggaatcattgtgccttaaacctatttttttttaatgatactttaagttctgggatacatgtccagaatgtgcatgtttgttacatagttatacacatgccatggtggtttcctgcacctatcaacccatcatctacattaggcatttctcctaatgctatccctccctgagctcccccaccccccgacaggccctggtgtgtgatgttgccctccttgtgtccgtgtgttctcattgttcaattcccacttatgagtgagaacatgcagtgtttggttttctgttcctgtgttagtttgctgagaatgatggtttccagcttcatccatgtccctgcaaaggacgtgaattcatccttgttatggctgcatagtattccatggtgtatatgtgccacattttctttagccagtctatcattgatgggcatttgggttgactttgctattgtgaatagtgctgcaataaacatatgtgtgtatgtgtctttatagtagaatgatttataatcctttgggtatatacccagtaatgagattgctggatcaaatggtatttcctgttctagatccttgaggaatcgccacactgttttccacaatggttgaactaatttacacttccaccaacagtgtaaaagcattcctgttcctccacatcctcaccagcatttgttgttttatgactttttaatgatcaccattctaactgacatgagatggtatctcattgtggttttgatttgcatttctctaatgaccagggatgatgagctttttttcatgtgtttgttggccgcataaatatctccttttgagaagtgtctgttcatatcctttgcccactttttgatgtggttgtttgttcgttttttgtaaatttgtttaagttctttgtagattctggatattagccctttgtcagatggacagattgcaaaaattttctcccattctgtaggttgcccgttcactctgatgatagtttcatttgctgtgcagaagctctttagtttaattggatcccatttgtcagttttgacttttgttcccattacttttggtgttttagtcatgaagtctttgcccatgcctatgtcctgaatggtattacctaggttttcttctagggtttttatggttttatgttttatgttttaagtctttaatccatcttgagttaatttttgtataaggtgtaaggaaggggtccagtttcagttttctctatatggctagtcagttttcccagcaccatttattaaatagggattcttttcccccattgcttgttttttgtcagatttgtcaaagatcagatcgttgtagatgtgtggcattatttctgaggcctctgttctgttccattgatctatatatctgttttcataccagtaccatgctgttttggttactgtaggcttatagtatagtttgaagtcaggttagcatgatgcctccagctttgttctttttgcttaggattgtcttggctatacgggctcttttttggttccatatgaaatttaattttctctaattctgtgaagaaagtcaatggtagcttgatggggaaagcattgaatctgtaaattactttgggtagtatgaccattttcacgatattcttcctatccgtgagcatggaatggttttccatttgtttgtgtcctctcttatttccttgagcaatggtttgtagttcttgaagaggtccttcacatcccttgtaagttgtattcctaggtattttattctctttgtagcaattgtgaatgagagttcactcatgatttggctctctgtttgtctattattggtgtataggaatgcttgtgatttttgcacattgattttgtatcctgagactttgctgaagttgcttatcagcttaaggagattttgggctgagatgctggggttttctaaatatacagtcatgtcatctgcagacagagacaatttgacttcctctcttcctatttgaataccctttatttctttctcttgcctgattgccctggtcagaacttccaataccatgttgaataggagtggcgagagagtgcatccttgtcttgtgccggttttcaaaggcaatccttccagcttttgcccattcagcgtgatattggctgtgggtttgtcataaatagttcgtattattttaagatatgttccatcaatacctagttttttgagagtttttagcatgacggagtgttgaattttatcgaaggccttttctgcatctattgaggtaatcatgtggcttttgttattggttctgtttatgtgatggattacgtttcttaatttgcgtatgttgaaccagccttgcatcccagggatgaagccgacttgatcatgatagataagctttttgatgtgcttctggattcagtttgccagaattttattgaggacttttgcatcaatgttcatcagggatattggcctgaaattttctttttttgttgtctctgccaggttttgctgtcaggatgatgctggcctcataaaataaattagagaggagtccctctttttctattgtttggaatagtttcagaaggaatagtaccagctcctctttgtacctctgatagaattcagttgtgaatccgtctgctcctgggctttttttggttgataggctattaattactgcctcaatttcagaacttgttattggtctatttagggattcaacttcttcctggtttagtcttgggagggtgtatgtgtccagtaatgtatccatttcttctagattttctagtttatttgtgtagagatgtttataatatccactgatggtagtttatatttctgtgggatcagtggtgatctcccctttatcattttttattgtgtctatttgattcttctctcttttcttctttattagtctagctagcagtctatctattttgttaatctttgcaaaaaaccagctcctggattcattgatttttggaagggttttttgtgtctaactccttcacctctgctctgatcttagttatttcttgccttctgctagcttttgaatgtgtttgctcttgcttctctagttcttttaattgtgatgttaggatgtcgattttagatctttcccgctttctcctgtgggcatttagtgctataaatgtccttcttaacactgctttagctgtgtcccagagattcgttgggtctctgttctcattggttttaaagaacttatttatttctgccttaatttcattatttacccagtagtcattcaggagcagattgttcagtttccatgcagttgtgtggttctgagtgagtttcttagtcctgagttctaatgtgattgcactgtggtctgagagactgtttgttatgatttccattattttgcatgtgctgaggagtgttttacttccaattatgtggtcaattttagaataagcgtgatgtggtgctgagaagaatgtatattctgttgatttggggtggagagttctgtagatgtctattaggtctgcttggccagagctgagttcaagtcctgaatatcgttgttaatttttggtctcgttgatctaatattgacagtggggtgttaaaatctcccactattattgtgtgggagtctaggtctctttgtaggtctctaagaacttgctttatgaatctgggtgctcctgtattgggtgcatatatatttaggatagttagctcttcttgttgaattgatccctttaccattatgtaatgcccttgtttgtcttttttgatctttgttggtttaaagtctgttttatcggagactaggattacaacccctgctttttttttgctttccacttgctttgtaaatattcctccatccctttattttgaacctacgtgtgtctttgcacatgagatgagtctcctgaatatagcacaccaatgggccttgactctttatccaattccccagtctgtgtttttcaattggggcatttagcccatttacatttaaggttaatatattatgcatgaatttgatcctgtcattatgatgctagctggttattttgcccgttagttgatgtggtttcttcatagtcttgatggtctttacaatttggtatgtttttgcagtggctggtaccagtttttcctttccatatttagtgcttccttcaggagctcttgtaaggcaggcctggtggtgacaaaatctctcagcatttgcttgtctttaaaggattttatttctcctttgcttatgaagcttagtgtggctggatatgaaattctgggttcaaaattcttttctttaagaatgttgaatgttggtcctcactctcttctggcttatagggtttctgcagagagatcagctgttagtctgatgggcttccctttgtgggtaacccaacctttctctctggctgcccttaatactttttccttcatttcaaccttggtgaatctgacaattatgtgttttggggttgctcttctcaaggagtatctttgtggtgttctctgtatttcctgaatttgaatgttggcctgtcttgctagattggggaagctttcttggataatattctgaagagtgttttccaacttggttccattctccccatcactttcaggtacaccaatcaaatgtaggtttggtcttttcatatagtcccatatttcttggaggtttgttagttcctttccattcttttttctctaatcttgtcatgatgctttatttcattaagttgatcttcaatctctgatatcctttcttctgcttgatcaatttggttattatatttgtgtatgcttcacgaagtgttcgttctgtgtttttcagctctatcaggtcatttatgttcttctctaaactggttattctagttagcaattcctctaaccttttttcaaggttcttagcttccttgcattgggttagaacatggtcctttagctcggcggaatttgttattacccaccttctgaagcctacttctgtcaatttgtcaaactagttctctgtgcagttttgttcccttgctggtgaggagttgtgatcctttggaggagaagaggcattctggtttctggaattttcagcctttttgcactggtttttccttatcttcgtggatttatctacctttggtctttgatgctggtgaccttcggatggggtttttgtgtggacatcctttttgttgatgttggtgctattcctttctgtttgttagttttccttctaacagatgcctctgctgcaggtctgctggagttttctggaggtccactccagaccctgtttgcctgggtatcaccagcagaggctgcagaacagcaaagattactgcctgttccttcctctggaagctttgtcccagaggggcacccgccagatgccagctggagctctcctgtatgaggggtctgtcgacccttgctgggaggcatctcccagtcaggaggcatgggggtcagggacccagaggcaatctgtctgttaggagagctcgagcactgtgctgggagatttgctgctctcttcagagctggtaggcaggaaagtttaagtgccgaagctgtgcccacagctgttccttcccccaggtgctctgtcccagagagatgggagttttatctataagcccctgactggggctgctgcctttctttcatagatgccctgcccagagaggaggaatctagagaggcggtctggctacagtggcttttccaagctgcagtgggctccacccagttcaaactttttttgcgaactttgtttgcatctttgtttacactgttaggggaaaaccgcctactcaagcctcggtaatggcagtcgccccttcccccaccaagcttgagcatcccaggtcgacttcagactgctgtgctggcagcgagaatttcaagccagtggatcttagcttgctgggctccgtcggggcaggatccgctgagctagaccacttggctccctggctttatccccctttccaggggagtgaacagttctgtctcgctggcgttccacacgccactgtggtatgaacaaaaactcctgcagctagcttggtgtctgcccaaacagcagcccagttttgtgcttgaaacccagggccctggtggtgtaggtacccgaagaaatctcctggtctgcgagttgtgaagaccatgggaaaagtgtagttatctgggctggagtgcaccatttctcatggcacagtccctcatggcttcccttgactaggggagggagttctcgaccccttgcacttccccggtaaggtgacgccccaccctgcttccgctcgccctttgtgggctgcacccactgtctaatcagtcccaatgagatgagccaggactctcagttggaaatgtagaaattacccgccttctgcgttgatctcgctgggaggtgcagaccggagctgttcctattcagccatcttgccagccacccaaacctatttttaaatgatcacactgttaagtttgcagtacttagcaataatgtatcaaaatgtttccttggagttttattctacagacctatctccttttgagatatgatatacataaactactttgtcttattttataaatttaattctttaaattgcctgtaaatctaaagtattttccgctcaccctgttttatgggtcatacctctttcagattgagtttccatctaccctagaggttctgtcacataccaatcattgtttcagtccttgcaggttaattgagtttcaaaaaaattttcaagggagtgctgggcactgaagaatattaagagtaacaggctgggcaattccacagcagagtatatgtccaaaataattgaagcaggaacctaaacagatatatgcccacccatcttcatagcagcattattcacaataaccaaaaggtagaagcaatcaaagtgtccatcagcagatgaacagataaataaaatgtgatatatacatacaaaggaatattattcagctttaaaaaagaaggaaatcctaacatgcactacaacatggatgaaccttgaagacattatgctaagtgaaataagccagtcacaatgggataattactgtgtgattccatttatgtgacatacctagagtagttagctttatagacaaagtagaatgatgttagccaggggctgggggagggctgaatggaaagttattgtttaattggtaaaaagtttcagttttgcaggatgaaaaagttgtaaagatgggtagtgataattgcacaataatatgaatgtacaatggcactgagctgtatattcaacaatgcttaaaatgttacattttatgtatatttttattttttaagcatatttttcaatttaaaaaaaattaaacataacctaaagagtaagatgctgggggtgaaggcagaaaagatgactgtccattttgatcctctttataaatgttgaatgaatctgttgaataacatggcagtaaggtgaaggaaatcatttctgtgtttataaactggaaaaactaacagtgttctttacctgttggagagcaactactaatgagatcttcatacaataaaaccttattatattaagcatggtagtaaaaaagtaaatatatatatgtatgtaaatacatatatagtgctttatagaaagtttaaacttccccaagtttctatactaaataaatcaccaaaaattggagaaagcaatacaacttttgttctgaattggaaataatgtgtttccaattaaataggtccactgaaaaataaactgtagatttttctgtttcgtttgttttaagaccaggcctcgctctgtcacccaagctggagtacaatgacacaatcatggctcactgcaacctcaaccgggctcaagcgatcctcccttcccagcctcctaagtagccgggactacaggtgcctaccaccctgcccagctaatttttttgtattttttctttggtggagactggattttgccatattgcccatgctagtctcaaactcctgagctcaagtaatctgccttcctaggcctccctcctaaaatgctaggattacgggtgtgagccaccacacctggcctaaattgtagacttttctgaacactcagaattcttatttgaattgtaatttttcacaaagggagaaaatatattaagtcagatgttttcaactggaagactggtgctatcacatcaaaatcacctagtgagtttttggtaaatacagtcctaccttttttttttttttttaattttagaattgggggagggtgtgatactttttcagggttgttacatggatatattacataaggctggggtttgggcttctattgaacccatcacccaaacagtgaatataatacccaataggtagtttttcaactcacccccacccacttcctgcctccccctttatgtccatgtatacccattgtttacctcccacttataagtgagattgtggagcatatggttttctgtttctgggttaattcactttggataatgtcctctggctgcatctatgctgctgcaaaggacattatttccttctttgttatggctgcatagtattacatggtgtatatgtaccacactttctttatccaatccgctgttgatggacacttaggttgattccatgactttgccattatgaatagtgctgtaataaacataagaatgcaggtatctttttgatagaacaatttcttttactttgggtagatacccagtagtggggttgttggattgaatggtaatcctgtttttagttctttgagaaagttccaaactgctttccacaggggccaaactaacttacattcccaccaacagtatgtgtttccttttctctgtatcctcgccaatgtgtaatttttttactttttaataatagctgtgctaactagtattatgatatctcattgtggttttaatttgcatttctctgattattagtgatgtggaacatttttcatatgtttgttggctgcttgtatgttcccatttttaaaaattgtattgatttatttgtattttatagagaaagtgtcttgctatgttgctcaggctggtctcatacttcctgaggctcaagcagttctcctgcctcagccttccaaagtgctgagattacagacatgagtcaccatgcctagctgtatgtcttattttgagaagcatttgttcatgtcccttgcctactttttaatggagtaatttgggtttttcttgttaatttgtttaggttccttatagattctggatattagtcctttattggttgcatagttagcaaatattttctcctaatctgtaggctgtctgtttattttgttgatagttacttttgttgtgcagaaactctttagttaagttacaatggtcaatttttatttttgttgcatttgcttttgaggtcttagtcataaattctttgcctaggcctatgtgcagaatagtttctcctaggttttttctaggatttttatagtttgaggttttatgtgtaagtctttaatctatcttgagttaatttttgtatatggtgagaggtaggggtccaatttcattattctgcatatggctagccagttttcccaatatcatttattgaattgagtgtcctttcatcactatttatttttgttgactttgtttaagatcagttggttgtaggtttgtgggtttacttctgggttctctattttgttccattgatctatgtgtctatttttgtgccaataccattgctattttggttactataccctagtagtatagtttgaagtcaggtaatgtgatgcttctggcttcgttttttgcttaggattgctttggctattcagctaccctgccttcttaaaagcacctttctttcaatctgatacaaccctgtgaggagtattagaaaatacaacttcaaggagatgtttgagaatgcgggcagtacagtctggggcaaggggagtgtaggattatgtatggttgaaaatgttccctttggtgatatagcaatgctgtctatcctccacctgtcactttgagaatcactggattaggtgatttaataatgctgcaagttccgtaatctgctggaaaaacgaaaacagaactttttaacagctaagggtctagttcttcaataactcaggccttgggaaatgcttcttttttcgatccttcaaaatccatccacacttacaggcaatctacagtttactttaaatagtctcctacttttgaggtgcttataatttaacatagttacatcccaatgccctttgtcattttattttaagtaaatggggttattgacgttacttgtcttcatgttcctgagtccttaaagaaacgtgttacctcatctgctagttaagttttcatgttctatgaaaacactcaatgctgcccattactctgtaagaaaaggtcagtgtgatttgcaattctggtagacgtaaagttcagaaaatgtgcgttagaaaatgcaaactctaaaggaaaacaatctcagcattggaagaataatgtcagcacatgatcccaactcaaaatattaatataaatcattttgaaaatgtctctactacagccaaatcaattttaaatgataaccttgttggcttagattggtgatggtaaagatagaataaactaagtggcattcttttaaaatgtcttgtatggcattcatagaaaaaagttcttaccaggtaagatcttagagaaaatatatttctcacctatgaatgtaagttactaagttattagctcatggtccatttttagattattgtaatcacaaaagataaactcctttaattaattggtcaaaaataatttagaataacatgtggacctgtcacatttttgacaaagtagtatctttgggatgtggttcatttagttcagtgatctcaagcctgaagaaatgagacttctttcaactcccacctttttattgaaaaggatcctgctagaaggcaaaataagaggcaacctatcctaagcagatataagccctattatagcactgatttctggagggatgtttaagtcagatttgttgagatatagattacatatagtaaaatccacaaatatgttactaaataacatgtaacaaccaccacagactatagaccaccttgtacagtttgtattgaagtataatgtgcatacaaaattgatacaacttttcattaagtggatggacctgtgtagctataaccagatcaggaaatacaatacttatagcacttaagaagcttctccttgtgccccctcctaatctttatccccactgaaggtaaccattgtcttagcttctactactgacagttagctttgcctgtttttgaaatggaaccactcagtatgtagacttttgtctgctctatctccatccatttttgtgcactttcttactttttgacaacataagatcccccgggctcacgttgtattttctccacttcagtcctataatcaactatttctccaaggaaccctggttccctttattgaagaatggtttttagaaacctgtaactgtgctctagatatgctctttgttccttgagtgtctttgcttctaggccctcttagcaaacagaacttggcaatatatgtatgtataataacctatgtatactcactcatctatatttatttctgtatctatatgtttatatatttttaaaacatgaagtcatactgataaattttatttcagtccagcagcacaaggctcattctagccttcattcttccttttgtacaacttcttcctttgacattgaaaattctggctctcattatctaaaatgtatttacttatttgttttatcctaaagtagttttgaattgcttgcccatacccttgtatgagaaagagatttaccctttagagtataatatttgcttacagttctttttttctgtagcccaatagtgtccagtcaatatatagttatccaaagtaaattagctcttttatttcatccactcattatggttacattattcatttgtaatacaggtagggtcacttgttaagagtattccattttggtttcttttcacatcctgattggggttttattttctcaataaaattcactttttgtagtgtcaagttctgtgggttttgacaaacacataagatcatgtaaccaccaccatagttatgataccaaagagttacatttttcagctccggatttgcaaggatggtaccaatataaactcccccaattttatgagacggcactaattgttccacatctctaccaatatttgctactatccatctttttaattttagccattctggtgagtatgtaatagacctcataatgattttgattggaatttttctgatgtgtagtgagatggagctccttttcatctgcttactggtatttgtttttttgtgtgtagttttgttttgttttgtttttttgagatggagcctcactctgtcgcccaggctggagtgcagtggcgggatctcggctcactgcaatctccacctcctgggttcaagcgattcccttgcctcagcctccctagtagttgggactacaggtgcccaccatcacgcctggctcatttttttatttttagtagtgacggggtttcaccatgttggccaggctggtcttgaactcctgacctcaagtgatccacctgcctcggcctcccaaagtgctggggttacaggcgtgagccatcgtgcctggccttgcttactggcatttggatatcatctttgattgtattgttgttgggttcttttgcccatattgagttgtcttattgatttagaaatctttttacagcctgtatgccagtcttttgttagataaatgtattgtagatatctcctgctactctgtggcttgccttttcactctcttcatggtatcttttgataaacaaaagttcttgattttaatatagggcaattcataatgttttccccttatgattaatgcttcttatattccattaaagaaaatcatggcagatctcaaacttgtgaagatactcttctgttgtttttttctaaaacttctattcttttacttttttcaactagcacaattcatctaagattaatttatatatatatataaggtgtaggatagggagaatgattcatttattttgcccatatgaataaccaattgacctggcatcattcattgacaggaatatcctttccctaactgcattacattgacacctttgtcatgtttcagatgaccttatatgggtgagtctttttttaggctatttcattgtcctcattctctatcctttaccaattgcacactctcatgataacttaggtttataatcagtctttttatctggcaatgtcagtcttctgagtttgttcttcaagattatcctggcttttcttggctctttgcatttctacttaaattctagaactggcctgttaattgtcaccaaaggaattttttaaaaattccttactagagttttttcagattatattgaatctgcaagtcaatttggagaaaacttatttctttacagtattttgtcttccaatccatattttcctctatttatgcagtctttaatttttctcaggatgtttttttcttttcagtgtaaaggtcttgtatatgtatcttttgtaagattcttaggttttcgatgctatctatttttaaatggcatccttttaggtttctgtttctatttgttttttactggtatatagatttctaaataatgatctttttcacatattaactgcaataacatatcagataattattttggattttctatgcatataattataccatctgtgaataaaaataatttgcatttctgcttttccaattctcatacagtactttttttcttactacactagttagcacggtaagacatgtagaatacaagtaaattgaaatggttatagtgagcacctttgtcttattcccgatatcagttgaaaaaccatcaatattttatcaaaaaggataatgtttgctatagtctctttgtagatactctatcagataaaggaaatttctttccattaatagtttgctaagagtttttgttttgttcttaagagattttttaaaaatcatgaatagttgttgtatttcatcagataatgtttttgcatgtaaaattactatatgattttttcccttttttcttttaatgtgtgaattacagattgattatggaaagatatttcacctttgcattcttggaataatgccaacattgacatatctttttaatgtcttattggatttgatgtgatgttattttgttttctgtttgtttttttgagagagggtctcgtcttgtcacccaggctggagtgcagtggtgctctccaggctcactgcagcctccacctcctgggctcaagcagtcctcccacttcagcctcccaagtagctaggattacaggcacgtaccaccacgctaattttttaaattttttgaagagacgaggtctcactgtcttgcccagactgatcttgaactcctgggctcaagcaattcacccaccttgggctcccatagtgcggggattacaggtgtgagccaccatgccagccttgctttatgtattttaaagctatcttaactaagtgtatataaatttataattctcacgtcttcctgatgcattgaaccttttaccttatgaaatgtccttcttaatctctaatgatgcatcttgccttaatatctatgccagctttctattggttagtgtttacatgatatcttttttcattcctttattttcaacctttctgtgttcttatatgacttttgttgttttttaattaattctgacaatcttcatattttaatcagcctgtttatatttaatataagttactaatgtatttgtgttcatatcttacatcttactctttttgttctgtcttacatgtgtatcttcttttttctctcctttcctgctgtttttggattgatcaagtatttttttctttttcttctcatttagcttctcggtcttgccctgttgcccagactggagtgcagtggtgtgatctcagctcactgcagcctccaccttccagtttcaagtaattctcatgcctcagcctcctgagtagctgggattacaggcatgcgccatcatacccagctagtttttgtgtttttattagagacagttttgccatgttggccaggctggtcactaactcctgacttcaagtgatccgcccgcctcggcctcccaaagtgctgggattacaggagtgagccatcgtgcccagcctgaattctcagtttttgtttgtctgaaagtttccttttgcctttcaatgtgtatagttctctatgttgggagttatactttttgagttctttataaatggctttccattatcttttggattctcttatttttgttgagaagtcagctgttactcttattctgctcttttatatataatatttttattttctctagctgctttttagaatttgtcaaactttaactttatccttagttctggttttccttttatttatcctgctgggatttttagtgcttcttgaatctgtgattgatgactttcatcagatttggaaaattctcagccattatctctttagatactagaactgtttatacttgggaatctagttatacatatactaggtcttttcattgtatcccatatgccttttatgctctttgtgtgtgtgtgtgtgtgtgtgtgtgtgtgtgtgtgtgtgtgtgtgttttaccccttttcctccccgagcttcaggctgtatattttgcactgacctggcatttagttccctgattctctcttctgctttgtcccatctgcatttcaaaacatccagtgaggctgggtccagtggctcatgcctgtaatcccagcactttgggaggccaaggcaggcagatcacttgaggccaggagttcaagaccagcctggccaacatggtgaaaccctgactctaccaaaaatagaaaaattacctgggcatggtggcaggtgcctgtactcccagctacttgggagactgaggcaggagaattgcttgaacccaggaggcagaggttgcagtgagccaagatcgcaccactgcacacgagcctgggagacagagcaagtctctgtctcaaaaaaaaaaaaaatctagtggatgctttatttcaatagtcccttttttattttctaaagtatctgattatttcttattcatcctagttctgtagtataatcctctaccttgtcatctatttttttctaacatattaatcatagtagtaataaattctgtgtctgaaaactacaatatctcagtcatttgtaggtctggtttttaaagattttttttaatttccacataataattgcaaatatttatggggtacatagtgatgggtttggtgttttaagagagggtcttgctctgtcaccgaggccagaaggccagagtgcagtggcgtgatcacagctcactgcaacccgtatcttgcaggctcaagagattttcccaactcggcctcctgagtagctgggactacaggcacatgccaccacacctggctaattttttttatttttattagagatgaggtctcgctgtgttgcccaggctggtctcaaactcctgagcttaaacgatcctctcaccttggcctctcaaattgctgggattatgggcgtgagccacaacaccctgcccatcgtgatgttttgatacatataatgtatggtgatcagagcagagcaattagcatatccatcatctcaaacatttatcatttctttgtattgtgaacattcaatatcctccttctcactatttgaaactatgtaatatattattgttaactgtagttatcctacattgctgtagaacactagaatttattcctcctatctagctctaattttgtatacttttaaaaatctctccctattgcctcctccttcttacccttcccagcctctaatatcctctgttctactttttacttctgtgagatcaactttttttagcttccacgtacgagtgagaatacatagtgtttaactttgtgttcctggcttatttcatgtaacataatgtcttacagttccatccatgttatggtgaatgacaggatttcattcttctttatagataagtagtattcgatcatgtatatataccacactttctttatccatttatctgttgttggacatttgggttgatttcatgtcttggctatagtgaataatgctgtagtaaacatgggggtgcaaatgtctctttaacgtactaatttcctttcctttggagaaatacccaatagtgggattgctggatcatatggtagttctgtttgtttcttttctctgcatcctcaccagcatctgctttttttttctctttttaatgatagccattcttactggagtgagatgatacctcactggttttgatttgcattttcctgatgattagtgataatgagcttttttcccatttttttggccatttatatatcttcttttgagaaatgcctgttcaggtcatttgcccttttttaaaacagagtagagttttttgtttttatttgtttgtttgtttttttactgttgagatgtttaagttccttgtatattctggatattaattccctatctgattagatgagtaagttgtatgtatttttttctattccataggttatcttttcactctgttgattgtttcctttgctatacagaagcttttcagtttgacataatcccatttgtttatttttgcttttgttgcctgtgcttataaaaggttgtactcataaaacattttcccagaccaatgtcttgaagtgtttcccttatgtttccttctagtagttttattgttttgggtcttacatttaatccattttgagttgatttttacagagggtgagagctaggagtctagttccattcttatgcatatgactagatgcatatttagttttcccagcatcatttattgaagaaactgtgctttctccagtgactattcttggtgcttttgtcaaaaatcagttgactgtagatacgtggattaatttctgagttctctattctgttccattggtctttgtgtctgtttttatgccaataacatgctgttttggttactatagctttgtcatatattttgaagtctgatagtatgatacctccagctttgttcttcttgctcaggatgttttttaccatttagggtcttttctgattccacagaaattttagaatattttttctatttctgtgaagaatgtcattcgtattttgataagggttgtattgaattggcggatcactttgggtagtatataggtctgtttttttgtttttgttcggtttggtttctatttccttttggggcttgtttcttggtttgcctgataattttttatcaaatgttaaacattgtccataataaattatagagcttctgttagtgtagagtccaattagatctaggactaagccacctcaaggttgggttatagtttttgtaagacccagtctacctctcatttgcttccacttctataccatggccctcctggaatctcagctgaaatcctggtgtttttatgagatccctactcattaatgggttctgaactccaaattttatctgttttgtgtaccatacaactagcacaatcaccactctgccttatggatgccttatacttggtgtcttggcctcttgtcctgcttcctgacaagtgtggcaaataccttgagtagagtatttcctctcctgagtttcaggcctactttattgttttcccctcctcttcaggatcatgaccctcagttctgtctgtcttgacagtcccaaactcgaatttttgtcttaccacccactagagattgcaaaaagttatgttggcttctctgcctcttagtagtagtccattgcccagattctcagcctcttacccgacacaggaatttgcaaataccctagggagaaaacgactttttgaatgtcagtttagctctttaagatcctcttctctctgagaccttctcttgtcaaattttgactaccttgtcagctctctcatcccttctttatttaaaaaaaaaaattaagcttttctgcctttttatggtctgggaattggtttactacaagctatggcattagagcctaaccaataggtcccttattgaatacatttttttattattaaatagaaaaatacatagcccgagaaagttaagtgggcttatctgtgtattaaggaatactgtttttaggaatgtgacttaggaatactgttcttcataccgcactttgggaactgctggattaggtcactttcccaaggtctcagaattagaaacaaaagcagctagattagaacccagcctcggcctggtgcggtggctcatgcctgtaatcctagcactttgggaggccaaggcgggagggtcacctaaggtcgggaattcaagaccagcctgaccaacctggagaaaccctgtctctactaaaaatacaaaataagccaggtgtggtggtgcatgcctgtaatcccagctactcgggaggctgaggcaggagaatcgttagaacccgggaggcggaggttgcggtgagccgagatcacactattgcactctagcctggacaacaagagtgaaactccgtctcaaaaacaaaaaacaaaaaacaaaaaaagaacccggcttcttgaatcccagactagtccaatctgttccataccatgttaactcattggcttacatctgtggttttcaaccagaaacaactttcccccttcctttcagttatgacaactggctggtatggaagagttgggtcttccactggcattttgtgggtaaaagccagggatgctgctatatatactataatgcacaagacagccaatccacaataaagaattatctggcccaaattattaattgcctcaagattagaaaagccctgtcttacagtatccctcaaaatttatatatttaaaggatcactggctgattcctctttacacttaatcataaggtcaacaccaataggctttagtaggataaagcatctttatcctactaaactacatccagaggccctttgacccaagaaaatgtccatatatgatctagtccgtacttgcttaactgtgtttctcaaagcttttgccaaatatgctccaattctaagacttctctttagttagaatttgttagagctggaaaactttctggtgtagaattgtgcgtgcatatcttgtaaatgcattttgtatgcatgaatggatatctagatgatagtgacatttacctacacatttatagattttatttatatatatacacatatatacataatatatatgtattctaggcatatatatatatatacacacacattagtctaaatggttcttagaaaatttattcattttggtttataactctaatcaatttctataatcaaaagctcttgaaaatgtaatacaaatagatatttaattaaagaggtatattaccaaatgtttttcagaataattattgtttgtaccagtgagtatttctttcagaaattcaattagactctaaaattcatttttcagagcattacaacttggcggcaaaattttcttttggctgaaacactgcatgcaagcttttggctcagaaaaaaatctttggaagtatagctgaaaagtctgattcagataactgaatggctaaaattttccttgtttaaaaggaataaactggttacacgtgaaatattaaaaactgtatttaaatggatagttaactattgccttatttcttttaagtcttaaccaagctggcttatcctatttcaactgctctagaactcacatcatttttgattcattgattttttttttttttttagtatcccaatagaagccatcatttctaaggttccaccccaactttgctgagccttggcccagaaaatttgtttagcttttctctgctgttgttaagctattttaaattttaaatttttgtgtttttaaacctttctgtgtttttaaagcctttctggtttaataaacaattctaaaatctcaagaaaatatccaaattcttttgttaataatttggcacttagccatctattcaatttatttatcatggtaaattttgcttatacttaattatttcctctagtcctagaactccaccccttaccataataaaggggcagtttataaaacaggtgtttttgtaagtaatttacatggtttagtatgcaaaaagtacaataatagagctgtttagctgtcagtacttgtgaggaagtaagcagttttttcgttattaggatgaccatataacttattagaaaaactcagatgcttttgagagtgaaagagtggggtgctattaataatactaggacagttctgggcaaaccagcccatatggtcacactaatcattatagatatttaaacaaaaatatttggtaaaatgaatttgtgtattggttgaggtttttggctgtgtttatttctaacatttcttccagtgaaaagattcttgatcatgtgctaagtatatgccaggtaatatagaacttaaaaaaaacatgagaacctctaatctcaagcaggacaagttggagaggcaagatacttatagataatgcagtaatgtaacagcacaaataaattcaattcattatggttttattgagtgcctactgtatgtcaagaattgtggttataaagatgaacaaaacaaaaactccttttcttgaaatctagaagagacatacttaaataatatgatgtgaaaaatgatattattttcatgaactaatttttatagaacaaatggaacaagaagttggggaaagcttttcaaagcaagtgatgtatgaactaggccttgaggaatccttacaattttggcaagttgagattacaaaggtattcaaagttaatgaggtaataaaagcaaaaggcagagtccttcatatgatttgttacaagaaatggcagaagggagatatggggcaaccatctctgaaatggtaattgtgatgggatttaaatgctatgctgggcaatacattattaagtgcttaaagtatatatatatatagagaagacatcctttggactgagaaacattttgtgatcagtttaccgtaattccataaaagaaaggaatcacacttccatttgtttataaagccctgtttcagagggatcaacaaatactaaagatgaaaatcctttttttaattaaatgctaaagaataaaagctgcaataatccctctaaaaagtattagtgatgaacaatcccatggggttatagtgagacaaatgtgatagggttagaaaaattgtagagaaaaattatggtaaaagcactagggaaatgccttagaaaattaataaagattggcttggtttaaagacggtaaataaagactaatgcaaaaggctaatgaattcagtcatggagaaagtttatactatagtgtttgctaaaagaattaccactagatgggattttattaagcatttttttattcaaagaaaaagggtaactcattaataaaatgtgtagttgatactaaataaataaatcaactagtgtagttgatactaaattaggagatagtgtagttgatactaaataaataaatcaactagtgtagttgataataaattaggaagatactgtagctgatactaaattctagaaattctggtaatagactctagaaatagatgtttgaaataggtgtttaaaataatattttaaagaaaatcatattcaccccattttaaatccacatagaagcagcagttaacattaaaaacttgtgtccacttccaggagatagtcatggtttaagggtccagaaatcaatggtagaatcacctgaaatttagaacagtagaaatatgtcttcactaaagagtctaaattttttttttttttttttggaggagtcttgctctgtccccaggctggagtgcaatggcacgatctcagcccactgcaacctccacctcctgagttcaagcgattctcctgcctcagcctcttccaagtagctggaactacaggtgtgtgtcaccatgcctggctaattttttgtatttttagtagagatggggttttaccatgtttactaagctggtcttcaactcttgacctcaagtgatccacctgcctcagcctcccaaagtgctgggattacaggcatgagccactgcgcctggcccaagagtctaaatttataggatgtatatgattaaaagtgacttttgtgaacatttaaataaatatttgtgactgaattttctatggaacatttttccttcagtggcttgcattttaatgaaggaattattttaaaattaccttattccctcccaatgttgtttaaatatctagagggtatctagggcttaaggaagattggatgtggaacaatgagtggaggcctagagaacaagggtagtttcctgcaacagttatatggatccctagcaaggttcatatttctgtctatactgctggttaatctgaatattcccataaattgtggaacataatccatggccttggttttctgtttcttgtagtaagatttatcattttatttctaccataaattagagatcattacatgattactatgaaggatctacattgctatttgttatgatcaaataaacagtatttttgcagttgactattcagggatctgttaaagcatttagaccttaggccctcatagcatatatatataagctttttggagacttggctctcactactttgagaatttggcacacagggtaatcaaaaaaaaaagctttcttggctcttgcctgtaatcccagcattttgggaggctaaggcagaaggatcccttgagctcaggagttcaagaccagcctgagaaacatagcgagacctcatctctactaaaaaataaatagtaaaaaattatcccagcacagtgatgcgcacctgtagtcccagctaatcaggaggctgaggtgggaggatcacttgatccagggagtttgaggctgcagtgagctatgattgtgcacactccagcctgggtgacagagtgagaccctgtctaaagaaaaaaagctttctttcgaaatggcctcaggtttatcgatttttaatttaacattgctctacagatttattttgttgagtttttttttttttaagtactaagagtgttttgggcaggggaaagaaattcacagtgtttttttgttgttgtattttgttttgttttctgagacggagtctcgctctgtcacccaggctggagtgtgcagtggcacgatctcggctcactgcaacctccgccccctgggttaaagcaatcctcccacctcaacctccccagaagctaggattacaggtatacatcacctcacctggctaattttttttggtattgttagcagagatggggtttcaccgtgttggccaggctgatcccaaactcctgacctcaagtgatccacctgccttggcctaccaaagtgctcggattataggtgtgagccaccacacctggcctaccacaatgttttttaactgaacagttggctgcagtaagcttttagaagcctacacgttggtatttgagcatacgaggtggatcataatggggatcattaggtttctttgacaggtgatattaagaacccaacccagcatgccacttgtaaaccatctatacatagagacatttgtcaccattgacagttgtgacatttaatctgggatctatttgcaactcagcttcctatgtattactatgtatttaacagtctcaattcaggctcaaagcatcagcttttttcttctagtttttctaggttttacttaacaaaggaaaatagaaatatctgtttactattgaggtgatcatttctcctcagatgagtcatgccagtcacgattcttggatgttgacctcttgtgctgtttttgtagttcacaagccaaagctgcactaaataggattatggaaattagattaatggtccaggaatgaggcatagtgctttggttgaataggaaagtctgtaaagtggagccagtagtacctgaaaaaaacttaatccaggtgaggcagatgttctgaagaatctcactcgtctcacctggattaagtttttttcaggtcctgctggctccactttactgactgctattcaaccaaaccactatgcatcctttttggagcactaatctaactccaaaggggtacaacaacctcatcacttctaatatgaatacaaccaagatattgtgtgagctgagagtggcagaagaaaactggaaaaagctctctcttagatagccagtgtcacttggagaagtctattcttatgtaaaaggagttatattggtcttctaagaagaaaggttgtcaggaactggcaagcactaaaatgcctaaccaacaccttggagttagagcagtctagttttagaaggcagagactaggagggataatcagtcatagctaaagatagggaatctagaccaaagctcattccagttcctaggattagtgcagaatacaatttattaagctagaacagaagctttgcagtcacaattagatcatcacaacgtacatctggatgtcagaaataattctgcaccctactcttttttttttaagttaaagagactgtctcccaggctggagtagagtggagtgatcttagctcacttcatcctggaacacttgggctcaaacaatcctcctgcctcagcctcccatatagctgggactacaggcacacgccaccatgctggctaatttttttctattcttttagagacagggtcttgctgtgttgtccaggctgatttcaaattcctggcctcaagtgattctcctgctttggcctcctgagtcactgggattgcagggcaccctattcttgatttttattcttcccttgtcaggactagcttagaactgttaccccaactgtataagtaagtgcatccttaactatcaagacccaagaaagatatgagcagagcaaaatgaggagctcacgcaagcaaaattaagacttgaaatgtcagcagataaggtatctgaacatgtctatgacaggaagccagttgcaacttaactactgcagtgctaaattaaaccactgctatgtataccatatttgaagtaataattggatacaaaggtatatggcccttacttcaaagagcttatacttgtgaagtgtacactagaagacagtatgtagaaattttaccaaatttttatcaatttacagtatgaattttaccaaaaaattcactatagaaataatgcatgacttcacatcacactggtgatcagagaaacaatgtattttaaaagtgacatatgaactggtttgtgaaatacaaatgaaattttgatgcaaaatataactagaaatgaccttagatatcagctggtacatcttagaaattcgagaaaaattaagacccactactagtgggataaatgttggtgtacagtttttcttggtgacagcttgagaatacatatcaaaagccttaaaatatgcatatcctttgactcagtaactttacttacaaattaatcctatggaataatttaacatatgcacagatttacatgcaagaatgttcttcatagcattggtcttaaattttttaatttttttaacttctcattttgcagcaaaaaaaaagttgtaaaaatagtagatattttccatatatccttcatccagctttcccaaacattagcattttatataaccagagtacatatatcaaaaccaaggagttaataaataggtagaatttttgtcaaataaataaataaaattttaaaaccagcaaactactatagatgtgatactattattgaagctacagacctttttcagatgttcccaattatcccacttttttttttttttggtccaggatacaatctaggattctactctgtgcttaataggtaatcatattcttttattctgttactatctggcataattcttcagtctttttttctcctccttaacattaacacttttgaagagtactggccagttattttatagaatgtctctcaatttttgtttgactgatgtttccctgtgataaaattcagattatgcatttttggcaagaataccacagaaataatattatgctcttctcagtgaatcatattcaaagacgtgatactaattagcctcgatagtagtgatgttgactctgattcactttacttggttaaagtggtgcctgccagttctctccattgtaaagttagtattttttctttcttattgaataaatatctcatggggaggtacttcaagatacgtcttccatacatacatggattaatcttgcctgaaataattattactgtggtattagccaaagaattatattttatttttattattccttataaacttctcaattcaaaattatacacttattaatagagaagagctttcccctttttttgtttattaatttacttatgtcatatggactcatgaatattttattctattatttaaaatatattactatcactatttattgtgtttctcaaattgtcgtagatttgaccattggaagtgccctcaagttggttcttatgaacttccaatgtactacagttattttctgacttccttacattctgcgaccacaagatctccaggttcagcttgtgttttccttgccccagccatgaaataggaatttctccaagaagccctggtttcttttattgtacactaagaatttatacacacatctatatctgtgtctatatttaacctgtgtgcgtgtgtgtgtgtgtgtatgtgtgtgatatatatatgatttatttatttttttttttttgagaaggagtttcactcttgttgcccaggctggagtgcaatggcgcaacctcagctcactgcaacctctgcctgctgggtccaagcaattctcctgcctcagcctcccatgcccagctaattttttgttttgtttttttttttttagtagagatggggtttctccatgttggtcaggaatggtctcaaactcctgacctcaggtgatccacccgcctcagcctcctaaagtgctgggattacagacgtgagccactgtgcctggccctgtgtatatatttttaaaacatgagtacacagtagtatcacctattgcaatccaataccacagagttcaggactggcttagagctgttaccccagctctgtaagtgcagcctgaaccatcaagaccagggaaacatataagcagagcaaaatgaggagctcacacaaccacacatcctggttaattttaattaagttttttaaatatatagaaaattaccatggttctaaaagtcaagaactattcacaaagatagagtaaaagaagtgtcacttccctgacattactttttcgccattcttgttttagcgttcttcccaccctgttcccacctacctcttgtaggtaaccaatctcagttttttacttatcttttctgtatttcttctttttttttctaacagcttcactcagatataattcacacaccatacaatttccttatttaaagtatacaattctttttttttgtatattcataggttgtgcaaccgtgaccacgatcaattttagaacattttcatcatcccagaaactgtctctctccagcttcacccatcttctcccaaccttaagcaacgattaatctactttctgcctctatgcatttgccttttctggaaattgcatataaatggactcttacaatatgtggttttctgtgttaggcttctttcacttaacataatgttttcaaggttcatccacattatagcatgtgtcagttttttacttctttttattgccatgtaacattctattgcatggtttattcatttcctagggctgccataacaaattaccacaaagtgagtggcttaaaagaacaaaaatttattatttcacagttctgaaggctagaagtccaaaataaaaggtatcagcagggccttgtaccctctgaaaactctaggaaattgttccttgtctcttcctagctactgggctcctggaaatcaattcttggcattccttggcttgtagctatatcacttcagtatttgcctctgtcttcgcatggccttcttccctgtgtatatctttctgtgcccactccttttattttaaagacaccaataattggatataaggcctaatctaatctagtgtgacctcatcttaactaattaatctgcaaagactttatttccaaacaaggtcacattctaaggttccagatggacatgaattcaggggcaacactatttagctttctacatatagagatacaacattttatttacctattcttcagttaatggaatttcattcctgtatttatttatgcccagatgagcagatacatgagcattttcttatttctccttcctttttatttgaaaagtggcatactgttgatatgtttgttttttccttttttcagtttataatatattctggaagttttttcatatcacttcacagagctctagctcattctaatctaaatattcagccatagagaatttattaatatatacataagatggaaattgatttagtattttaatttttatgaacatggaatgatgtatacaatatattggggatgttttcttctataggttttttaatctgtgttttcaaggtattatattcacacagtatgaaattcctccttctagatgttacccatctaatcagccctttcccagagtgaaccaatgcttccactgaatgtcagctatacacattgttccacaccttgcctttttgcttaatatatcttagagattgttccatttttttatagctgtataatatttcattttcttgtcacatcatactttattttactaatcctcttttggtacacatcttggtatttctagtcttttgctacaacaaatataacagcactatttgcaatgaccaaaataattggaaacaaccccaaaggtccataaagagtaaactgaatatattatatatttatgtgatagcatacataatgaagagagaatgaatggattaccactcaactcaacaatatcaatgaatataacaaacataatgtggaacaaagtcagacccaaaagagtgtatacagaattccaaactaaatagggtaggaatagctcatgtcagaacagcccttcttcaggtagcaattataactcttaacaaaatattacaaaaccaactacctggagacactggagaagaatgaaaatcaggcagaaactgaaggagagtctatacttggaggaggagaatggccttgagtacatttcctatttttatgactctttctctagggccagcccaagttggcaccaagtagcatgcctaaaagttggtagaaaacacgcagtcttactggcttgaagatccagaggaagagtttaggtaaaaagtgagtgaggaaatttcagaaaggagaaaaaccatacagaggtagccctaaattctacatacagaccttatccaaatctctggatgacccctcaattacgcatatgcagagtggattcctagcagcccagctaaggctaaaagaacttaataaagatgtctcattgtccattgctggggtgcagagtttggaatttcattctagccaagtttacttgtctccttaaaaaaacaataataatcccctccttagaaacatttgagtagactgtacaacagaggtcagcatttttatttattttttttttttgagacgagtctcgccctgccttccaggctggagtgcagtggagtgcagtggcgcgatctcggctcactacaagctccgcctccccagttcacgccattctcccgcctcagcctcccaagtagctgggactacaggctcccgccaccatgcccagctaattttgtttttctatttttagtggagacggggtttcaccgtgttagccaggatggtctcgatctcctgacctcgggatccgcccggcctcccaaagtgctgggattacaggcgtgagccaccatgcccggctggcatttttttcttaaaggaccagagagtaaatattttaggttcacagggtactctttcagtaatttaaatatgacaaggagcaaacttgaatataggtatgtagaaattatcaagtgtggaaaatgaagagaaaaaaaacaatgaacatggccgggtgcagtggctcacacctgtaatcccagcacttttggaagccagggtgggtggatttcctgaagtcaggagttcgagaccagtctggccaacatggtgaaaccccgtctctactaaaaatacaaaaattagctgggtgcagtggcacacgcctatagtcccagctacttggtagggtgaggcaggagaatcactagaacctgggaggtagaggttgcaatgagccgagataatgccactgcactccagcccaagtggacagagcaagactccatctcagaaaaaaaacccacaaaaacagagaacagagcttccttgacctttaggacaacagcaaaaggcctaaaatgttcataattggagtctcaaaaggaaaggagctagagaatgaggcaagataaatatttgatgaataatggctgtaaggtttcccacttctggtgaaagacatgaacttacagatttgggaagccctgtgaaccacaggcagaataaatacaaagaaaaccacacctaaacatttaattagactactactgaaaccaaaagatgaagagaagatattgaagagcaaagtagcacattgcatagaatgggaaattatatgaacaactacagattccttacagtggagatcaaaagaaagtggaacatctttgaagtgctgaaacaaaactgtcaacccagaattctatctccagcaatattttccttcagtgatgaaggtgatattaaaacattgttatataaacataagagtatatactatgtgattccatttgtataaagtcaatggaaacaggcctcaagttacttttgatggggattagtaattgcaaggaggggagggaatttttcaccataatgaaccactccataaattagtaacataaaaaacagcagttttattttctcatgattctccagtcaaggctaggctcagccgagtagttctacttgtcttgacagtggtcacttgttggctacattaaggtagtacgttggctgcaggctagactcattagggatgttcagaactctctatttagtctaaaggccaacatttccagagtcagacttccaatttgtactcttctctgtatgtgtcatacctcaattaaaagcccactttcagactaggtgcagtggctcacacctgtaatcccaatactttgggtggccaaggtagaagaattgtatgaggccagggattggagaccaacctgggcaacacagcaagaccccatctctaccaaaaaaaaaaaaaaaaattagctgggcgcagtggcacatgcctgtagtcctagctactcagaaggctgaggcaaggaggttcgtggagcccaggagttcaaggcagcaacagtcagccgtgatcacaccattacactccagccttggcaacagagtgagaccctatctcaaaaaaaaaaagtctactttcaaagggcaatagataattatttttttaattacaatctaacaaaaatagaataatctaatataaatagaaactacaaaatgttccagaaaatgtaagtattcctgtgtgactagtgtagaattaatataagaaacattaataggtgataaagtaaaaaagataacttagggttagattacactgagatttgagtgcttggctacagagctgggtcttatttgaagggaagtgggaaactattgaagggttttgagcagaggaatgatatgttcaaaacagtggtttaggaatataatcccatgctagtgtacaaattagactagaggagggagagactattatcaaacggatcaatttggaaacaatttagataagcaccaataggaattgaattaaaataatagcaagctaatgaaaaaaagggaataaaatgtattaattctacatctacacagattgagagcctactatgttctatgtacttggtaaaggactgtatatatttttgtctttatagtcaaggaattcacaacatatgaaatgtagaagtatgaaaaaataacaatttgttgtaataagaactataatagatgaatatttaaggtgttaaggacacaagaagaggaagcagccaataatacagaggagtctaagacatgctttagataagatttaaccttacatgagtagttacagtttaccaaacaaagaaggcaaagaacaacattctagccagaagaaacagcacataaaaagtcacaggcaaagaagagtagagcatggtgaattgggggacatagttcactatatctacatgtgcaagctaagcataggtacagaagctagaaagataaggatcacatcactaagggcaaaagacatgaaaaatttggtgactatatgagatgaaacaagatttagtgactttataagaagacaaggatgaccttaatattttgaatttaagtgactagaaggataatgataaacccaatagtaagaattgtataacttatagacacttttcatctgagtggacattaaatacctaggagttctttttatatgtgtgtgaagaatagcactagatgtgtttcatcaatgaaattctgaatataaaataatcatcataggttcttaaagccagtcaacaaccaagaattgatactgaccactggcacagtttttttcaaaaatgacaaactttaaaagaaaaaaaaatgccttgaatgaatgtttttcttaactcagaagaaaagaaaaatctttaactacatatagcttacctgaagaaaaaacagaattgcagaattgctgtgaatgttctaaagacctggttctatataatcaagttaattcctctttcatgtgttttaaaatattgttgatccaagaaccaaccatcagctatgctggaagtctataattatgcattgatatatgagaaggctatcattctctacagacgactggtaccatccttagcagaatacttgaggctgcttttggtttagggaatctgtagctcagagattttcctagaaagtaacctctgttgttcaaattagatagccatttgtggagacaaaacccactgggtataggtagtattacctgaatcactaaaagataattgattagaaatccaaatcaaaccttgagactgctgagtctagatgagtggctgcctagggatagagggcaggaaggggtgggaccttacaaagacacatgaagaaacttttagaattgatatgtttgttgttttgattgtggtgatggcttcatgagtaatacctattcaaacttttccagttgtacacttaaatagtgcagtttattgtatgtcaatcatgcttcgataaagatgttagcaaaggaaatgactttcatcttagaatggtcagataaactgttttaagtgctacaccattatccatataaagaagagatggccatttaaaaatatttatacaagacttgaagcaatgtaggtaacctgaggtataataaattgagtgtcttgatatttagagtcctgatgtaatacactttattaagatatagatttgtaaatttatgctaattctggatgattatttttcttgagttggtttctatggactgaatgttaaagtgggttttaagcaggttttatataatatatcaataccacattagcttgattttttttattgcgagagatgcagaaagatcaatatcttacatgctctatatcaccataaatactttcaataaagcttttttggcctggtagggtgactcacacctgtaacctcaacactttgagaggctaaggctggagaatcacttgaggccaggagttcaagaccagcctgggaacatagtgagaccctgcaaaaaaaatatggaaattagccaggcatggtggcacacgcctgtagtcttggctacccaggaggctgaggcaggtgatcacatgagctgaggagctcgaggttacagtgagctatgatcataccacttgcaatgtagcctgggcaatagagtgaaaccatgtctcattcaatcaaacttatttgaaccttcgtacatttttgcttttattaatgagcttttcttttaaaatcagacttttaatggctttctggcagtgtcatcctggttgtggttgagactaatatgagctctagtttgtgttttttgttattgtttttgtttgtttttttgagacagggtctctctctgttgccaaggctggagtacagtggcacaattacagctcactgcaaccccttcttcctcccagactcaagtgatcctcccacctcagccttccgagtagctgggactataggtgcacaccaccacacctggccaatttttaaatttttttgtagagacagggtttcatcatattgcccaggctggtcttgaactactggactcaggtgatccacccacctcaacttcccaaagtgctgggattataagcatgaaccaccatgctcagctgagctctaattactgaagattaattctataggttgaacctggatatgttagaagacataggggactttcataaagaagttcaaattagaatatgtgagataggagaattttttaaaagaattgttatttgatacttagggtgtagtcatatactcttaatattgctagagtgtaaattggtaaaagttttcatatccttttatacagcaatttcagctcttggaatttaaataatcaaaagtctgggagcatctacatgtgaagacattcatgtcacttttatgtataatagtgtagcaacttgaaactatatatattatgttacatgaaaaataaactaacacagtgggttcattcactttgtgaaacttcatcacttatttgaggactttgagtataaacaaatcagaatataaaattacctgctattacgaagtagcaagagaggctgggcacagtggttcacacctgtaatcccaacactttgggaggccgaggggggcagatcacttgaggtcaggagttccagaccagcctggccaacacaataaaacccatctccactaaaattacaaaaattagccgggcgtggtggcatgtacctgtaatcccagctacatggcagactgaggcaggagaatcgcttgatcccaggaggcagaggttgcggtgagccgagatctcgctactgcactccagcctgggtgacagagcgagcaagagcaggcgagcaagcgagactccatctcaaaacaaaaaacaaaacaaaaacaaagtagcaagagtgagtatgccagtgtgctgggggtaagatgatttagatactctgtattttccatgtcttattttcatactttaaaaaacatatcagttgtttctaaaagaacatattccttttagttacaaacatatacattcagcaaccctaaagtagcatagactactactggctgaagctctggggttttattagtacagtgatgacttaattaacaaatcctctttgaacaaagcctcttcactcaagactggccttggtgcagtaggcatgagagaaggaccagttttctctgagctagatcggtagcagcagggactaatgaggcagggccttgaaagtggctctctctcagatctaactcctcagggactggctaaagctgaagctgagggtactggtgcactcctgggacctacacagcctggttacccaggtgttgaaaaaacagtttctgtgccaacaccatatgtggcttttaagagactcggcaggactcttgctttaggcagagcattccttgtgtggaatgagtaagctggaaaataacaaagagggaatcccatgtgctaggaagcttcctcttgtcttctgtgtgctccgtgtactgctttttcaattctctgggccttattttgttcaactataaagtaaaaggagtagctaaaaaatctctaatatatctttcagttctaatagactacatgtttaaatcaggaatcggcaaactttttataaagggtcaaatagtaattattttctgctttgcagggcatactacctccattgcaagtgctcaactctccctctgtagcgtgaaaacagctgtatataaacaaatgggtgtggctgtattccaataaaactctatttataaaaataggcagctagccagatttggcccacaggccatattttaacaagcccaggtctagatgttaatgtaatgggaatgtcatattaagagaattatttgatgaataggatataattcttatttcatagagaccattctctcagactttttatttttaaagcgtaggcaaatataaaatattatttcactgtcaggatgtaataccatgggaaaaagattaaaaatactctggcaccaaactgttgtagtaaattatctgaaatagagcctttgacttcccaattaaggaagaaaatggtgtctgcaacacctgtgactgggttattttaagtcttcaaaagttaggggcctagtagaagagagtctcaagggcttgttcattttctttctcatcaaatgggccaaatcatgcttttcatagtagaaggtaggctgtggaccctttactattttatttttaaatatttctcttggctaggcataatggcccatgcctaaaatcccaggctgaggcagaaggatcccttgagcccaggagtttgagaccaccctgggcaacatagcaagaccccgtctctactaaaaaaaataactttttaaaaattaaaaataaataaataattttttggtggtccagaaaggggcagctgccatgctttgcaggtttcagatccccatctatcttgggttgggtttctatcttggtcttaagttatcagtattctaatatggagataagtctgccttcactttggagacctttgttagttcttccatgtcaggcttcagctagtatagtttgtctaatgcatttatataaaacttgtttccaacaatgaaaaagcaattacaggttgggatatgtaattcaggcccattactacataaaaggatcagcacagtggtactttatctgactagggaagtctaaaatattcttgttggccagcttgctttcacataagcactgttcgggatcttttctaagttgcagaacatgaattccttattggcctatcccactagccacagctgtgagcacaacagaactgacacatacctggtaattataccttatctaaagtgaacagggccaccttcccagcatagtgacagctatagcccttaatctaatgcagtggttctcaaagtatagactcactgggggtgccctttctgaggctctttcaaggaatctcttctatgaaatcaaaactacttcacagtaattcaaatatattatttgcctttttgactctcaatgacagtagagttttccagagactacataatgtatgatatcacaacagattgaatactgaagcaaatgttaagaatccagctgacttctgttaaccagatattaaagagattagcaaaaacttaaatgtcatactctctactaatatttttgtttggaatatatagttattcttatgaaaatatgttaaaatgtaggtttattcagaaattttctgagatcattttattttctaatacagtaaatattaataaatatgactcacacaaaatctatttggagtcctcaatttttttttcttttttttcctggcttacattttttgatgcactcaatttttttttttttttttttaatttaaaaagagacagggtctcactatgttgcccaggctggtttcaaacttctgggctcaagcaatcctcctgccttggcttcccaaagtactggtattacaggtatgagccagtgcacctgacctcaataattttttaagagaaaaagtttgagaacccctcctctaatgtaatacccttagttgcaatactctgatctcatggttactgatatcatctttaccatattccctcttataaaatatttactaaaattatccccagagataacccttgttaacaatttagtgattacttctagacatctttctactgagtgcttgcattcacacataatatatatacttttacatttattggatcatactgtggtctttcaaaacttattctcctgagtttaatttttctacctgatcactctctgaattcttataaaatcttaagttcttttttttttttttttttttttttaagacagggtctcactcagtcactatcacccaggctggagtgcagtagcatgatcatagctcactgtagcctcaaactcctgggttcaaaggatcctcttacctcagcctcctaagtagctaggactacaggtgtgtgccaccatatctggctaactttttttatttttagtggagacaggcatctcactatgttgctcaggctggtctcaaattcctggcctcaagcaatccacccacctcagcctcctaaagtgctgggattacaggcatgactcaccatgcttagcctaaatcctaaggtcttaaaattgaaagggacagaggggtcatcttatctcattcccaactcaagtcagaaaccctctctaaaacattcacaacctgagaggtccatttaatttggttttataaaccctaaattgttagaaactttttccttctcttggacataaatttgccttcttgatcacttttacccataggttctagttctactttgggaaactatatagaatgcatcttatctgtcttcactgggcttcattgtgggtattttcttctgttctatcttccagttcactaattcttttttaagttgtgtctaagcttctattaaaactatccactaaatttttactttcaatttccatttaaacctgttgtattctagtcctctgttaaaattctcgattttatctttaactcttgctatttcaaagtttctgtttgttaagttcaatatctggaactgctttattaagctgtaatttctgctggttttaatttcctgcttgcctctttgtattactgtttattttttattgtgggtgatatgttgtatttgcaaaattgcttatagaaataatttgaagtataggatgattcatgtttgcttttggcaggcatggggacattggcacactatatttatcttcatctaagtttaaagatttagatgattagaggctaagctacaatcccttgtctaggtctttctactgcctgttcacacacccttaatccttttgattcccaccctgagataaggagattttaactaggcccattactcttgacagactgggttccagactttgtcctcctagcatcaaacaccagactcacttctctgggtttctatcatcctctgtattatagcctggtaattcttcattcttttgttaggacttcaatgccttcaaacagattttttaaaaatatgtccagatgttctaattcttgataagacagttggtctgaattacctaggctgccattagtacctgcaacctactttaatccgtattaatatttttctgtccttctggattgcttgggaaactgttaaagagcaggaataaccctgaccaggcatctgtaccacattcaaccagatgctctgtaagagctcctcttgaaggtttaatctgatattaatcagataggaagtacagttcttatgaacagattcagtcttcccacagggatgagttcagttaagaggggcaatggatacggtgtacagtggccccattttcctttatgtttatattctagtcttgtaataaaactaatgctcagaatgaaaggtctcaatttaggatttaaaccaagtataaacaaaaagttaaaacaagctattgttcaaactttgacttaagtgaaagaattggtttttttatttgtttgtttatttttgaggcagggtcttgctctgccacccaggctggagttcagggatgcaatcatagatcactgtaacctcgaactcctgggctggagcagtgctcccgcctcaggctcctgagtagctaggagaacaagtgacaccacacccagctaattttttaatttttttgtagagatggggctttgtatgttgcccaagctggtcttaccttctggcctcaagtgatcctcttgccttggcctcccaaaagtgctggaattgcagacatgagccaccatacccggcctggttttattttaaaaaacacttttgctgcccttctgtaaaatgttaattatatgtatgcacattttcttttatctggtgcttctctaaattcctttagcccacgtcttatccaactagtcatgtgggaatttcctctttggggaattaaatatttaatattaacttctaggtagtacagagcagcccactgtgtttcacttttgtattattcctttgttagcactaagttttctgtatcagcttgtctagaatttttgtttcaaaattgtattcttctaatttatttgcagtttttctcttctaattgtttaattgtccatcccctaccccctgccccaaggcaaatgtactgtcttttatccatatgtgcccataaattctaaactcaaagatttctggttctcccttatatttatggtatttttctacttctctgttcagtatatttttgcaagtgtttcagttttcttcagtgtttgaggttctctagtgtgtcatttcattttcatgcatcagagtaattcctaccattcttatatggagtctcttacctgatgattttttaattagtaaagtgcaatattgaacaacattgaagattttatttcttaatctaaaacataatatttatttaataatgaaatggaaatataggttttgtgaaagggagaaaggtgtttctctaaatattatacctgtgtcaaaaagctgcaagtgctactaccactgttttgtgacccctgaatgatttctgctttctttatattaatacttactctaatagtaattgaactcccaaaaagatcacaaagtccccaattgctagctttataaatacattgatgtgtaccttgtttgatgagataaaagcttcagtaagtgatatccccacctgtgtggttaatttcaaaatattgtttgtctaatacattgttgtcagtgacaactgaacaagaacttttagaagcagttggctgtccattaatggcagatttcaaggctatgcaaattgtgccagttcagccctgcattttttcgatattatcatatcaattgagtcagttcagagtagacaaagcaaggttatgggaaccacctagagcatcatgcaccatttaacatcaatgcagcatacatgaacatctgcaacttcgatcttattaacagaggatagaatggaaggcagtaaacagctttcttcatcacttaattgcaaaatagtatttcctaatgtttgcattgtttatcaacacgaacttcatcaataattgtataattatggttgcctagatcacagtgccctcatgcatcttgtcacttattatagagtggtctgagtttaatttgaatttgaacacatgatacaaggataataatacaagttccttgaaatgtgagttgcataatacaaaaattttgtgtagtaggagaatggcaagttatgattcttcagtcactttggggattaacacaaggaaaaacaggactgaaaggcagtgaaagatgaggggaagccactagttagattcaaacatagacccattggacatgagagtaggttatgttccttagaattaatcatgagtaattcgatgtttgctttaggcccaaattgagctgaattaaaacaggattattatgcttaggtcttcccttcagtctctgtagttaaagagagaaaatggcagaaaactacaaatatagtgaggaaaaagctatggtggccaaagttaaaaataccacatgctgaggaaagccttgacatagctgctcagccttcattgctgttgcttttgaagcctgataatgccacactactcctaattagcaaatgttagtattacagtaagcaatcaagtgcagtcttcaggctttgtggcagcagtttcgcagtgcaaaatattgaagaaaaaatgaaggaaaacaatataagctcagccacagttattggtgtggtcagtgggagttgtctcacaagagagcaggaaaaggaaaatgtgaaaaacagtgggtgcatttaaagcatgtaagacaagagctggctagtctgaaaagtttgtctattttaatcatgaaaatctcacatttttacttaaatccattttatatttaaggaaaaatctaaggcttgttcatgaaattacacttgaaatattttaatttgtggttagagtctcctccccatctcaaattaaaaggtattaaattgtatattgagtgagctccgtttgtactcagctcttcccaattaataaacatagtcatttccttaaaaaaaaaaaactctagagttagaatgttttctctcactaattagtctgtatttatgcctttaataattatctgttcattttctagcagcaaatgtttgttctcagattaaattggagaaggaaggaaaaaaaagatagctacccacagtatagtatccacagacgatatagagttatgtccctctttgtgtggttcttgagtataatagacataacagaagctttcttaatatgatagttaatctattattttctgtatttgggggatgctaagaactggtttactagaggtaatagtttgatctgtagttatttatgttaaaatacttttttaaaaggtaattacagcttctactataaacttgaaaaagttggtctaactctgtgccgaatgagcggggagatattactatatacatacatataagtgtatatgcctcttacctgaatacctcagggagcacacttttctgaaccagggttttgtaataaatgtgtgtactactaattctgacacatgtatagttctcctttaaataacttgtatgcaaacgttattcagaaacgtcttctaggagctatttatcaaaactgctataataataactttgtcctaatgagtttcagtctctgtttagggagtaatcgataaactacaaattaatgttccataattcacattataatgcacatataattattttgagatgaggcaaaccctatgcatttaatttacagctataattaagtaagctcatttgatactaattaagtaagtctaaaaggatcataggtttgtgtatttaattatcaaggtacaatcagcaactaattccttgaaaagctttcctatcttcagttcaacactgatctcagcccacactacaatttatcttcttgcatcttcaatagattaaaatgcattgtgaattgtggagaatctacttggtaagttagcttctttatttaaaaagtatatatatgtatatatatatacacatacataggcttaagaatacagaaattctataatctggcaaaactgtccttaagaagtgaaggagaaattaagacatttccagataaaagataaagaggtttattgccaatagacctgtcctacaagaaatgctaaaagggaatgcttcaggattaaatgaaagaatgctagacagtaactgaaagccatatgaagaaataaagaactcctgtaaaggtatctatataagtaaatataaaaaccagtattgctggtttgtaactcttctttcattcatgaaaggaaaatgcctaggccgggcgccgtggctcacacctgtaatcccagcactttgggaggccaaggcaggcagatcatgaggtcaggagatcaagaccatcctggccaaaatggtgaaaccccatctctactaaaaatacaaaaattcgctgggcgtggtggcacacgcctgtagtccctgctactcgggaggctgaggcaggagaatcgcttgaacctgggaggcggaggttgcagtgagccgagatcacaccaccgcacttcagcctggtgacaaagcgagactccatctcaaaaaaaaagaagaaaagtgcctaaaacaataattatatgttaatggaaagacatgtaaaatatgtaatttataacaacaacataaagagggaaacagagctgtataagagcaaggttttttatactgtccaggctaagttggtaacaattcaaactagattgttatgaatttaggattttaattgtaattgccatagtaaccactaagaaaataagaaataggtcagggcgcagtggctcacacctataatcccagtgctttgggaggccaaggcaggcggattacgacgtcaggagatcaagaccatcctggccaacatggtgaaaccctgtctctactaaaaatacaaaaattagctgggcgtggtggcacgcagcctgtagtcccagctacttgggaggctgaggcaggagaatcacttgaaccccggaggtaggggcaggagaatcacttgaacctgggaggcggagtttgcagtgagtcaagatcgcactactgcactccagcctggatgacagaccgagactccatctcaaaaaacaaaaaaagaaataaaataagaaataatgaagttttctctagttttgttaaagtagtatataaaaattagattattagaaaatacacttaattgctagcttagaagtcttttaaattctactgtcagccgggcacagtgtctcacccctgtatttccaacactttaggaggccaaggtgggaggatcacttgggcccaggagttcaagaccagcctctgtaacatagggagaccctgtctacaaaaaattaaaacaattagccaggtatgatggcaagcacctgtcatcctaggtactcaggaggctgaggtgggaggaccacttgagactgaaagattgaggctgcagtgagtcttgattgcaccactgtactccaacctgggcgacagagtgagactctatatcaaaaaaaaaaaaacaaattctgtcagtcaatcaactaatattcaagtatttaatatagtaggcttcctgctaagtttcaacaattgtctccatttcttcccactaaattttttaatgtatagtcaagaaggaagagctatctgatgtctagagtgacattctagtgttgggaaatgctagataagatgttcacattttcagatttcccagccacatttaagctcaaaaaatatgaatacttgtccccatgactttcctgaaggtctaaaagatatttctgtctccatcccttcaaaaccaagatacctgattgtgaggagtagaagacccctatatggtccagtgtatgttctcttcaatctcaaagcgtgtttagagtattgccattgctatcagaaatgtgaactttcccctcagatcctagattttcagattaagctaatcttagaacatgggctttcctccttccttatcagaggccactgtggtaaaatattatagaaagtaattgttggccagtcgcagtggcttatgcctgtagtcccaacactctgggaggctgaggcgggcagatcatttgaggtctggagtttgagaccaccctggccaacatggtgaaaccctgtctctactaaaaatacaaaaattagccgggtgtcatggccggcgtttgtggtcccagctactcgggaagctgaggcaggagaatcacttgaacccaggaggtggaggctgccaagatctcgccactgcactccagcttgcgtgacagagtgagactctgtctcaaaaaaagtaataataataattgctaatacctaatgttgcgctttacagctcacatagaacatttacttatattatctaaaatgaggtattaaaatagatgaacaaactgatatctgggctgggagggagttgttgcttcttttatttctttggggtactactagcacagcctgtcagtacattaaaaatagagactttttggcattactttgttttttccaagattaactagcacaacacaaatttcttgtgcctaggtgtaaccagtgttgagacttcacataccacacacaattaatgacatcaaccttgcagtactgacagcgatatcatgcccagtttgtatatggtgtctgggtcatctgaggaagttaaaatagtattgtgatctgtgaacaggccaagtctagcaggtgccatttgcatagactagaatataaatagtatcctctaaagctatatgatgtaatgtccctaaaatgaattatctcccatcttctttcattctcagaaacaaaaatactgattcttgtattgtttgatggaaaactattagttgttcaacataaccagcaaagtataaagacttgacacctaatggcttctgttttctctgagagttagaattagtatgtagcttaagaagagctgtaggcatttagaatgatatttggggtggtggtggggaaatggaggcatcagctagggatagtttagaaccagttctaaattgagtggaattgccaaaattcggtatggtattggataacaaatatggcctattttgacacagggtcttaattttttttttaataggcttgtgccattcttcttaatctaataggcattggcaatccctaattacggagaactggtttgtctagtgacatcccaaacataggaagaatgtttccttctttaaaattttttgatagacacttgagtcaaatgaagaaatcccagatgaaaaattttagaaaggacattctactctcctgtagaatgggaaaattgtcccattcagctagttgtaagccaaaggagaaaacttaaggggttgtattatgcagctacatttttgaactgataacagttacccttccctgtcctttcctgcctaaacagatcctgatgctgcaaaccaacatttctttctttttttttatcactgttgatgaaggttatttaaaacagaatcagtgatatgttagcaaatattttatgactggctttcaggaaaaaagaacatagattcatagcaattgtgtcatggtttaaatactcccaccatcaatgtgaggtcactgaatgtagatttgagaagagctttgtatatgcagaattaattctcattagccaatctgagcaggctccagcacaccactgacagttaaaagaggtggatgactgatgtgagtaaccacatgaatgaatgtcaaaaacattatgctaaaaaaaatgtgctgaggtaagaagccagatataaaagaacatatactgtatgattacatttatttgaatttagaacaggcactattaatttacagtgatagaaatcagatcagtagctttttggtttttgttttattgagaaggaatttggctatgaagggatatgaaggaactttctttctttctttttttttttttttgagacagagtatagatcttgtcactatgctagtagcgccatcttggctcaactgcaacctctgcctcctcagttcaagcaattctcctgcctcagcctcccgagtacctgggattacaggtgcccaccaccacgcccaactaatatttttgtatttttagtggagacagggttccaccatgttggccaggctggtctcgaactcttgacctcaggtgatccacccaccttggcctcccaaagtgctgagataacaggtatgagccagcacacctggccaagaactttcttagatgaaaatattcatagcagcattacccaatagaactttctacagaactatcaacataacaattgtattttcaatctctgcttaggaaaaataaccaaacagcaatttaaagatagcctgtaggccaggtgtggtggctcatacctgtaatcccagcattttgggaggccaaggtgggcagatcacttgaggtctggagttcaagaccagcctggccaacatggtgaaactccgtctctgctcaaaatcaaaaattagccggctgtagtggtgggcgcctataatccaagctacttgggaggctgaggcaggagaatcacttgaacctgggaggcagaggttgcagtgaactgagatcgcaccactgcactccagcctgggcgatacggcgagacttagtatcaaaaagaaaaaaaaaaagcctaatagtaagatggaacccagtatgctagtatatatttaacagtcagctcatagcaaaccaagccctagtttgttgtgttttctaatttctatggtgtaaatactctcaccatgactcaccattcaaactaccaagatgaaggcattgaatggtgagttggaaagagaaatgtacgatcaattcataagctggtgtgaactcagtttctgaactgcttctacccgtcactattattgacggactgaattttcttggttttagtttagttctttagattattcaatctttcccagagctgtgtctttgcccagagactttattgaacctcagagatgtctggctaggctgtagctcaactttagatcctttaacagaaggaagaacacgagggctgagtgcggtggctcaggcctgtaatcctagcactttgggaggctgaggtgggcagatcacttgaggtcaggagttcaagaccagcctggccaacatgatgaaaccctatatctactaaaaatacaaaaactagttgggcttggtggtgggcacttttaatcccagctacacgggagggtaaggcaggagaattgcttgaacccaggaggcagaggttgcagtgagccgagatcatgccattgctgtccagcctgggtgacagagcaagactccatctcaaaaataataataataaggaataacatgcgtatgatccttaaaatatttctgcaactttttttttcccctggtgctgcagcttctattcgtaaagaatggtgaggaacacaaccaagctttaaaatcagtgtacttgagaggttttgttgttgttgtttttacaggtaattaaccatatgttacacattttaatctgcttttaagtgcaagagagattggcaaatgacttaataaagaaatgacttctgcttaaattggataaaatggttgtttactggtgtttattgctgtattccaagtagacaagtaatctgtgaatccagtttagtttattggacaataaatggtactcagaacttttatcagtgtttgattgtcaggatgcccattgaaattgacttcatacttagggaactttaattttattgtacagtatgcactgttaaaaaaaatatccttgtctttcagtataaacctatgacattgccttgtggcattatcatccctgagatgctttcttgctctaagatttcttctatgtcataaagaaaaaaggaacttttggttccttcatatctaatgcagttttttcttttgtaaactctaaatattttccattgccaccatcaacaattcaaataacaatcttactgatggaaagtccatgattagaaatagctgcttcttcaaaaataaagaactttgtatgtacctatccattttgaaaatcttaaccattgtgctcagaaggagagatatgattttaagaagggtcacatttagaataccaataatgtcctactcctgaaataattgggaccaggccgctaaaaagaaagcacctgatgtttggcctttcagtattttctataactatgacgccttggtccaaattatctaataaatgcttcttcctattctcccgccctaagagtccatggtctctttataaagaagaatcatatacatacagatattacttgaatttatatggcatcctcatgaggtgaatcccacctatgtcacttaggattcatttgattgccctggtttgatccaattcaagtattaattcaggccaggtgcaatggcacatgcctataatcccagcactttgggaggccgaggtgggcagatcacttcagttcaggagttcgaggctagcctggccaacatggggaaacccccgtctctactaaagatacaaaaattagccgggtgtggtggcaggcacctgtagttccagcaacttgggaggctgaggcaggaggattgcttgaacccgggaggcagaggttgcagtgagtaagccaagattgtgccactgcactccagcctgggtgacaagagtgagaccctgtctcaatagaaaaaaaaaaaaaaggccaatatgggcccagggcctgccattcagacttccgcttgtggcagagaccaagggatggcagcaggttagtcgcaggtgaagtcataacaagcggtgtggagccgcacctgggcaacatgtcggaaggaaatgcagtgagcgaacccagcactctgcaagggccccgacccctcctgactggggcccaggagctcagcaggcagcgactggcaccccttcaccccgggccgccttcccttcatccgctctgggaaccttaccctgggggttgaggttgggggtcaagaagaaaaccttcaccccaaatatcatcagtcagaagaacccaaggaagaagtaaccgtcaagaaggagaaacatgaaagggacagagatggacagagacaggtgcatggacagggatgaggccacccagaagtgatccagtctcactccatctttgagaagggcccagctgaaatgatgaagaaaaaaggaactggaataagaaagtgaatgtgtcagacatgggaccttctcatatcgtccacatcaaaaaagagaagaaagagttggacgaagacacgaaacatctcaccatgctgtagaaggacgatttcattgatgaccctgggctgaggaatgacactcgcaacatgcctgtgcagctgccactggctcactcagggtggctttttaaggaagaaaacaatgaaccagatgttaaaccttggctggctggccccaagaaagaggtgggggtacctactgtgaaactgaaagaggagctacaagatgaggaggaggccaagataaaggctccttccagagcagccaggaagacccccgggcctcccgaaggacatatccgtggcagagctgcccagggagctgagcctcaccaaggaggaggaattgctgttcctccagttgccagacaccctccctggccacccacctatccaggacatcaagcccatcaaggcagaggtacagggcaaggacagagaggtggtactcatcaagcaggagaacgaccaggaagccaggctggcaaagaatgcttctaccctagctgacctgacagagggtcaggttggcaagctgcccatctgcaagtccgaaagggtgcaactcctcctgggcaaggtgactctggacgtgaccatgggaaccgcctgctctttcctgcaggagctggtgtctgtgggccttggagagagtaggactggggagatgatagacctgggacatgtgaagcacaaacttctgtgttcccccgattttgaatccctcttggatcacaaacactggtaaaatgatcagatggaggaggatggcggctgctgtctgctccagacattttgttctcgaatctctgcaacccaggagaggccagttgagcccacccactccagcctttggcagccattgtcccagtttcccccagggcccacagggcttcctcccacagcagctgtgaatggcacagttaccttcccacagtgtgaagatggtacatccttgctgctggggacttgtccatgctatttgtttttgtatttatattttgtattttgtcttaatctcttcaactgactgcatcctcccaagggaggagggaggatctgtgggaaggtgcaggcttttggtggctgttgggccgtcaggcagcaagtgtgaggactgcagcttttgctggtgctcccttcttcctcccagaggcagtataggagagagagcaaggattgagtctgagacttaagcatggggtcccaactcatcagttcctggttctgtatccttgcgcaaactacctaacctttctgagcctcctgttcctcatctgacaaaaatggggatgatacctacttcacagggttgacgtgaggattacatgggatattatagatgaaaactccttgcacaaggccagaaccagtagccactcaataaatgttaatttccttttaagtaaataaataaataatcaaatgttaattcaaagtcccacatgagagcgttctgtgttttgtggtgtttgttttgttttgttttagagacagggtctcattctttcacctaggctggggtgcggtggcacaatcacagctcactgcatcctcgaattcctggactcaaaggatcctcctgcctcagcctcctgagtagctggaactatagacatgtgctaccatacctagctagtttttttttttttttaatctgtagactgcctctgtggacagtttttcaaattttttgtagaaacagggccatgctttgttgcccagactggtcttgagctcctggcctcgagtgttcctcccaccttggctgagacgacaggtgtgagccactgcacgtggtcagccttctatctttaaacaggatctgaatctagattcatcaactcataaatatgttctcatttttaaatgatggaatgatggaaagtgaaagcaccaatcaaatcatattttcattatttccagaatgtgttcagcacagttaggtctggaaaggtttttgggaaaggttgtgcaaggttgaatttattcactgttgaaatagcacctctaaatttcaagcaattgtatgatttacttttatacaagtgtcagaaatgctaaattattaaatcccaatggcaggatcactgacaactagaaacttgagtttatttgcttccgtggtttactaaactaagctagagaaatatagtacagttatttactacttaagatcagccagaaaatgtatagtgagttcatactgtactagattctgggagataatcaaatgtaaaacatataccagtctcaaggaagttaaaatctagtaggaataatcactatattcagcaataattgttaattgagcacctactctgtactagatacagtactaagagctgggaataagattaagtcataattcctacctataaggagttcaaagtttagttgagaagacatttgtaaagaagtaattgtaactatgatagataccttcctggaagtatgtgaaggttataagtgatggcataaaagagaataatcagttctgcttggaggccaaggactatagccaagaagacatgccttatttggaactaagagtgaaagacaatttgaaatgtagacttgatacatacacaagaataaaagatcatggcacatttgggacatcatgagtatgaccaaagagtaactgactaaagttactcttttggtcagggaaagataaagtttgaacaataggctggattcatatcctagagttaagagttcattcaatagagaaccattgaagagtttttaacaggggaataacatcagatttgtattcatgaaaaagtactctgtttattcatcatatatttattgagcccctataatataccaggcatagttctggatgctagcaatcatcagaaaaaaatattgccttttctatagctcctcttacctaggcagccaagttttgtgccctgagccctagctcctttcctgtgctcagctgagtgaatcagggttaggaacataaccaaaggtagacagtccatagatggtcagtgagctatgagctaaaacagcagaggaaatcagttttttgtctgtctgtttttgatgtaggatctccctctgtcacccaggctggagtgcagtggtgctatcatggctcactacagccccaacctcctgggctcaagcaatccacccaccttagttagcctcccaagtaactgggactacaggcacgcacccccatgcccggctggcttttaattttttttgtagagacagcttgttgtgcaggctggtctcaaactcctgggctcaagcgattctcctgtctcagcctcccaaggctctgggattacaggcataaatcaccatgcctggctggaaaccagttcttcagataagagagtgcagcatgtaacatttaaagaagtagagaccaggttgacatgaacagctttatagtaagattaaagtgatatgcttcatttagtgaacctattaaagataacagaaacctcgttaattcattatacacacacacacacacacatatatacacgtgcatatatatatgtgtatatatatagtcaggtgcagtggcccacacttgtaatcccagtacttcgggaagccaaggtgggaggatcacttgagcctagaagtttgaaaccagcctaggcaacatagggaggcccatctctataaaaaaaataaaaataaattagctgggcatggtggcgcatgcctgtggtcccagctacttggaaggctgaggcaggaagatcacttcagcccagagctcaaggctgcagtgagctgtgatggcaccactgcaccccagcctgggtgacagagagagatcctgtctctaaaaaatttcttaaatgcagtcacacacactaaacaaaggggaaataaggttttagagcagtaattccatctatcattgttttcttggtcatttttccatggaaaactatttttgtattcaaagtcaacactcattctcttatatgtttacattcagaactgaagaccttaactggaattaacttaaaacatttgtagaaaatcagatgcaaacatgaacaaactaagagattttaccacaaacaatgatgtagaggcaggtagtctgcaaggtcagaaccatgccttcagaagcagcaattttaagtgagacctgaatctcctatactcaaaggtcttgcattagtcaggattctctagagggatagaactaataggatagatatgtatctatataaatgggagtttattaagtagtattaactcacacaatcacaaggtcccacaatagaccacctacaagctaggagcaaggaagacagtccgagtctcaaagctgaagaaagtctgacgttccagggcaggaagcatccagcgcaggagaaagttgtaggctgggagggtaagccagtctggccttctcatgtttttctgcctgctttatattctctggcagctgattagatggtgcccaccaagattaagggtgggtctgccttccccagcccactgactttggcaacaccctcacagacacacccaggatcaatactttgcatccttcaatccaatcaagttgaccctcagtattaaccatcacaagtttcatttcaagattaataatatccttgtccatttaatcataaaaaggaatgcttattatgtgccaacttttccaagtgctttatatgtattaactaatttactcctcagaaaaatcctgtaagtacctgcaaatgctattattgttccttttttctttctttctgagacaacatctggctctatcacccaggctggagtgcagcagcactatctcggctcactgcaatttccgcctcctggactcaaaccatcctcccacctcagcctcccgaatagctggggctacaggaatgcaccaccacacctggctagtttttttgtatttttttgtagagatggagtttcgccatgctacccaggctggtctcgaacttattagctgaaacaatctgcccatctcagcctcccaaaatgctggggttacagacacgagccaccgtgtctagcctcctattttaaatatgagaaaattggcctggcacagtggctcatgcctgtaatcccaacactttgggaggccaagttgggaggattacttgagcctaggagtttgagaccagcctgggcaacatgacgaaaactcttctctacaaagaatcagctgggcatggtggcatgcgcctgtaatcccagctacctgggagtctgagataggaggatcacttgagccagggaagttgaggttgcagtgagccgagattgcaccactgcactccagccagggtgacaaagtgagaccctgtctcaaaaaaaaaaaaaaaaaaaagaggccaggcgcagtggctcatgcctgtaatcccagcactttgggaggccaaggcaggtggatcatgaggtcaggggttcgagaccagcctggccaatatggtgaaaccccatccctactaaaaatacaaaaattagctgggcgtggtggcacgcacctgctgtcccagctactcaggaggctgaggcagaagaatcgcttgaactcaggaggcggaggttgcagtgagctgagattgtgtaactgcactccagcctgggtgacagagcaagactctgtctcaaagaaaaaaaaaaggaaaaaggagaatttaatctgattaccagattgtaaatggcaaatctggaatgtgaacccaagcagtctgacttatgcacttaaccacagttatactccctctactctctatggagaatttatcaacttaatttagtcaaatttggttatcagtaccaggcttaagggaatttaaatgtcagttaactgctgtgtaacaatgaatcaaaatctatttattccatcatcacctttttttcaggaaaatagtagcaacattacttgaatgacaactttgggatcatattttactacttctctttcattcatttgtcccaaattcctgcctttgccatgggactctaggcagttgacaaactctgtgagcctcagagtcatcatttataaaataaggttagtgataccttactcatgtgagaattagatgagataaagtatacaaagcatttgatgcagtgctttttcactcagataactaccgttgcattccattgcctgatgtatcaaatccaaacttttgcgtggctttcaaagtctccctagaaatggctagatcccacccatcttgatttatttcttgccttacttgatatataaactttcttctgtctctattcctcttgggacatacacacctttcttttcctctctttttcattatccacatgtttaagacctagtttaagttcagtcttctccgtgaaagcatctccagttaaactatattgttctttcccttttttgaactcctgttgcagttataatagatgttacattgtgtgatatttcacaaattctttgatatatgctaggtttctctttccatctagattctaagctccttgagaagatagatcatgtcttaatatttttcctgtatctcccccagaggatctaacagagtatcataactattgttctatgagatctaatgagctcacagctattgttcaacaaatacttattacctgattgaagaaaataagctcctaaaaatacctgataatattatataggtctttatattgtcagggtgtttttataacactgttaatacttaatccatataatagtcacagaaaataggtagaacagatattatcttcattttttaggtaataacactgagtttaaattacattgtggcttgcccaaggattcttggtaagtagcgttattgaccccaccctcaacccctgccattccagtccattgtccgttctctatcaggctgccaaaataattttcttttgagacagggtgttgctctgtcatgcaggctggagagcagtggcacaatcatagctcactgcatcctcaaccacctgggctcaagcgatcctcccacctcagcctactgagtagctgggaatatagatgtgcaccaccacatccagctaatttttccattttgggtagagatgaagttttgccatgtctcccagtctggtctcaaactcctgggctcaaccagtcctcccgcctcagcctcccaaagtgctgggattatagacatgagccactgtgcccagcaatattttcatatcaaagatgagattgcatcactcccttatttaaaactttccaacagtttcccattttacatagaatgaaatcctgcaaaacccccacattcagtatactccaggtacagtggccttctttagcttcagcagtcttagtttgccaagcttgttgctagtctggggcctctgcacttgaatgttctacccctggaacttcacatggcttgttccttcttacccttgaaatctcaactcaaatatcacctcctcagtgaggaagtaatacctatgtaaattaactcccctcccttgtcacacttcatcatatcatcctgttttattttctgtatggcacctattaatatctcaaattaggccgggcatggtagcgcatgcctgtaatcccagcactttgggaggccaaggtgggtggatcatggatcacttgagctcacgatttcaaggcaagcctggccgacatgatgaaaccctatctctactaaaagtacaaaaagttagctgggcatagtggtgcacgcctgtaatcccagctaagagtagctgaggcacaagaatagcctgaacccaggaggtggaggttgaagtgagccaagaccacaccactgtaccccagcctatgcaacagagcaagatgctatctcaaaaaaaaaaaataatatatatatatatatatatgtatctcaaattagcttgtttatatatttgttacttgtgtattgtctatccccactagaatgttggcctcataaaagcagagtttttatcctattcacatctgtattcccagtccctaataaagtacctgacacatggtagagtcttaataaatatttattaaataaaatagctaagcccgaactagactaaaactatggcttttttgctcctaatcaagtgtacttcccatgaacatttaatttttcctactttttgtggaagcacttatacctttggaactacagtaagaattgatgttcagaataatgacattaagatgtgctgtaggattctctattatcaaagaaaaattttattcagttcaataaactaaactaattaaagcagggatgtcatggcatattattatattaacacatttagaaagatttccaaataaaaagactttctgctttttctttagttaactagaaaattaaattaactcagagctctttatgcctcaaaagtccttgttaattaggattgttctataaatctctattattagcagagttcatcatcttttttattgccctgtttattagggcagtctaagcagggtgtctttgctcatatcctgatatgtgtgtcctagtgaaaagaaaagcatttccggattctcattttttccctattccttgatataggcatatttcatgctgttagtataacaatttagtttccttctatcagttctctccataaagctggaatgatattattgacctatgaagcaaaataattaaatttaaggtctgtttaaaagcattaatgctttgtgacgttgtttatgataatagaagattgaaaatagcctaaaagtccatcagtaaaggattggttaaataaattatactatatccatgtagtggactattatgcagcaataaaaaataatgaggacattctctgtttaccaatatagaaagatatccaagattttaaaatatgatccagagtagcctagatagtatgatacctttttttgtgtgggtgaggggaggaaaaaattaagaatgtagtttattgtatatgcatagaaaaattctagaaggatatataagaaagcaataacagtgataaccagattgggaagtagaaggagcagaaaccagctgaagggcagagatgaggagagggagattttatagcatagcttttcatatgttttatatttttgaatcatacgaatacattacctactcaaaaagttaaattaaaaacaagcacaactaaaagtaatatgtggccaggcatggtgcctcacgcctgtaatcccagcactttgggaggccaaggtggatggatcacttgaggtcaggagttcaagaccagtctggccaacatgatgaaactccgtctctactaaaaatacaaaaattagccgggcatggtggtacacacctgtagtcccagctactcaggaggctgaggaaggatatcgcttgaacctgggaggtgaaggttgcagtgagccaggatcgcaccactgcactccagcctgggcgacgcagcgaaactccatctcaaagaaaaaaaagtaatatgtgattctggactgaattctataccagatgaaaaatattgctataaaatacattaggacaattaagaaaattgaactgtggactatagattagattaaaatgttgttttctgtgtttatcaactataacctggctaacagaatatcatcactcttaggaaatacacactgaagtattaaggggtaaaaggcataatatataccacaaatgctaaataaaactttgaaagaataaataatgttatatatatgggaggaatgatcaactaaatgtggcaaaatgttaaaaaatggtaaatctggataaatgttgcatagaaattgtctgtatttttctgggaacttttctgttaatttaaaattatttctaaatagttttttaaaagaaacaaacaaaaacattttaatactatggatattaccttattataagcaatggcataagaatgtgaagggttctggtttttacgtagtcatacttttcactttctggagaagtttttaccatcacttttctgtttcttccatgcctattgatgctgggtcagaggcagtggcaggggtagtgactgaattttaccttgaggttgaaaaacaccaggccaagtgtggtgactcatgcctggtgtttaggaggctgaggcaggaggatcacttgaagccaagggctcaagaccagtctggagaacacagcaagaccctgtctctacaaaaaaaatttaaaaattagccaggcatgttggcttgcacctgtagtcctagctgctcaggaggctgaggcaggaggatccttttagcccaggagtttgaggctacagtgaaccatgatcacaccactgcactccagcctgggaggcagagtgagaccttagctcttgagagagagagagagagagagagagagagagagagagagagagagacagacagacagaaggaaaatgaagaaaggaaggaaaaggaagagagagagaaaagaaagaaagaaaaacacctgcctacctgcctttcaacctgctggatcaccttcacttgtatcttctcaacagtttaggacatcaacaaaacagtaacaatgtggcattttaaaaattctttgaacaaaattttctaaggatatcgtgaggttgtgtgtatctagtgctaaaatatatagttaatttagtggaggtaaacctgcagaaacatttaattgtttggcattgagtaactggatttgtattattgttcaattagatattgtggcaattgtagaaacttaaccatctctaatataattgactttcattattgatgcatgaagatgtttttattctaattagattggcctcttaagtgattaggtagtgaagcttgtctcatatttaagtgaagagtaaattatttgtatgaagtgtctagaggatgcctaaaattgattattttgtattctaggtaagctaaattttattgttttgaatgaaggcactctgcaagtcttatctaataaatgacacaaaacaaatctgttatcaactgaattgttagtgtttgtttcctgtctgcttggggaagcttatgatttagtggttttttagaaatccagaaagtaggaataataattattcccaacccttttccttctcactttacaaaaagtttgtgaagaattgagaaataaatgctacgaataatcttaagctcttaggtagaagtacttgatcaaaactaaccaggtcatttttctacaattagtgcagaaagctagtttttactaattgttcccacagctactccaggcccatttcatgcctaagaaaactaggtcccagtgagagtcatgtgagtgttgtaggcttcattggttgaataacgtccttacctgtaagtgtatattcagatttagtgaatgtacttcatgtgttcatataataaatttcctagaatagctatggagtaggtcatgccggtaaaaactgttagttttgtgacttttttttttttttttttttgagactgagtctcactgttgcccaggctgaagtgcagtgacatgatctctgctcactgcaacctccgcctcccagattcaagtgattctcgtgcctcagcctcccaggtagctaggattacaggcacatgccaccatgcccaactaattcttgtatttttaatagagacagggttttaccatgttggcgagtctggtctcaaactcctgacctcaagtgatccacccgcctcagcctcccaaagtgctgggattacaggcatgagccactgtgcccggccatgactttttataatagatctgtaaaccagcttaagtcatttgaaaatcagagcatactgaaaatgtaataaaacataaatattattgaagatttttcagagtcatcattttgaaaggagttcttgtagttctttagataatagaaaataatgaaaactgagtttatgacgcatcttttgcatatatgatattcttatatacttatctgtactgataagtataaaaaggtagaaaataattctactttgtatttcaggaaattgagcttcatatgaaaactaaggataaagtatctcaatgatgtgtgtgtgtgtatatatatatatatatctccagaaaaaatcattataaagctgcatttatgtagaattttcagcaatttagataaataagtcatgatttttttttttttttcctccgagagggagtctcactctgtcgcccaggctggagtgtagtggtgcgatcttggctcgctgcaacctccacttcctgggtttaagcaattctcctgcctcagcctccagagtagctgggatttcaggcatgtgccaccatgcctgacaaatttttttttgtatttttagtggagccgggattttaccatgttgcccaggctggctgaactcctgacctcgtgatctgcccacctccacctcccaaagtgctaggattacagatgtgagccaccatgcctgaccagaagtcatgattcttaagaataaaattcaaaataatctcttccgttgtcgattaggttctgttcataaataaatatttatgcagtcaaaaatgaataattgttttcaaacgaggagctcaaggaattctatgtaattttggtttacttactatttatatataattattttccaatctgtaagtctagtgattaattcttatattacctaaaatgttttatagacatgttagattattacataatgtaaatgtattgtaaatagtaatggtttcattaacttgagctcattttacttatttagtacctgtttggttttagtttatagttgttatttccctgtatagtgtagcttgtacttggaagtagtaaaaccagatttctttataagtatttatggtacagaccttttcctaaatcagactgcagacctttcctgagtatttctaataaagtctgcttacattttttttttggcctgcatagtagtttgtgctatatatactctctagaaaatgtaattctggatatttgtgccataactttcaattaatcaaaatcttgtcaactgccatataggccctcatgttacaaaatgtggaaagttcagttacttaaagagtttggctgggcattgtggctcacacctaatcccagcactttgggaggctgaggcagtcagatcacttgaggtcaggagttcaagacgagcctggccaacatggcaaaacctatctctactaaaaatacaaaaattagctgggcgtgatggcacatgactgtaatcccagctacttgggaggctgaggcaggagaattacttgaaccaggaggcggaggttgcagtgagctgagatcacgccactgcactccagcctgggcaatagaatgagactccgtctcaaagaaaaaaagtttaagccagatgcagtggctcatgcctgtaatcctagcactttgggagaccaaggcaggaggattgctcgagcacaggagtttgaaaccagcttgggcaacaaagtgagaccctgtctctacccacccgccccccaaaaaaaagcaaaaaattgaccagctgtggtgctgcgtgtctgtggtcccaactacacaggaggcagagagaatcccttgagcccaggaggtcaaggttggagtgtgttatgattatacaactgcactccagcctggatgacagagcaagacctaaaaaaaaaaaaaagattttaaaaaagattgactaagtgaatgagtcctcttcttgaatatcagtcattccaggagagtattttcattaacatatttatgtctcttgttgaaagtatccattaagagcaggtagcaaaagctagacagaatatgcttttgaagattctctatgctctttattaatacctttcttaagtttctcaagatctccttttgcctccctcttgatcttaaacgagactgaagtttaagagtctttagccactctgtccccatagggatgcaaatttatgatttcagaagttccagcccccaataagaagcactgtccaatcgtttgcagatgtatcttgtaagccagatttcatgacagataagtccattccactgtcatgtgccatgtttaaagtactaaattaggttactctgtagtcaaaacaagtaagccctggtccagactactctagggcaaaatcccgttgcactgtcccttttgttctgcccatgcattcagttgtagctttcccttttgccagttgacagatagtgacttctttgcaaaacataaccagattaggttatttttagtaaaccaactaaaataaaaaattcttgacattgggaagaagtattttaacagaataatagtaatgtttttattgtgccattgtgattttctataaagaaacacccaatattcattatttatatttttttaaatttacaactctttaactgtatccaacatttcactgccaggaatatagtcaggctcgaagcttttttagaaacccatgatccaatccataccaacacttcctttagtttatggcttctgttcatttgcactgtccagaaaggtactgctaccatttgtagtcactccaaaaaaaagtgtgaactacctaggtataactctcataagacgtatacagcagcatctgtatgctgaaagttaccaaaaaagtattacttgcagatgattttgcaccttagttcccaagtgcccctgtacagaatatggagcttatgtcctgtctctctttgaatgatgagtgatgaaggagcttcagatgttactgggtgagcttgtattgagtgttacaaagagaagtcattctgcctttctttggctctaattgcagaaagtgaagtcactgcttttgctgtcttggatcaagaccagaaagaaattattgataccaatggagctggagatgcatttgttggaggtacagactaatttatttcattcttacttacaagtaaaacattttaacccttgtttctaccatataaccaagatttattcatttagtaacttctaatttcttcttttaaataattaacttctgaagttctttccatatacttctatcattgtcagtattagagggttttaccagaggaaaaatatgtgtttggaaaagataatttgctactatgctgtaccccagtcattttcacaagattaattgtatctgtcagaaaattgcataaacaaactgcatcaagtacagtatatagtatattcatagcccttcaggcttaaatgttaacacatttttgttctttaaaacaagttgtgatgaatattaaacagtatgctaataactaaggatgatgtcttttgatgataatcctttggttaaaacatctgtttcaaacacaatagtggttgtttgttatactaaaaagggttaaatttttgcctatttttggctcaataagaactggcaaattttatgtgaactaatgattttggtaatgaatactcaaaaataaaatcaaaacaatagaagacttggcttgatgacttagattgatctaaaatctgattcaaaaattcttttgataagtctaaattccttctagttaagtgtagttaattaagctagtttatagtctctagaaagctttcgcttcctcacagataccccaaaggggtctttcctggtctctgtttctttctcttaacatcaagccagaccaggttaatttaaaaaaaaaaaaaaaaaagcaagcaagtggagctgatgattgtccctttttctctggaggataatttgaatcatgggaaacttatttaagtttgtgtgatggttttaacttaatattttattttaatagtcttttgccaacataaatttttatttttctttctctaaaactattcatgcccagtcttttttttttttctcccaggctggtgtgcagtggtgcaatctcagctcactgcaacctccacctcccgggttcaaatgattctcctgcctcagcctcccaagcagctgggaccacaggtgcatgcctccacacctggctgatttttgtacttttagtggcgacggggtttcgccatgttgggcaggctggtcatgcccagtcttaaatgaactattaaccattaggatgccccatgcccttgttctttggaaagagtctgtaccacagacaacattctacttcactgttatgattgtgttttttatttccttgctcggaaagtcttcattattgataatattagagtacttagcagccaattttcctattttttactttttagagctatagatgtatgtaggctaaaatattttattctgaatttaaccatattctgtaatacattaagaaaaccctagtgatttcttggttagaaattggtcaaaccaggaatcttagtctagaaacttttaaacttatacactgtatgtacattacttaagtactttaaaatctttaaaacatgaagtattctatttctttgacattcagtgggacacataatgaggccatcatagatttgatggtgacctaaatagccactacctctggccttgggttacttggcttcctggcccggcaacaacagattctgttacagacacctaactatctgtaatgctaccgatactaggtgagaacatgtagactttttgagggagggagaggccattcttaggatactgaggtaggaacagctagctaccatttgtattgtggttacaacgataaataaactacttcatcaaagcaattgggatttttttgttagaggatttttcagcctctttttatcctacttcattatatttattgttggggtatagttaggtaagcaaaaaagaaaaagagtatagaacagggatccacagtcgtcttttttaaaggccaaatagtgactattttaggctttgcaagtcatatacaggctgtattgcatatcttcttgttttgtttgcttccttgtgttttgtttttttacagcacttttaatacgtaaaaacctttcctagctctccagctgtacaaaaacataccataggccagagttggcctacagactatagtttgccaaaccctctttaaatcatgggcagcttcctcactttattcatttctagcatttcaaagctccagacactggatttcactatacattgttgaaatcagaatagagaaagtagaaagcaggtagaaactaggcaggactttactggtaatacaattagatagccatttttctcactttgaacctactcagttcccagggtaatcagatcccaaaacactgggtcatgcaatgagatgaacatcctaatgtcagtttattaatagaatacttatgttgccatctttagcacattctgtcaaatgtgaatcaagctacaaagtaatagcaatagataacttttatacagtacctactaaccaaccaatatcttaaacactttatatatatattaactaatttagtgttcacaaaaacttcttggggtagattatttttacccctattttactgatgaaaaaaacagagacaaagaaaggtgagataatgtgcccatagtctcatggctagagagtagcagagccaggattcaaacccagaaagtctggctccaaagtcagtgcttttactcaccacactaatactgcttctctaaacatttatgtaaatctcaccattagaactgagaaccacagaccagccttcctgacaaaagctggttttgccagagaatcttcctgttatctgagtagatgacttactttattgaaaaggatctgttgtaatctgacagggttctggggactctaaggtaagattgttgaggaaaagaaagaaaaactgaaagggaagagaatccaagaactgtagtccctggtgagtttcaaccaagagctttttgctaagcagtagaatcgattgcactacagagatacagaaagccagatgataaacttgcttggttagcatgggctccaaataagagagttatatgaatcagctgtttaatagtgaagcaggatatttccctaagcccttctcaggcagaaattgcagtgtgtgggcgcaggaactagccagccactttggtgccagcaggagcgaacttcactcactcgcttctccactgctcacaggagggtgagcacacgtgagcaggtgcaggagctgggctgagcgcttttgggcactggtaagagcgaactccataccagaccagtggcagcatctaagggaagctgcccgtgacccctggatccccagaggaagcgttacagtgcccttttagctttgctgtctgtagacagcttaagcattaacagctcagttgagtgaccctccattgtcaccaatgtgacagccctttgcacccacactcatggcacccgagttcttgtccggcatccaggataaatgaggtcacacaaacgagttggagatggtaaatgcaggggattttattgccgatgaaagtggctctcaacaggaaggggagctgaaagggggatgaagcaggaagataatcccctggagtccggtcatccccagccagactcctctccaaagctatgccatcaagctgtccctctgaagtcaagccgcttctctccgatgtccaaccgtggtctacaacatccagctgcttctcctcttctttctctgttggctgagcctggggtttttatgggcacaggattgtgggtggggtgggccatgggtgattttggaaaaggcaacatttgagcaggaaaacaaggatgtaagttctcactttgggccatggtattaggctttttggctttaggatggggcgctcaccagagacctaccctcttctgcccagaaatttgcctgcctcctgtccctatcaatagcacccatctaacaactgatgcatctatcttacaacagaaatggtcttgttagttggaaatactaaaagatccattggttaaaaccccctgctccctctccacaccagcaggagcctttctactgggattggaaataacagctgttggcttgacacagtggctcacacctgaaatcctagcactttgagaggccaaggcaggcggatcacttgaggccaggaatttgagaccagcctgaccaacatggcgaaactctgtctctactaaaaatacagaaaattagctggtcatggtaacatgcacttgtagtcccagctactcaggaggctgaggccctgcccgtatggaaaaattaacaaaatggatcaaagacttaaatgtaagtactaaatcagccaggtgtggtggctcatgcctgtaatcccagcactttgggaggccgaagcatgtggatcacttgaggccaggagtttgagaccagcctggccaacatggtgaaaccccatctctactaaaaatagaaaaattagccgggcatggcgttgcatgcctgaagtcccagcaacttgggtggctgaggcaggagattcacttgaacccaggaggcagaggttgcagtgagtcaagatcttgctactgcactccagcctgggtgacagagtgagaccctgtctcaaaaaaattaattaattaattaataaaataattgtcgttgactccttccaccttgggaatgaatctcaggcagtggcaacttttacatttactatgtagtttatttttcttcgcttcattgcccaattaacatatcttctttctgattgacacattctatatttggatggttaatatattcatcctgtaactttcaagttttgctggcctaagagtatttctgtcttttgtgactttgcatatctatattttagtccactttgtggtaatttaactctctgaaggacaataattttctttgcataaatttcaagttttggataaagtatcactccagctaccatgtgctaattatctatatcagtaccagagtgccatgtgttcctttagccagctaaaaagatatatgactacatcatggattttcatgtataatttaaaaatgagtaacccaaatgtacataaattaaattaaattaaattcgtagttccatctcacgggtttagtgacagtaacaaatccctccagcctctacaagcatcgctccttgttctatttggaggtcttaagcactttgtgatatttgttctttatttgtcactgcccagccctgatagaactaatcttttcacattcttcctcaaaagcccaagtgctaggattgtactcttggaaatggatacaattctataatctctaagtatgatttcctaatttcctaggtcaggaaaaaatttcttcctgttgtcctgctgtgctttgtcacagcaggtctaccttttcatttggaaccctctttgtcactgccatagtaacaaatggaaacattgagaacattttgtgacaggcactgtcattgttcccagtgaaatctcttcccctgtgtcttcccagtaaatgaaactgagaagaaaaatcataacaaataacatgaaagaggacctaatcaatatgttcccactgggctgtcaataccagcctgtgttaatctaatatgatttagtcatatgttttatggcagctgtgggaatatggacaggacctacaaatcatctttagactgaaagtgagtacacctttgacagattatgtgtaggcacttatatacaactctcagataaaagactagagacttcacccaagaaccaacattcttagaattaaaaaaaaaaaaaaacaccttcattaagtatggttaaaagccacgtatagattagaagattttactttgttggttttttttgttttgttttcgtttttgttttgagatggagtcttgctctgtcgcccaggctggagtgcagtgacagaatctcggctcactacaacctctgcctttcaggttcaagtgattctcctgcctcagcctcccaaatagctagaattacaggcatccgccatcacgcctggctaatttttgtatttttagtagagatggagttttgccatgttggccaggctggtctcgaactcctgacctcaggtgatccacctgcctcagcctcccaaagtgctggatttacaggtatgagccactgcacctggccagaatattttatttggaatgataataaagtaactgtgctgactcataatactttttttggagggggagatggggtctcactctgtcacctaggctggagtgcaacagcacaatcatagctcactgcagcctcaaactcctgggctcaagccatcctcccacctcagtctcccgagtagctgggactacagggtttttaaaaaatgtttttgtagagacagagtctcactctgttacccagtctggtcttaaactcttggcctcaagcagtcctcctgcctaggactcccaaagtgctggattacaattgattaaaatgacaattcatttgggattacagacatgagccaccacccccagccagaatactctttattttaaaaatcctcacaacagcttcagcagagaaaatgtattacccttaaaaatattacctataatatgcaaatgactctgaaaaccactcagcaatcacaatgcaaataattctcctatttcccatctaataaaaaggaacactaattacattctctaggctgggagcagtggctcacacctgtaatcccagcactttgggaggccaaggcaggtggacagcttgagctcggcagttcaagaccagcctggacaacgtggcaaaaccccatttctaccaaaaataaaaaaattagctgggcatggtggcataagcctgtggttccagctactccggaggctgaggtgggaggattgctggagcctgggaggtcgaagctgcagtgagctgtgattgcacccctgcactccaggctgggtgacagagcaagaccctgtctcaaaaacaaacaaaaaacaatttcattctctaattcatgtttagaaaagaacattggtttacaaaaaatttttaaagagttttttcagaacaaggatgccacttcctcttcatgtggcacctatctatacttctgagaaccatgaagactctctaattatcttcatattttctatcctcaccttgtttctttggtcccaaacatttatagcttccttccccattcttcttaattgctgcttcattgtgctatgcatagaagtggtgcagaattcttgggatttgttttttctacactacccccttcctttgctctccatctcagaagactagaagacaacttggtaagtgttgaatatattgtttctcagacttcttcactcaaaaaccaaaaccttcatatgacccacatctgctgaggatttacttgatggtgaccaagatgacagctgcccactgctaaacaacccaatgtcaacaactctttttcttgtctttctgctctaatgggacatcttctctgttttatttcttgaacagaaatttttcttaaaaccatcaaatgaacagtgaaattggcttggtcattaggaatatgaaacagaccaggcatggtggctcacacctgtaatcccaacactttgggaggcagaggcaggaggatcacatgaggccgggatttcaagaccagcctgcacagcacagtgagaccccagtctctacaaaaaaaaaaaaaaaaaaaaaaaaaaatagccaggcagggtggcatgtgcctgtagtcccaactactcaagaagctgaggtgggaggatagcttgagcccaaaaggttgaggctgcagtgagctgaggtcacgccactgcactacagtctgggcaacagggggagaccctgtctctacaaaaaaaaaaaaaaaaaggatatgaaacattcaccacagatagtagttcaggttcatgcaacagaaagcaagagagagctatacccttgcacagtgataggatgctttattacatgccacactagtgttatacatccagagtcttagtcaagctgaagctagaccagcaccaaatttcataaacactgtctatgattatttgagccttcgttagttaaaaaaatgtaaagattatcctctccagccatgatttaaaaaaagagagagagaaatcactttgttcatgtgaaatacaggatgattttagagtgaagcctgtaatttctcatcaacgcaaatgttccctcaaagacctaatatcctgaatggccttcatctagaagcaattgtaaatagataatggaattgaaaggagtttatcttctgggaatgtggataagacacagacagtctgaaccatgtaggctatcagactccaaagctcagatgtgaaacttaggtttcttatatttgatgattattgagaaatatttattctaagaaaatgatgttgatatggaaatttttatttagttgcagaggtccacaggaaatgtagtaagtaaaatttctgaagttcattttcttaaacagaattgtgacataacaaaatatatgtgtgttagttccctgacctagaatattggtgagccaattggaagtaatttgaatcctaaaattctctcagctgctattaaatgaatctggtcaattttacctgtctgatacatccaacatgtatcagttagcttttactgcataactaaccactttcaaaacctagttacctaaaataacaactcatttatttagctccacaaatctgtgggttgacagctgggcctgtgcttacctggacagttcctctggccttagagtgttgagagattaagtaatttgcccaaggtcatattgaaagctaagattcaaactcaaaatttggcctcaaagttcttagccctagccattttgctatactcccttttattactacaacatcttagcttcctctctaaaggaggagaaatagccaaagtggttttataaacactggtctgtcgactggtaccagtctatgacataagagttttcatcagtcagtatcaaaatgtaaaaaggcaggggcaagaaagtaaatttccataaaactaaatgtattcagttttaaatcttgcccttcctactttgagggagttcagttttctttctttatgaataatgttggtaatagtggattttttaaaaatgttcttatctagcagaattaaagtttgccagctctgtgtttatccctaaaatcttttgggcaagtttcaatgttctgtgaaatcccaaagtctgggattcactgatcaaccatattttttcataaattctacaaaattatttggccttttttttttaatgccagtaaaaaattactgatgacgtgaatgccattcatgttgggcttttctaatatctggcccacttcttcatataaagaagatgagtataggccaggcgcaggggctcacacctgtaatcccagcactttgggaggctgagacaggtggatcacttgaggtcaggagttcgagaccagcctgaccaacatgatgaaaccctatctctactaaaatacaaaaattagcaaggtgtggtggtgggtgcctataatcccagctactcaggctgaggctggagaatcgcttgaacccaggaggcggaggttgcagtgagctgggatggcaccaccacactctagcctgggcgacacagcaagactccatcccaaaaaacaaaataaaaagtaaagaagacaagtatagaactgtaagttctatacttactgtaaacagatgagtacaggccgggcacggtggctcacgcctgtaatcccagcactttgggaggccaagacgggcagatcacgaggtcaggagatcgagaccatcctggctaacaaggtgaaaccccgtctctactaaaaatacaaaaaaattagctgagtgtggtggcagacgcctgtagtcccagctactcgggaggctgaggcaggagaatggcgtgaacctgggaggcagagcttgcagtgagccgagatcgcaccactgcactccagcctgggcgacagagcaagactccatctcaagaaaaaaaaaaaaaaaatgatgagtacagagcaataagtataatatgatgtgatttgtattttgttaaaaatggtcttatgtgtgtatgttgtaggtatacttataaaagcatataaaagttccaggaagaaacactccaaacagctaacagtggatgtactgggaggtggctgaatgaaataatcactttctactctgtatgtctgaatttttttttttttacaatgtgcccttattggctttgtaattagtgtaatctttaaataaataaaatcacatgtgtgtagcactgatgcagagcctagccaaccttagtacctagcagaaatcttcactgtggtaaataagtcatcagacacagcatttcaaactatacgataatttacataaaacataacctctgatgttttaaggctacttatcagcaaaggtctgaataaaacaaaattagcagcatgattgtcaaattaacagctactctctcttcagatatataagttctgaaaccaggggtataaacacaggcttttaatttatttttcatttaattatccaattaacgttgacattttatagaatttagatatatttctagcccacaaagtaaatggcaaattaaaaactgatttctgtcatcaaatgctcttaaaattttagaaccatcatgctatgagaaattttcagttgatcaaatgtaggtttttgaattgagttaaataataacaaaatgatccttcttatgaattagggcataagcacagcttcacataaacaatgttaccatcatcttatcccagcagctattactttgccccattgaatcttttgtttttaactatatcatttagagtgtttgtgctgaaaggaaaattttaaaaaatcatattttctggttttcagtttccagtagtgaaactcttttcaaatgagatcttatctgaatcagaatgaaatgaacccacaaaaattaaaaattaaaaatgtttttaagaaagaatgaaatgagattaaacaaactcccatttgtccctatccacattttatttggtggctcatgatgtcacgtaggaaaaccatgacctattcaaaagcccctatttgatgaatgaagaaagtaaggcccaaagaaaggtaagatgagttgtccaagggagttaattgcaaatacgagacaagaagccagattactgaattcatgaagcagcagttacttgtgttcataatccaaatgaaagttgtcagttaaggctgagcgcagcagctcatgcctgtaatctcagcactttaagaggccgaggtggacaaatcacttgaggtcaggagttcgagaccaccggccaacacaacatggtgaaaccccgcctctactaaaaacacaaaaaattagccaagcctgatggcgggcacctgtaatcccagctacttgagaggctgaggcaggacaattgcttgaacctgggaggcagaggttgcagtaacccaagatcacgccactgcactccagcctgggcgacagagtgagactccatctcaaaaaaaaaaaaaaaaaaaagttgtcagttaagctgtctgttatttagtcctcttggaaacatataggtcaagagtcaatatcccaaatgcacagaaggaggggttttttgttttgttttgtttttgtcttgatgtttgactttaacaataaacagaagcatacgctaaacttttattttgggaaccacatcaaaagatcacacattagctttaaaatcaaatactgactcagtgttgtacatctatgctccatgaagaagaatgacttttaaagcagtgttttgaaagggattagggtgaaagggcatcttatctatatgagtgcaaaatactgcttagcagtactcttcaagagctttcttccgaaattaagatcatttttaaattgatgggcttttggttttgtttttaattcaaatacaatgtcccataccatgttaacagaacttagtaagcttccatttttagccaccacaaagaaggaataagaagttattctcaaagctgtagctataggacaataaagttattctttcttatagctacagtactgaccacttgcctgtatattacacattgcttctcagttgctcactttatgtgggagggtgtgttgtgctgaactatcttaaagcaacctttgctctaaattgacttcctgtacatgtcaacaattaacaccatctgacaccaattaagctttagttttcttttcttttcttttcttttttttttttttttgagacggagtctagctgtgtcgcccagaatggactgcagtggtgtgatctcagctcactgcaacctctgcctcccaggtttgagtgattctccagcctcagcctcccaagtagctgggactacaggtgtgcaccaccactcctggccaacttttgtatttttagtagagacagggtttcatcatattggccagaatggtctctaactcctgacctcagatgatccacccgccttggcctcccaaagtgctgggattacaggcatgagccactgctcccagcctggttttcattatgcaaatacctgctaggtcagaccttaccctggcaggcacagtagctttttcagttatttcaaaatttaatatttattattttccctgaaaaatcagttttctaaaatttgggtcacaagttgttatttgagttcatgactaattggtagtcaatatgaagtcaaaacaaaattttactaactagactacatagaaaatacaaaaagtttacatctgagcacttttcagcagggggaaaccattactttgtcacatctggatattctaagctagccaaattgaagtgggaatttcctgccagatgttagttctttgagcaacctgtgaacatctaagtaagtgaggggttatgagtccttgtttggtagagctatacccactctggaggcttgctcctaacaggcagcagacattttatatgtactaccaccagtcaggaggttgtgcaacctatttgaagtcaatatgatgtgctcttgttaaatgtcaaaacatccaaggcctcattttgaatgtacaacatcagtcttacagatattatatccagggtgaacattgcattgaaatgtcctcccaaatgtagatgacaaaaattttgtttcattaatagaaagaaggtaagactgaaacaccacaggtattccagataacttggatagggccattttgtaaagtcagtgtagaccaaaatatgtctctaaatatgagggaaataaagaatctgaaatgacatgaaaaataccaagtatttatatcaacctcctgttctagacgcacatgggaattaggaagtgaaaatttcattcagaagagctgtgcacaaaaagtggaaatgcattattcaattgaaacaagtaacatttttaagggggataaaatactttctacatgatctcactggttttgtcgtcctccgtaagggaaaatattgacatttaccagactgtttgctccagctttctgatctcctgcagtttatttttataacaaccttatcgatgggcctcttacccagctctctaggtttaactgagttgagtcgatttgttaccacagcttcaagtagctgttacagaacaagcaagacatcctaataaagctgtaaacgtgtttactcaaacagagtattgattttacttggaggggaagaagccggttcttagcacagtgtcagggtggatgaatttcactgcagtttttcattgtcatctgtcagggttgtgaaacactaagtaaagccatcagaggataattagaagtaccagaagtttagcccctaaaatcagttaaccacttgggagttttgtagcttaattagcttttattaaaactttccctagtattaatagccaagcacttttaatggtatttccaagtagatcaagatatcaagattgtgacttgttaaatatatgaatttaatggctaagggtttttcagaccttttctcactctaaattaggctaccactagaacataattagaaccaaaaccaatgtaaagatacagtgatctgtacttatactagcagaataaatgcatgatttttttttctgaaaaatcaacttaaaagaagtagtaaaacaattataaaataatttaagccaggcgcagtggctcatacctgtaatctcagcactttgggaggccaaggcaggaagattacttgagcctaggagttcaaaatgagcctgggcaacatagtgagactcccatgtctacaaaaaattaataaattagccgggcatggtggtgcacacctatagttccagctactcaggaggccaaagtgggaggatcgcttgagctcaggaggtcaaggctgcagtgagccgtgatcacaccactgcattccagtctgtgtgacaaaacaaagccctgtttcaaaaaacaaaaataaaacatgtctttgtagaaaaatccagtttgcgtctttattacacttaaatgtttttgtaacacaatgtgatctaaacacataaaactgtcaatgccacccttatttttaaataccttgattaaagcagattctaaaatattctagcttactttaagttagtcattgtcttaacaataaaagctgatgcacgttgtgcaaaaggtaagcatcagagtaaggagttgcttaccttctgtagaaactgcattagctactgagcttcatgaaaagcattcatgtgaacactacctgacctcttccaaatgtctagaaaaacaaatcacagttgaaaaaaatcacccacctagaaaatgaacaaaaaaactggaaatttattaaaaataagtttgaccttctctcatgatgctgcagtcaagcaaaaatgaaaaataagtttgaccattatatttaaagtacatcttcccatatctaaataattcatttagtgctttatggtaaactttttatgtcttcttgcactactgcctcggcctgtctaaatgactaataaaaattatgatatctctgggatgaccagttctaaagcctaagggtaacagactctgtcagaaagaacagcaaaagatgttgggttttctttgtctttgaaatgctttgtcacgtgtttatctgtgcatatagttctaagccaaattctaccctgaattgctttaagccacaaagtagcaggttgtaaaatattgttgcataagagggcacctctagagcttgctcttctaatttttctaaaggtagaagaaattgacttttcacaattgtatttagatcattcttccatattaaggtattcaaaaacagaaaacataaaggatatggatttatgattatatcatttttatgtgcatttcaaaaggcccacaatacagtaatttattttattctatgcaattttcttgagaatgacagcatgtgagagagctcgttggatggggaggggcagtatatagtagggtagccatatttgagcttcaaggcactgtttactctgactccttcagtcaaaaggagcataaacccatttcacctagttcaggttaaggaattttttttttgtaaggaagatattataacagtggttaagacactgggtcaaaatatgtggggttttttgtttgtttgttttggttttttttgaggtggtgtctcgctctgttgcttaggctggagtgcagtggcgcaatcccgactcgctgcaagctccgcctcccgggttcacgctattctccttcctcagcctcccgagtagctgggactgcaggtgcccaccaccacgcctggctaattttttgtattttttagtagagacgaggtttcaccatgttagccaggatggtctcaatctcctgcctcctgatctgcccgcctaggcctcccaaagtgctgggattacaggtgtgaaccactgcacctggccccaaaagatgtggttttaagtcctggtaccacattaactagttgtgggactgctgtggtttgaatgtgtcccctctaaaattctagcattgtcaatgtgatagtattaagaggtggggactttaagaggtgattaggccttgatggctcctctctcattaatgggattaaggcccttataaaagaggcttcatgcagcatttggctagcttgctcttccactctggcttacccttccaccctcacaagacaccaaatgccaacagcttgatcttgaacttcaaagctgccataattgtgagacaataaatttctgttctttatgtattacccagtctcaagtattctgttgtagcagcacagactatgagagagactatggaaaagttaattctcttttttgtttgtttgttttttgttttttgtgtttcttttttagatggagtcttgctctgtcaccaggctggagtgcagtggcatgatctcggctcactgcaacctctgcctctcgggttcaagcgattaccctgcctcagcctcccaagtagctggcgactacaggtgtgcgccaccacgcccggctaattttttgtattttagtagagacagggtttcaccatgttggccaggatggtctctatatcctcacctcgtgatccacccgcctcaacctcccaaagtgctgggattacaggagtcagccacagtgcctggccgttacttaacatctctaagcctccgtttcctcatttataaaaatgaagataatgagtacctatctcatttgggttattatgaaagttaaatgaagtaatgtttataaagcacaacacctgatacatagtaaggattcattaagtgttacatattataagaggggtctcaaagaagtctcagacaagagccagaatgacaagttttcactgaaagtatagccagatggtgattgtaggttcaagtcagttctggagacctcagcagcagatactggatcttcactccagttcttcactaattaatcctactcagctgcattacgtgtctgcgtcttactgtctcacagtcagcttcccagcctgtctttgttttccattctggctcctaaaagagaacactgggttattagctcaattcactttttatacaatgtcatcagtaggacactaggagaaccataagttgtttgcccttgaacgagatgcctaccctttgttccatttaatagtaaaggttgaatttacgtgcacaaaacattctgcagtgctggaagtgatttttcttaaaagggtaatacgtggatgggctctataaacattgtgtttgcatgccttgtccactaccttcttcccatatttatagttctgaaaatgttccctacaacgtgatccatctatcatacaatacatggaacatcaaacagcttgtatctcaagctagaaacctagacgcccttcctgagtccttccattccctctctccaaaccgtcagtgagttcttttgattccgctttaaggatgtatctcaaatttgtccacttctatttctctgtcatgactttagcttaggcctgttttccacttactgtagtagtttcctaactgatgtctatgccttcactctttctggaactttattccattttctgtataatagccaaaataatcactttaggaagaagttgaattatttcattcccctgcttacaacctttccgttgcttctcactgcacttagcctaaaaatccaagctcctgtggtgatttaaaaaaatctatatgatctgctatgtttgtatctttatttcattccattttcacctttgcctgcatgatgtagctatactgtcagtcttctttcaggccttagacactttgtacagtggagtttactttgcctagaatgttcctcccctactctttaaaagtcaactcttctgtaatcatcctatctaaaatgggtcccttgactaatattctctcctgttactcagttctttttcatagtagcacttaacactctggaattgtcttatttacttatttgtttacttgtttttgtctatttcccccattacaatgtaagtttcagaagaacaggaactgtaagtgtcttatttaccagcgtatccccgggacccagcacagtgcctagcatagaagactcagtaaatattagttaaataaatgaatatatcaatcatatgcacagctgcaaaccgatttgcccctaccatcaagtaaagaccatttagtcggtatttctaggaatttggttattgaggtatatcataagaaggggttagaataagtcaggaaacagagtaggccatactttaggatcaggtcaacttggtttaagagtaacccacgctaggccaggtgcagtggcttacgcgtgtaatcccagcactttaagaggctgaggtgagacaataaactgagcccaggagttcaagaccaaccagagcaatatcgtgagacccccattggtatcaaaaattaaaaaattagccagacctggtggcaaacacctgtagtcccagttactcaggatggtgagataggaggatctgttgagcccaggaggtcaaggaaacaatgagccataatcatgccactgcactccagcctgagtgtgtatgtgactaatccagaaacagagagactgatcatactacctttagtatcacttaaaataaaggatgctgggctggggggcatggtggctcacgcctgtaatcccagcactttgggaggccgagaccggatcatgaggtcaggagatcgagaccatcctggctaacatggtgaaaccccatctctactaaaaatacaaaaaattagctgggcgtggtggcgggcgcctgtagtcccagctactcgggaggctgaggcaggagaatggcatgaacctgggaggtggagcttgcagtgagccaagatcatgccactgcactccagcctgggtggcagagcaagactctatctcaaaataaataaataaataaataaataataaaataaataataaaggatgctatggagagaatacatgtgttaggaaagaaggtagtatttaataataattgtactaagtagttatagtacagatacaaaaaatttattctcaagatcataatcctgaacatcagttcctgctgtaataggcagtaacatacaggtcagagactccagtcaagatttcataaaatatattaaagttatccagtagatctccaagttgattcctgacatcactctcaagtcccctaatacacacatcacactctcaaacttacaaatttggtttgccaaaatgtccagtgggaagggtttaattcagcagataatagaaccttgccctgtcctacctaggatctttgctgccattccttcgtttataggtgtgagtggggtaaaaagtagctcatccataaaggaggcagtgaaaatctctagtgaagagcactgagcctgggacataacctgtttcattttccacagcttctttacctcaagccacagaattgttcttagctctttaacttttgtcagcacccacatcaaatcaacaaacttgtttatttttcttctttccttactatctatcacccagaatagtggttctcaaacttgagcgtgcatcagaatcatctgaacacttgttaaaagatctgttgctggaccctctcccagggcttctgatttagtaggtccgtgatggggcttaagtgatactgaagcagctggttcagggaacacgctttgtgaaccatttctggaaagaattttacagtagattcccatttgatctctctgcaagcagtctctttcctagtaagttcatattccacacttctgccagagttagctgcccaaaagcaatgtaatatgcctcccctgtatcagagtttggttggctctctatttattatagtataaaatccaaatcaggctgggtgtggtggctcacacctgtaatcccagcaatttgggaagctgagatgggtggatcgcttgaactcaggagtttgttaccagcctgggaaacatggggaaaccccatctctaccaagaatacaaaaaattagtcaggcatggtggcacacacctgtggtccgagctactcaggaggctgaggtgggaggattgcttgagcctggaaggcagaggttgcagtgagctgagatcacaccactgttctccaacctgggtgatagaatgagaccccgtctcaaaaaaagtccatatcacatcatacaagatccttgacgatatgtccccattttgtctttcccgctgtgtccccaactcagctgacctttgactatattgcaaaataagctttgtcctgtcaacagcatggctttttttcctgcttataatgtctatctctgcaaaatgttattcattcaacacccagctcatgtcaccttctccaagatgcatttctaaatgtcccccaattgaggtgttatgttatttttaaagtgcatacgtggctttctctcctaaagctataaaaccctcaaggacaaacactgtgttttatccatctttgactcctttggtgcacccaaagcccagtacctagacattcaatagctgttggttgatggaatgaatccaggtacttctgacagattccagattttcactttcttttgtttcttataataaaaatgtagtatagaagcagtcatggcatgagtctagtaaactgaggattcagatcagtcaaagttataatttatcttattccctttcctaaagcagctagagataatgaaaataaaacctttaaaaagaatgtaacacctttaagttgactgcctcgtgtacactgtggcagcatatatctggtaatcattggtataggaggtaagtttaacaggccagtttaagacagcatataaatcatcactaaaggacagatagctaagaaagatggaaaataaacaaataattgaaaaaccagattgacccagaaatgactaagaacaaagtttgtgcagggagacagggagaattgagtttagtactgttagttgctgtaaaatatatcaggtttgctttaattacatggtaatgcttctaagaacaaaggtaattacatgataacttatgttactactcccatattatctctaaataactatgtaattagcttgtcactactatacagtgtgaagtttgatattactcatggataaagaacattggtaacttaagtgagtgagcaagggtggggtgagggatggaggcagcagggaaatcatagaattattacaatcaggaatgcaaatggttaattagatcattgcacccagtccttaaggatctgagccagagccatggagaataccaaacgagtctgaggtaaattctccatggcttgtcacagtgtcttctgaagaccataaacatacaacaaagtaagttgacaaagcacgcaacagatcaatgagtttgggatataatgcatgtaattttaaacagttccttttatttggggaggtttttcttttaagtaaatactaagaattttttttaattgaaaaatatttcactcatctcattttccaacatcctgaggttatatgtgtggcctatggggtgaggatgtgtagcactgggaactctcatttattgctggtaaaaaatgcaaaatggtaaacaaccactttggaagacaatttggcaatctcttacaaaactaaacatacttttaccatatgatctagcgatcaggctccttcgttgcccaaatgatttaaaaacttacgtcttcacaaaaacctgcatgcatatgtttatagcagttttattcataattgacaaaacttggaagtagctacatatctttcactaggtgaatggataaacattatcgatacaataaaatatgattcagccaacaaaaagtaatgagctatcagctgggcatggtggctcacacccgtaatcccagcattttgagaggcaaaggcgggcagatcacttgaggccaggagttcaagaccagcctggccaacatggtgaaaccctgtctctactaaaaatacaaaaattagctgggcatggtggcaggcgcctataatcccagctacttgggagactgaggcaggagaattgcttaaacccaggaggcgaaggttgcagtgagctgagatcgtgccattgctctccagcctgggcaacaagagcaaaactctgtctcaaaaataaaaaaaagaaagaaggaaagaaatgagctattaagccaagaaaagacatgagggaaccttaaatgcatgttgctaaatgaaagaaggcagtcttaaaggctacatactgtgtgattctaactacagtcatgcaccacataacattttggtcattgacagaccacatatatggcagtggtctcataagattataaaaccttatttttactgtaccttttctatgtttagatatgtatagatacataggtacttaacattttgttacaattacctaaaattcaatagaataacaggctatacaggattgtagcctgggaacaataggctataccatctaggtttctgtaagtacactctgatgttttcacaatgacacaatcacctagtgatccatttctcagaatatatccccgttgttaagcaactcaagactgtatatcacattctagaaaaggcaaaactatggagactgtaaaaaagtcagtagctaccatgggctggagctgtggcgcaaggagagagggatgaataggtagagagcactgaggatttttagagcagcaaaactgttttgtgtgatactttaatggtgtatattattatatttgtcaaatcccacagaatatacaacacaaagtgtaagccctaatgtaaactatagatattatttaatgataatatgtcaataatggctcatcgattgtaacaaatacacccactaactaatgtaacaggttaatcataggtggaactggggagtaaggggatgagggaagatttgggaactctctgtattttctgcttcattgttttgtaaacctaaaactgcccaaaaatataaagtctaatttttttaaacccaagtgggaaaacctttcttcgatccatcttattctactgacatcttgggtgtgtatgatggtctgtgtttcccagtgtcatcaatttcactgccttaaggtgctatggcttagacttgtgtcctgtggccagtgacctcacagtttttaccaaaatacttgttttcattgctatcacgtgatagctactctaagtatgattatccttcttaattctgttaggaatccccccggcattccctgtgagggaagtattagtccttgaatttccgtttcaaaagatgcgtactgatttacttggtatatagcttctgtaagaggaagtttcatttgggaaagaaaggttgtgctaaggttccctcagaaactttctaaattgccttctctaaaattgcctgtgtttccctaagcctaagagtaaaatacaggaaatagtgatgatttttatgtgcttgaggaatcttctaagaagagtgaccaattttattctacttatactgatacttgtactgatttaccttgtggaaaattcatccagtggctacaattactaactcactccaaaggcatgagtgggaaactattaaaataacacatcacttagctgaaactcttgaatggttgctcttaataaccatttttctgaataatttaaagttcccatgttttttaaaaaggtttattgacttagatctgatttgaaaagtgtaatgtagcttattatagaatatttaaaacataagaaaaacaaacaggaaaaaagtcatcccaactctagaaacttaacttttttcaaacacattttttttttttttttttttttttactattttgactaaacatgtttctaaatgtacttcttggatctgactaaagactaaaaatggaaggaaacacaagtagaaattataaagtcaggatcaggccagtgtggtagctcatgcctgtaatctgaaaaccttgggaggctgaggtgggaggatcacttgaggccagaagttggagaccagcctgggcaacctagtgaggccccatctctaccccaaaaaaaaaagaaaaagaaacttatttatttaatttcctctctttaaaggtatcatatgcaaaacagaaggtttgggggttttggggttttttgtttgtttgttttttgagacagggtctccctctgtagtccaggctagagtacagtggcacaatcatagctcactgcagcctcaaactcctgggctcaagcagtccccactaccttagcctcccgagtagctaggactaaaggtttacaccaccatgcccagctaatttttctattttttgtagatacagggtcttgctgtgttgccagggttggtctcaaactcctgggctcaagcaattctcctgcctcaacctcacaaagtgctgggattacaggcatgagctgctgtgcccagccagaagttttcattttagcacagtttaatctttcactttctggtttctgctttttgtgtgtcttatttaagaaatattttctacctctaggacataaagatattttttattttcttctaaaagtcttactatttttccatttacatttaactcattgatagacctggaattctttttttttttaatatagagtgaggtaatgttatttttccaaattgaaaactagttgcctaaacactacttttctaagaagccatcttttccccatgaatttgcaatggcaactctgttgtagctcaagtttccaccttttctctatttatttatagctatgccaacaaacactgcatttattattatagatttttagaagtatttaatctggtaagactagtctctcctatcatttttacttcagtaagtgtatatgcctgttcttgatcctttgctttttcatataaattttagaatcaacttatcaggttcccaaaaacattgttgagactgtgattgaatttgtattgaatgttatcttcttctccaataacccagcatatctctccatttaggtcctttgtaatatctttccataaagttctatagttttctttattagaggctggcataacttgcatcgcttttgtatttttaccaaattacatttttaaaactgttgctcttgtatatatatatgtgtgtgtgtgtgtgtgtgtgtgtatgtgtgtatgtgtgtatatatgtatatgtatatatgtatgtatattctatatacaaagctgctctcaatgaaaatattgacaaatttatttcttcttttacaattcctgtgtatgtgtggggtgtgtgtgtgtgtgtgtgtgtgtgtgtgtgtgtgtgtgaagatctcgcactgttgcccaggatagaatgagtacagtggcatgttcacagctcactacagcctcatccttctgggctcaagcaatcctcccacctcagcctcccaagtagctgggactacagtcatgtgccaccatgcccagataatttctgtattttttgtagagccgaggtttcaatttcttacccaggctggtcttgaactcttgggcttaagcgacctgcccaccttagcctcccaaagtgctggaattacaggcacaaactactgcacccagcctccctttacaattcttaaattttttttagtcttgttactcttgttagggcttccccactatgttaaatagtattgattttttattttattttattttttgatacagagtcttactctgttacccaggctggaatacagtggcacaatctcagctcaacacaacctccacctcccggattcaagcaattctcatcccttagccaaccgaatagctaggattgcaggcacacaccaccacacctggctaatttttgtatttttagtagagatggggtttcaccatgttggccaggctggtctcgaactcctgacctcaagtgatccaccagcctcggcctcccaaagtgctgggattacaggtgcaagccattacgcctggcctgattattattattttatttttattttttatttatttatttttgtttttgtttttgtttttttttgaaacgaactcgttctgtcacccaggctggagttcagtggcccgatctcggctcactgcaagctccacctcccgagttcatgccattctcctgcctcagcctcccgagtagctgggactacaggcacccgccaccacccccagctaatttttttttttgtatttttagtagagacaggttttcaccatgttagccaggatggtctcgatctcctgaccttgtgatctgcccgcctcggcctcccaaagcactgggattacaggcatgagtcaccatgcccagccctcattattatttttaatgggactgtgtatgttttctatttatttgtaattttactgtttccctttttccacattttctgcagttattgggtatgacttttataatcagaaaaacaatattttcacttgctttcttaaaaataaataatctcttagtgaaggcctgaggggtccttataggtgtaatatggatggccatggagctgctatggcttcaggctttatatatatgaggtattgctgtctattcacagtattctctgacctttaaatttatgtggcttaaaatctattttcaatgcataaacatttgtatatttttccaggtgaacaatgtactacctagatgtataataatttaaatttagtgtaaaatgagattttttacaacaaattatatatttccaaaaactttaaaatgtttaaactctacataggcatatggtggtctactatatataaaaggtttctgggaactatttaagaagataaaaatagagccactgacatgtatttgtactgtatctttgggaaaacaatttcagcgtaatatatacttgtaaaaagtgaattagtaaaactattctggccgggcacagtggctcacacctgtaatcccagcactttgggaggctgaagtagaaggattgcttgagcccaggggttcagaccagctgggccacatggtgagactccatttctacaaaaaatagaaaagttagtcaggcatagtggcacacacctgtagttctagctactcaggaggctgaagtgggaggattgcttgagcccaggagtacaaacaaaaacaaaaaaaactttattcctccaagtttaaaaagtgcagcttgcttacttgttgacaagctgctgaatatagaatgaacagtaatagagtctactgggttttaggttccagctaccatgaaaaactattaaggaactataaatagaaaagaaaaaatggactcataaagactttgttcatttccttctaaaatatccctagcttattaagtgtctccattaaggcttccgtacccactgacaatatttcttgattctctgtaaatgacactaagaaaattctagatgctatagctcttctatagtaactacatggaatagacagcttaagttaggaaattacattgccttttgagcacaccagcaatcctacctctgtgtgctttgaggaaactagtgtagcacctcctctttttgtacaactttaacatatgtttcaggtctcatgtcaaataccagatacaatttgtcaatttattgatcacattttgtaacatcagtaaaagtctaaataaaatcaaccagaagataataggctacaccaattgttaatgaacagaggtttatttggaaagattgttccaggattcagagccagctaacaatagctctaggaacccaatttattgtcgatgagagattctcaccttatgcctcgtcagctagaggacctaaagtctataacgtctcctaaagctgggaaaagcctgagaggcccaggttgatacgcctatgtgtaacaggatagagagaaggaaccaaagtaaaaaggcaacaacaactgcctcagcatatgagttcttgatttggaaaaacctgcactgatggttcttgttctctggtgtaatgcctcctatgcctgctctcttggctgtgttgaaaagcatacatacagagctgtgctcttcattttcaagatgatgtactgataaggaccacaagccagtggcactgggaaaaagggatcctaagagactttttcttattaaacatacattcaaagtcagttatttaatattttgctttttggactcttggtaagcccaaatcttgttctaaaaagagcagacttttttgttttgttttgttttgtttgagatagtgtctcactctctctcccattctggagtgcagtggagcgatatggctcactgcagccacaacctcccaggcttgggtgatcctcccacctcagcctcctgagtaagtagctgagactacatgtatgtaccaccacgcctggctaaatttttgaatttttttgtagggacggaattttgccatgttgcccaggctggtctcaaacttctgggctcaaatgatctgggtgcctcagcctccctaagtactgggattacaggcatgagccaccaggcctgacttgtttttgtttttttgttgttgttgttgcccaaactagagtacagtaggctcaatcacagctcactgcagcctcaacctcccacctcaagcagtccttccacctcagcctcccaagtagctgggattgcaggtgcatgccaccacgcccagctaattttttttttttttttatgtagagacgagtctccctgtgttgcccaggctggtttcctgggctcaaatgattctcccatctcagcctcccaaagtgctcagattagaggtgaggcatgagccacccaacctagccttttttttttttttttttttaatacctgcaagccacatttatctgctatagtgtttaccaaccacactctggggcctgaggctgtgtttcagtgaatgaaatattaaaaagtactttgtttacttgctgacacagtacagtatttgtatctattaatagcatattgttattgttggttttttttttcgaaaaacactttattggaataatatacttaaaatgcagggaacttttaaaaatagagtgaggccaggcatggtggctcacacctataatcccagcactttgggaggccgaggcaggcggatcacctgcagtcaggagttcaagaccagcctggccaacatggtgaaacccgtctctactgaaaatacaaaaactagctgggtatagtggtgcatacctgtaatctcagctactcaggaggctgaagcaggagaatcacttgaacgctggaggcggaggttgcagtgagccaagatcacaccagtactccagcctggatgacagaggagactctcaaaaacgataataataattataaaatagagggtgaaagaccaaacatcctatagaaaaataagcaaaagataaaaattaattcacagagagatttgttctttaaagatatataaaaagatgttcagcttcacttaataagagaaatccagattaaaattatactgaaatatttctaacccatcggactggcaaaaattcaaaagctggacagtgtactatattggtgaagttgtggggaaatgggcactcttacattactagtagaaatagaaaatccttaaacctctatgaaggagaatcactaataaaactatgtatgcatatagttactcattaacctagcagttctacttctagaatttatcctgaagatacgcccctaataacacaaaaatacatatgtaaaattttattcattgtagcattgtttatatttccaaaacattggaaactatgtaaatgcccacacataggagatagattaaactacagtgtatttatacatggagatactatgtagctgtaaaaaagaatgaagaaaatctctaccaattgatgtataatgattaccaggagattttggtctctgactacaggagtctcgctctgtcacccaggttggagtgcagtggcgtgatctcggctcactgcaacctctgcctcctgggttcaagcgattcttctgcctcagcctcccaagtggctgggattacaggcacccgccaccacacccggctaatttttgtatttttagtagagacaggatttcaccacgttggccaggcaggtctcaaactcccgacctcaggtgatccacccgcctcagcctcccaaagtgctgggattacaggcgtgagccatggcacccagcctccaagagatacttttaagtggaaaaaaagcaaagtgtaagagagcatatatagtgtattacctccttttgtgttaaaacaaaaaaaaaaagaaaagaaaaagaaagaaaaggaagaaaatgtacatacatctgcttacctttactaaaagaatacaggaagataaaccagaaaacagtgaaagtggttgcttaaagggatggtgaggaggacatggtaaagagagtcactcttctttgagcatatcttttatagaatttttacttttagaaacatgttaatgttctacatattttttaaatattaaatcaataaggatagaatgtaagaaatgggactaaaactgaaagcaaactgaaaaacatgaacccaactatttccaatcttttcttaagtaaaatgagctccccaaagggggtaaaaaagagaaccaatctaagttacatgctgaacacagtatttgactacaccagagaacagaaaattaaccctaaactctttttagtagatttggatttttttcttttaaagttagggatgaagtgacttggaaactattttagatgtattacaaaagtgagtaaacaaataaatttgttgatatttttgggagctaggttctcactataaaagaaggaacatacaaataatgggatgaggaaaggcaagaaagaaccctgtggagatggactagaattggaagtactggtgtcagctcaatttctaaaataggtctctgtacacatgtatacgtatacagttatggatgtaagtgtgtgtgtgtgcatgactatgtatacatgcatacttcccagctctgttcattaacatggtctagaagcaaagagcacagctgccacccagatcttggtctctaataccattctgtgctaaaaagaaccagttatcctcagataaatggctgattccagggcatagtagagcccagaacattatgccagaacataaagaagggatcaaaaataatgtgatggcatatccaatgacacgggagccaccagcctgaacggctcccactggcaaaaactggaatattttaaggaccaaattaattaagggctgtaagggattataaaccattgatttaaaaagaattgtgggccaagcatggtgtctcacacctgtaatcccagcactttgggaggctgaggtgggcggatcaccttaggttgggagtctgagaccagcccgtccaacatggtgaaaccctatctctactcaaaatacaaaaattagccaggcatggtggctcatgtagtcccagctgctacttgggagactgaggcaggagagtcacttgaactggggaggtggaggttgcagtgagctgagatcgtaccactgcactccagcctcggtgacagagcaagactccaccacacaaataaaataaaaataattgtgcattcttattgataataaatagattttaaaataataaatgggagaagaggtaggctcttgtttatggtagaatggtgagggctgactggtaaatgtgaaaatcatttcacagctgcagttggaaaatcatcacagtatgagttgcttcagttaaaaattatgagtggatactcaatctgggagggggttgggacttttgataaagaacagaatatttatgtgatttttttttttttttgagatggagtctctgtcgcctcggctggagtgcagtggcgtgatctcagctcactgcaacctctgcatcccggattcaagcgattctcctgcctcagtttcccaagtagctgggactacaggcacccgccaccatgcccagctaatttttgtatttttagtagagacagggtttcatcatattgaccaggctggtcttgaactcctgaccttgtgatccgcccccctcggcctcccaaagtgctgagattacaggcaggagccaccatggccagcctaatttgatttgaggatttgctcagtctgtcttccttccttctttccttccttccttccttccttccttccttccttccttccttccttcctctctctctctctggtctctttctttcttttttctttttttttgagatggagttttactcttgttgcccaggctggagtgcagtgacatgatctcggctcactgtgacctctgcctcctgagttcaagcagttctcctgcctcagcctcccaagtagctgggattacaagcaagtgccataacacctggcaaatttttgtatttttagtagagacgaggtttcaccatgttggccaggctggtctcaaactcctgacctcatgatctgcctgcctcggactcccaaagtgttgggattacacgtgtgagccaccgtgcctggcctatgtgatcttaaattgtctattcacaaactgcttgttagatgcaagggaaaaaataggtactatacaatggagaagtaggacaacaccttgatcaggtggtcagaattcctatcaccagtgcacagcagatggacatgatgtgcctctaaatgtgacactttgagaaggatccatcataatgtgtgtagtagtctgcctgggtgtgcatagtctgaacttaatcatgagaaaatattagacaaatccaaaattagaatcagtctattaaaaatgggaaaataaataagtaatgggataagcgcgtcagacacagtggctcacacctgtaatcccagcactttaggaggctgaggcgggtggattgcttgagtccaggagttcgagaccagcctgggcaacatgacaaaaccccatctactaaaagtacaaaaaaattagccaggcgttgtggtgtgcacctgtggtcccagctacccgggaggcagaggtaggagaatcacctgagcctagggagttgaggctgcagtgagccaaaaaaaattatgccactgcactccagcctgggcaatcagagtaagaccctgtctcaaataaataacaaataaattaaaaatgaggtgaggtaagttatgactatattcttcaaaaatgtccgtatctcaaaagtcaaaatctgaggaaatgttccagatttttaaaaactataaagataccacagttaaatcctgaactagactctgttccagaggagaaaatttccataaaggatattattgggtaattgactaaattgaaatatggacagtagattagataacagtgttactgaagttgatgttgatgtccacactgtagctatgtaagagaatatccttattctcagaaaagatacactgaagttttcagaagtaaaaagacattgtaaatgtaacttcctctcaaatagttcagggaaataaaattgtatgcagagaaagagtacatgcaaatggtgcaaaatgttaacaatattgtgcacctgggtagatgatatgcagatgctttttgtactatttttattcctgcaacttttttctgaatttggaatccttttcaaataaaatacattttaagcaggctaataattaaaaatctaaactaagattatattgggaaacattatgctaagtgaaataagctagacacaaaaagacaaatattgtatgatctcacttatatgaggtacctagaataggcaaatttatagagacaaaagtagagtagcagttaccaggggctagaagtaaagaggagtggggagttattgtttaatgggtacagagtttcttttggggtgatgaaaaacttctaaaaatgcatagaggtagtagttgcacattgtgaatgtacttaatgtcactgaattgtgcatttaaaatttgttaaaatagtaaattttatgttacgtatatttttcaaaataaaaaagtatcttggggatgtttacttccattataaaaggattccctacaattatttaaatataagctccctttgtttatttaaacaattttatacagctttcaagattcacatcagatactttttgaagattccacttataactgattatgtagtatctgtatttcattttagttggtttttaaaaatagattattgaaaaactgacattcaccttgggcaaaggtcttagcttttttcagcatccaggttctccacttgtcaaagcaaaagattcttcagaatacttcattcatcatctagttctcttagaaaaaggatgctggtggttttgcttcacaaaaatatttcataaacatgagctttttctttttctcacaatgatcataccaggcggaatgaagaaaacagatgttgcttataaggcgtctaatagacatgtttgcattgtaagctgatctgactctgaatttggcatctgctccattcactgtgtggactgagcattttcgcctcacagtttggcagaaaagttaatattgacttttgactgttacctgaaaacttggtgataaaatactcttactaaacctcttgagagagtgattttacagtctcagcaaatgtctttaaaatacatcattctattaaccattttaattttattctttggttgggaatacttatttgtttcatctaatacagagcattccccaaatctgactgggaaaagtctgtgtggtcagaatggtagaagaaggaggacataaatcacttataatgttctctacaggtcattataccacagcttctcaattaaccttcatccccctcaggctgcccagggcctcagggaaggcccagaagcctagctgcagcacagtttctcattattatctgctcttctgagtatttgagtgttaactgcagcagctcagcagctcaggtttcccctaaggggaaggtagcccagattcttctgctcttgacctgtcttatttgcaattatcctttttttcttttttcacagttttattgtggcataatagacatacaataaacggtatgaatctaaagtttacaattgtataactttggacatatgtgtacacccatgaaaccatcactatggacatatccactgctcccatggccttttctaatcatgccttcctgctccttctcatccccttttggattgtttccagtttggggctattacaaataaagctgctgtgaacattcatttacaagtctttgtgtggatatgtgctttcacctaccttgggtaaatacctagaaatagaacggatcatatgatatgcacatgtttagctttttaagactgacagatggtttgggaaagtggtcttagcattttacattcccacaattagtgtgtgagagttccagttgatcacacccttgccaacacttgttatagtcagtcttttcagttttagccattctgcgagtgtgcagtggtatctaattgtgattttaatttgcatttctttaatgaataatgatattgaacattttttcatttgcttatttggcatctatcttctttgctaaaatgttaaatacttttgcctactttgtgttgagttgtttcttgttattgaggtaccaagtatttaattgtgacaaagttcagattattttttcttctataaaagttgcattcttagccaagtgtggtaacttatacatgtaatcccagtgctttgggaggccaaggcgggcagattacttgagcccaagagttcaagaccaacctgagcatctctacaaaaaaatgcaagaattagaggaaagctgaggtgggagaagagcttcagcccagaaggtcgaggctgcagtgagccatgagtgtgccactgcactccagcctgggtgatagtgagacactgtctcaaaaataaataaatttttaaaaaagaaaagttcatactttttacctcttactaagtgatctttagcaaacccaagatcactaagattttcttctatgttttctcctcaagagttttaggattttattccttacatttatgtctgtgattcatttcaagtgaatttttgtagatagtgtaaggtaaaggttgaaatgcttttttttcacacaatttgttaaagtgtcctttcttgatgggattgtttgggcacctgtgtcaaaaatcagttggctatacagaagtaggtttatttctggactctgttcagttccattgatctatttgtctatatgctaataccatagtgtcttggttattatcattctataataaattttgaaatcaggtagtataaatcctctggctttgttcttctttttcaaagttgagtttttgctaacctaggtcctttgaatttccatataaattttagaagcagcttgtcagtttctataagaaaaatctgctagaatttttattagtattccaatgaattaatagaaaaattcctgcagaactgataatattgaatcttctgacctttgaacactttatgtctatttatttaggcttcttttatatttctcagcattgttttgtcattttcaatgtgcaggccctacacaacttctgtcagatttattctaaggtacttcaaatatttgaagtatgtgaagtaccttagaataaatatggataaatattcttaactttttaatcaatttttgtttttgagacagggtcctactctgttacccaggttggggtgcagtgatatgatcatagctaaccacagccgcaaccttccaggcttaagcaatcctctcacctcagcctcctgagtagctaggtctacaggcatgcaccaacatgcatggctaatttttgtattttttgtagagacaggatttcgccatgttgctcatgctggtctcaaactcctgagctcaagcaattcacccatcttggcctctcagagtgctgggattataggcatgagccacgatgcctggcttattcttagtaacttctaattgttcattgctcgtatgtataattatatatacacattaccagtatagataatttacttttgtatttttagtagagacggtgtttcaccatgttgattttgagaccctatcaacatatgcttccctggctgggtgtggtggctcacgcctgtaatcccagcactttgggaggccaaggcaggcggatcacctgaggtcaggagtttgagaacagcctggccaacatggtgaaaccccatctctactaaaaatacaaaaattagctgggcgtgatggaaggcacctgtaatcccagctactcgggagcctgaggcagaagaatggcttgaacctgggaggcagagattgcagtgggccaggatcatgccattgcactccagcctgggcaacaagagtggaactccacctcaaaaaaaaaaaaaaaaaggaagaccagattgacttgatggcaagttgttgtgtctcaacttgagctctttagaataaatattaggggaagctcatgatgtttgggaaaagatctcccgaccgggcacagtggctcaacacctgtaatcccaggccaaggcaggcagatcacgaggtcaggagtttaagaccagcctggccagcatggtgaaaccccatctctactgaaactacaagaattagctaggcatggtggtgcatgcctgtagtcccagctattcaggaggctgaggcaggagaattgcttgaacctgggaggcggaggttgcagtggccaagatgatgccactgtactccagcctgcgtgacagggcaagactccatctcggggaaaaaaaaaaaaaaaaagacctccctaacggtaacgcacaagactttctcttactgtcaaggctgaagaatgagacaggtgcttagatcatatattggtctgacccaatatgacatttctgctgctgttatacaatactcatgtgtttttttttgcctgtgttctaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggacacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataat

SEQ ID NO: 1514 - DNA, 558120 bp, Homo sapiens; identical to SEQ ID NO: 1513
  source 1..558120: mol_type = genomic DNA
